United States Patent 8,781,750 (CELL-TYPE-SPECIFIC PATTERNS OF GENE EXPRESSION) - sequence listing, part 29

SEQ ID NO: 36947 - DNA, 186231 bp, Homo sapiens
atcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtactgggcggctcggtgtggtggcgggggcgacgcgggacccagtgcgggcggccggcggggcgcgggcccggggcgcggcggtggaagaaggttcaggcatggcccgtgccccggacgcagccccacagtgtggcccggggagggtggatctcgggagcgtgtgtttttgtgtccacgcgcgtctgcgggccccaaattgcgtaactccaaggacttttcggagacttttgtaagtataatgctcagctttgtttgcccgggatttataagtggaaccgagagctgactcctgggtgacctcagataatcgggactcggagggtcaggacttagggccggggctggaaattgtgtatggattcagggtcggggggggagcagtttaaggaagaaactcgggggaaagttctcgttaaaagatacctctattccctgccccctccctttccgtgttaaaagttcttggtgaaatatctttctagccgaggttttttggattaatagataactcatcagccacattcttctctgctgagtcaaagaccccgagcctgggcggtgaacgcttgtgattttaggggccgtgcagctgaggggagcagagtaagagggttaaaaacgcagcaattcaccaaatgctcatcgagggtattttcataggactttgacttctgagcatgcattttaggtggtgcgtccgtaatcatgatgaaagttttgtgactgcggagcgttccttcggtggaaacaaaattgagtagatgtggtcagaaggggagtcggactcaggaacaaacgtttcagaattcagtaggatatttgtggtatcctaccaaatgactctttttgcaggtacgttatctggagtccaagaaattatttctggcgtacttcttaacatcccacacagttgagttcttaaacattctagaggaacttgagagtgtgtgtagatgcaggaaagtgcacgtctaaatatgacccgaaaagattcacacaggtattggatcctgatataggtgaacacagaaggtaaacggattctaaagcgttagaatgttgagatcattgttgagacactatgttgtgtgcaaacttcaattctgatagtgaaaccaaaattgcagaggaattcattaatacatacaacttctctgcacattgtccacttggaaaatggtaactatttagatggagaaggtagaggagcgagactatgccaaacaatgcaaaataaataggagattttactcgtcacccagttgtatggtagtgaaaacctaaatgaattgcagtcagccaaaaattgctttttcacccgaggacattttctattttattataaaagactatttgaagagttgtttacttgcatgttttctaattacaattgtaggaatgctactggcatttcttttttcaaagcgatggagagttgaatggtgtgttctgattttttttcttgaactttactggctgctttgctatttattttccctaccacttaaaaaaatttaaaaataatgacaagtgtgcttttttaggaattaccatatttaactaattcacttaccatatcaagataatcatcgcttcagaaatctttctgtttcagctagatgtgcaatctgtttgcttctcagggttagaatattatatgaaaccatctttctttattcacccagttgagaaaacttttttttttccttttggtaggtagcaaaagaggttcaatgtcctaaaaatcatacccacattaaaattaagtatagaaaagtcacatttttctgcttgacccctcttaacagctgccaggaccaagggattgcctgccctgttcctggacgctcctccgtccttgtgaggttgtgtataataatcgctgtataatcgcgggccattgcagtacagttgctgcctcttacttgtcctgttatctgacagcgttccttttcaggtaggaatggcatgtggctctagaaagtatcggtctttttagcaaaacacttgttatgtaaaaagtaaggggacacgtaggaagatttcagaacccaagttgtccaagagagatgtcgtgtacaaaacagttaagaccgtgaagagaggggggtttataatgtcagaaattgaggaaaagaaactaaggtggcctgaatgatccaggtaattttgccttaatttcctatttttggtttatattttgttcttgaaaaactcttaacctcttttttgtttttttctttctaaccctgaaagccacaggtaaaataaatagagtattaggtgagtgccattaatgtgcccggcattacacaaaaccactgcactgaccctttccctgcccacccattgtatcagcaacttgctcttaagcacatttaaaaaccttggcggtggactccagtaaacagaacacacacatacaacatagatatatacacgtaatgacgagaggaaaaatgtgtttcgttgtaatttctggtagccattgaactgacatggaaaaatgagtccaatcatcattaagggaaaatagtttatttcacagatcatgagggtggtttgggctttctccacattgtagaacccaagtttgtttttttctgtgtttctagtttcgaaacgaattccttctatcaatcagtgtattttagcttcttttgagagtttctaatgcttaccctgaaataattgtgctgaaatgcctctttggttctaattgtgtagaatgaacagttcaggatctaggagtatttttgcagctttttagggttggaagtttttgagaactttggcagaacatgtattaatacttctactttggatagcattgaaaactttgaggaaaaataatttaggatttggctagccagttgtgtaagagagatgatacatttaactttccgatttttaatgtattattacattaaatacatgtgtaatacacgtacaatgtattatacatgtgtgttccctaagcaagttgtcctgtaaagactaaccagttgtcaaaatctcactgagatttttaaggtttgtttatatatgtttagagtatcatgtcatttcttatattttacaattgataaaatgattcctagaatttctctaattgtgcaatcaaactttataaaaattgatatataatagatccataattatttgtcttacctaatcagttataattgatgagtttaaagtattttcaaatatatcaagaccttttctgtcttatagcttataacttatagctatagctataagctaacttataacttatagctatagctataagctaacttataacttatagctatagctataagctaacttataacttatagctatagctataagctaacttataacttatagctatagctataagctaacttataacttatagctatagctataagctaacttataacttatagctatagctataagctaacttataacttatagctatagctataaagctaacttatagcttgtaacttatttgttggtcactgaattttcaaaatagaaatttagattaaatatgtgatttggtttttatttctacttttatccatgtcattgagtacttttcaggctgattgtaaaacatctttaaaaggccttttattatattgaagcactggtgttaatttctccttaaattgctttgaattgacttgtacttataataaaactaaaaaagcaaaaaacgtggaagtgttggaatattgatcaaaaagatgtgcagaaatcatacagtcagttcttctgaggttaatacaaacctttactttgcattccttcttttaaagtgctaattttgccaaaatattggggttgtaaagaaaattatttcttaaaattgctgcagagagggtaatgtcagtttgatgtggcaacctcaaattttcattgagcattaaagtcaatctacattgtgacttcaggaaagtacagaatggttttatacaatttaaccaagattggggatctctgttattccaagttcaatccaatgcaataaacatatatttcagttgtagaataggatttggtgacaactgatgctccatgacccctgtcaatatggcatgcacttttgagttatttttccagtagcggtttaaacatttccctgataaacccttgtgtgcatctgcagtcttcttcattcccagtggcattagttttcagatgggtagtttggaaggggtggaagttctcttctggagatggtttcacatgattttcgtaggttcatgttaatttttgctttaaggataaaagtgttcagtgctggtgacaaggcaataaagtgggtacttttgtgcagagcagtggtgatgtaaattagtgtagcttttcagaaaggagtgacactatcaaaatgtgttcaggccctttgatttagtacctttatttttagaaatttaccctaagaaaacggtatcataaagatttatatataggaatgatttttgcagtgacttatgacagtgacaattcagaggcactctatctaacatgggaaactgctaactaaatcattgtataattctggaaggggaatattgtgcaaccactaaaggctccgtttttaaagagaaaaatacatggattataaaatatgtattatatataaattcatatttattatgtattatacatatgtggttatatactattctctgtgttctggaggttagaaacctgaagtcaaggtgttggcagggccaccgtgctctctaaaggctggagaggagaacctgtccttacctctttgagcttcagtggctccagacattctgaagactatatttttattctcatgttgtaatattaaatgaaaagaactgattttaaagttttatgctatgtgatgccagttctcaaataaatgtatattcattcataaaaccaaacattaattgtatctaattggtggattacagatcattgctatttactttctgatgcctttcggtgtttaagttttcgaaaatgaccatgtgaacaaaaagaattaaatgtctttttgctttgagggtttccttgaatcgtgatattcacaaaaccgaggttggtcacatttagttttgctcacaagcctagcggtgagaatcaggtctgccttgttcctcagacatagtctttcttagtactattagtatttctcttactcattcccttatcttgattgtgttagtgatcttcagctgctctcctgttctgatgctcttctggagtccatccttacaccatactgctgggccctccaatgccccgaatccttcagtgctacttggtactccacaaagtcaagtgcgcacatggcgttcgggattgccctcacctacctgtatactgtgatccctttgctaagaggaagcctaggtcttcctcttctgttctcttgatctagtctgagctgcttttaagccaggattcaagtttttcagcctacatttttgcaagatccccctcacctgaatgtcccatcccatagagatgatttttcattagaatttcagtaaaagttactttctgttatgtccatttaactcctggttattatttttttcagctatttattttgtatgggtctatgccattttacagtattcccaatgttcaacacctaccccagcaccaggtaaatctcctctgcacacatccacacttacatatatacacgtatataattctttgtaaatatatatgaaatagccttattggtgaggttggtgattatgagtttgtacaggtaataagaagcagccactcgtttaatattgaggatcccttctgtgctctgcactggggaattagaaaaggtgtggatggatcggctggaaaattacttccatccctttgtcattaggaacctccatttgcgagcacaggtgagcctgcctggtccatcaaatagccactgctggaaaattacttccatccctttgtcattaggaacctccatttgcgagcacaggtgagcctgcctggtccatcagatagccactgtcagtgtgggactgcttgtcccaaggtgcatttgggttttcaccattagaatttggtttctgctgtggaattccatttgaccttttggacgagggcttccagaagccttggttaggtggaagagcatggactccctgtgttcccaaacaagcctgctctgtgtgacagccactttggaatgtttgtgttcagtttcatttggcaccttagtgtctgcctgggggtaggggaaagggaatgcaaatgttcctcttgaacagtgcttgctttggtcaaagaaaaaaacttaggaaggaatgaggagaatgaaccttaaaagctggtgcagaagtggctgcatagctcagtgggcttgaggccatctgggaccaggtatttaaaatggatgctatgttggtatgaacaagtcagttccatgcccctggtggggatgagcttatttgtcatatggggataactcctcacactcacatccctaaagtgtaccaggagaatattgtaaacaattttattgcactatattttctatgtttggcggtggaggtgggaggtccttgatattatctgaaacatgaagctgagtaaaggggatatgtctgtggtatcagaagaaagctgcttggcttgtcagtgttgctgatagcaggaaaaaggaaatactgaaatctttagcctgcagaattgtcagaaatctttttatctattcattaaataattatctcctaacttttattgagtatttactatgtgccaagctgatgaagggattatgatgattgtgctgctttgatggggaagtggctgaagccctgaaaagctatggagccagggtcttcatgtgcagattctagagatgccaagatctgagagaggcagttcctgtcttaaagttgctcacagtttaatggtgatgcccctgtatgaacaaacaggtataaccacgcccgaggttaaagtagaggtagttgagttgagcacagccaaacctgcaaggaagggatggagctgtgtcacagaaagctttaaagaagtttaaagagtcagttctttaaagatgacgtatgagctaaatctcagttaagattttgactgatgagaaaagggttcagacagtggggaaaagatgggctaggcaaggaaatcgctctgtgaatgaacacacagaggcttcaaaagacccttttggggaagagcaagcaaggcatggcaggagagaagaaggggaaggaagaatgaaactggggagggggcactggcccacagtgggtggaagagctgcctctgcattagggaattggactttgtcctctgatggggcaccagggtggatgtgccccagaaggcagcaatctaggacgtcccaatgggcagggggatgtggcgaattttggaaaagttgttgagaaccattcttgcagtgaggtttctgctgcaagagtcctggtctcaaagtgaggcagcagcctggcagtggcaactgaggcagagatgccaggtgttcagggcctagataactgtcagatgtgcgggagagaaggcaaggagacagcctagcagccttttgggtttctccttcgggtggctagctaagtgacggttgtatttgtaggaatagaaaatagagatgtggaaagggtaagaaaagaaggtacctaggagatgaagatgttactgagtctggggtgcagaggagaggtctgatcttgaaatacgattttcagaacaattcaagaacatagagctgataattgaaagcgtgcatactgggagtgagtgcccagaaaatggaattcctgctttctaggaaacgttgtgagggttagcaaggaaagagatacaaaatttagtgaaaatttagagtcatgttaaaaagtgtttgggaaggggagagaattgaaaataatcaagaaaaatggaaacttaaaaattaatttaggaacataaaaatgtattacatataatctgcctgtttttaaagggtttggtatacttagccattggaaagcctgagggggagcttagaaaaatctgatatatggtctttctcatatgcttttttttttgctttgctcaaaactcaggaacctgtttataaacctcccaaacttgccattaattcccaggcttttacttctccaactctccatttgccaaccctgcacctaaaaggaaagatcaagctaccataaaatctggagaggcgtgagtttttttacaggaaaaaatttctaagttgcttttatcttttttgacttttttggggaaaaggaagagtaggatgagcctttggccagcagcccaaagacatctaatctgtgggttatattttcattttcttttttttttttctttgagacggagtcttgcgctgtcactcagcctggagtgcagtggcgccatctcactgcaacctccactgcctgggttcaagcaattctgctgcctcagcctcccaagtagctgggactacaggcacacgccaccacacctggctaatttttgtatttttagtagagacaggggtttcaccatattggtcaggttggtctcaaactcttgacctcaggtgatccacccgcctcggcctgccaaagtgctgggattacaggcatgagccaccatgcctggccatattttcattttattcaatttatactttaaaagtttgctgcctttttcagcccagctaagtgtcagctcaaagtagtccaggaacttaaaaagaaaacaacttgcatttgtatttctcttaggttttaactctactgcacctattatggtgacggtgcatattgtgtaaatgctaaagagaaaaaggaaatggcagtgataaatgccagtcacaccgagaagatggattcacattccaggttgtaatacagtattgttacacaaatttaaaatgcaaagggaatgcttagccagttccattctgtcagcctttagggttttgcaaaggtaggagacatctgagaatctccaaaatgaggtctggctcaccaacctctgcaaataagttataggacaactttacttttaattaacttttatttctcatgagttgatttttttgtgacgttcctcttgattttcccagattctcatgtcaccagggtagataggctggcagtggccaatgttgttctaagagaaatcctaaagactacccaatttttttttttcttgaatccgcaggatcctgttttgtgaaaattcctcttacgcccacctataggatagacagtggaggccccccctgggagaaagtgtacacagaaagtgctatctaattacagaagtagcagaatttcctttgtgctcagaggggaagtgctacaaaagtgtaattactttacccagcatgtgtgatttacgggacttaaaatgtgtgagtttccaaagagtcatctgtttttaaatacagtatccctcccagccaggcaggatgtgtttggggaggtgggagtgaggacatgtacttccgtcctgtgcctgctgcaggatgcctggtgacaggggactgaaaccactggtacttgctgcccctcagggtcttgcttatctgagtagaaggaagaaaatcagcaaagggctggaatctagtcagctactcccagaccagatcatccactgctctcctcttaccttcccaagccaaattctttttctaggacctccaagacttttcccagtaataagcaaaagaattgttagagtgaaccctgagaccgtttttaaaatttatttatctttctttctttctttttctttttcttttttttttttttacctgtttttatttgagatggagtcttgtggtgttgcccaggctggtcttaaaactcctgggttcaagcgatcctcccgcctcggcctcccaaagtgctggaattatagacgagaccatttttattgcacaaattttcttttcaatcttacttttcctaatatgcttaagaaaatcagtgggagaattgaagatcaggtgcagtggctgggccaggtggctcacacttagcacttcatgaggctagcactttaggaggctgaggcaggcagatcagttgagcccaggagttcgagaccagcctgagcaacacggcaaaacctcatctctacaaaaaaaattagccaggcgtggtggcgtgtgcctgtagtcccagctacttaggaggctgaggtgggaggattgcctgagctcgggaggtcgaggcggctgtgagccatgatcgcaccactgcactccagcctggacagagtgagactctgtctcaaaaaaaaaaaaaaaaaaaaaaaaaaagaccaggtgcatatccagatgtaatcaaacctgtaaaaacacttaatggtttttgcatattaatggattgattaaacatttatggagttggtgtctactctgcttttaacattgctctttgacaaaccatatgaagtgttgccatcccatgttttgggataagaaagctaaggctctgagagattaagtaattggtctgaggttttacagctggtggataggagcttaaaattctccagtggcatatgaggttcatgtgatccgggccctgctggtttctctgacctcatctgccaagaatcacagcctcattcattatgctccagctgcctgggctttcgttaggtgtctccaacttgccaaacttgttcctgcctcagggcctttgtgcaagccattctgtatgcccggaaagccctacactcagacattatcagcctcatccttgccattcatttagatctcaattcagatgtcaccccagagagacctttgacctccaagtttaaagtagccctatattcccaacccttttattttccaaatagtacttcttacctcctgacgttgccttgtatgcttattgtacttatttggtacccttggaatgtaactccctggcagcagactgcctgccttgtttaacactgtacaaacctcagatgcctaggacaatgcccagaactgtccaataagtttttttgtgaattgactagaatgtaaatctgctttacagacgccaaagcctgtctgatacactgtatcatcataaacctttttcagcagttttcaggttaaactttatatttctgccttgaagatgatcatttctggtcctcatccccactttattgcatacaaaaccgcagttgtcatctcacacacttttaagctggaaatgttcagatggtaagtgataagagcccttgtcggggtatgcagcagtttttcacacataaacgaatccttcccttttgtccacttaggatgggaaacctactaattccacagaacgaggagagggatgtgggcctggagtgtagggaatgcctaagtaccagtagggcaaggtgaatttgattcctgttttgcagatgtgactgttaggttgttagggttaatttaataacccaggtggaattgatttggagatagacttaccacttctgatcctttgattggatctagcctccagctcaatataccttcctcaatttgcctacaagaagaaaaagatctgaagctcagcataatgctggctttagccagaagaatccagcctttaagccatctatatgtgtagccatgaaggaccttctaatatgccttgtgagcccttatggggccacctcacagccacaatttatgcccacgtgtcagcctcacagactcaggagctgtttctattcattgtaaagcagaccagatgacatttcaggatgaaagaaatgtaagtcatcattacatacggcatcaggctaacaagtcacctgttagttgagcagactagttagttggtgaaaatgcatcgatgaaaatgcagaccattggattatcctcatttatagcatttatgtcacacttcaccttcaacaaacttggttaacttaaccatcgtccattacctgatagtcttagaaccaatagtatataaatccttatagaagttatttcttgaccaatcaattcatgagtattctttgttttctctcttattatctcattatctctttgtttctaagggacctaggacaagccactgaagctgcttgtctttgacaagtcattttaacctgtttccttaactaaaaggtagggattgtatagacagcacctgtggtgcattaaaagaaccataaatctcatttttccactttcattccactttccatttccccattgtgatgcagaaagctgccgtggcgtgccaagacacatccagggtgggctgtttggggggaatggttttaattttaagccttttaagtgaaaacccttagaccttgcctctgttttgttaaattacgattctaacaaaataagaaaaaattagtgaagcactagactttggaaactctttcctgtatatttgaaatgattttcttaagactgcttttcttacctgaaattgttttgttttttcctaagcaaatgagtgcctctccttgagaactgggtgggagtctctgggtgtgagagaacagcaggaaatgaccctttctaaacaaaaggactctttaaggcctatcctgagtctttgtgttttgaggaggggttatgcagaaaaccagagctaggaaatgaatctctgcattagccattctaatgggggaagggagaatggagaacattctctccttgcacgccctcccaagtatctaatgccagggaacacttactgtgagatccaaagaagtgcagaaaagaccctgggagcctaggtggtggttcttcaggagtgcgtggcttcaagtcccctaaaggaaagaaaaaaccaggttgggcagaacgacacccaatgtgatgttcacctttaacctgggcttccagaatttgcttgaaaaagctcatgatcaacagaatgcagaaataaatacaaaatgaggaaagtatgagagggattttgcaagatctatttgtcatatatatctttttgtttttgttttttttctcaagacggagtcttgctctgtcacccaggctggagtgcagtagtgtgatctcagctcactataacttctgcctcctgggttcaagtgattctcctgactcagcctcctgattagctggaattacaggtgcctgccaccatgcccggctgattgtttttatttttagtagagacgaggtttcactgtgttggccaggctggtcttgaactctgctgatctcaagtgatccgcctgcctcggcctcccaaagtgctgagattacagtgcctggcctgtatatatgtttatgatcgatttatcatatatatctttatgatctgtttatccataggtagaggttagagtgttatgatttgctaataaatacccagtaaataaatcaaagatttgaattactgtgttaatgagaaaatgaactttgaggaatgcaagtccttttaaatgatcaggtccagagggactttaaaatgagaccacagtcaggtcctactcccctcttgagctatatattcacctctctgtattcactgcttgctgttgctagaagtagctataaattaactaataatgctgcactggacactgtaactcactctatagtttaacaatgtatatagccaatcactaatcagtataatttgtgtaaaccaatgagaattcctggcaaacaactttatatcagcccactcccttgtccctgctcctttttttttttttttttgcctttaaaaagccacttgtaactgctttttaattggaatgcataagcccctgggttgcagtcttcaagcttggccaaaataagctctacttatattaattttgcctcaccttttatgttgctatcaacttcttttctcaatctaagctgaagagggaattaataatcattgctgtgcgaggtagtgggtctgtaatgaagaaatgttgagccttgccctgcagtggaatgttccctcctctcctcacttcaaagtgaccattcattgtatcagtatttgtgcaaggagatcccaaatttaaaatgctagaaaaggggataggtcttatcaaaattattttgcctttataaattcttgctgtcttggagcaatgaacttctctgctcttccagggacactcctgtttttttttttttcaaggaatataaatctcactaataattagaaacacacgtcttgttgaaaatggttttgtggtttacttcgtttttagaacatttgaaaacgacaaacatcttttctaagaaaaagcattgtttgttacaccaccactgtttgtaggcttttcattgtaactatatttttagaaaggctggctcatgtgtttgatggggactctgtgttgagggtaaggggctggtttatttactccacagcaccagatgctttacagaattaaagataagattaaagctgccactcagatcccattatgaaagggttttgtttatatattaaaggcttggaagactctttatcttagatatgaagccagcaatgcagtattcaaaagagatgtgatcattgtaagttccagagttgatagggaaaaattattctcactgaaaatcccagtgtctgaagtgttggtaggttttcttttttttttctttttttttttttttgagacagtatcgctgtgttgcccaggctggagtgcagtggtgtgatctcggctcactgcagcctccgcctcccaggttgaagtgattgtcctgcctcagcctcccaagtagctgggactgcaggcgcctgccaccgcacccagctaatttttgtatttttagtagagacggggtttcactatgttggtcaggctggtcttgaactcctgacctcaggtgatccgcctgcctcagcctcccaaagtgctaggattacacatgtgagtcactgcacccagccggttttcttcatttcttttttcttttgagatgaagtcttgctctattgcccaggctggaatgcagtggtgcgatctcagctcactgcaacctccgcctccggggttcgagctgttctcctgcttcagcctcccgagtagctggaattacaggtacacgccaccacacctggctactttttttttttgtatttttagtagagacgcggtttcgccatgttggccaggctggtcttgaactcctgacctcaagtgattctccgtccactccccagcctcccaaagtagctgggattacaggcctgagccaccacgcctggccctcattttcttaatacatcatttaaactcctaatttgagaaaggttaacgtataacgttgtaacaattggtaagataccaatttacaaatatggaaatatatattagattcatttggaggaggttgtatatggtatacgattggcatatgtttttcattctgaaagtatcagttattttcctgttattatctgtggtaacattgcttgttttttttgttgttgttgagacagagtctcgctctgtctctgtcgcccaggctggaatgcagtggtatgatcccagctcactgcaacctctgtctcccgggttcaagcgattctcctgcctcagcctcccaagtacctgggacttacaggcgcctgccaccacactcagctaatttttgtatttttagtagagatggggtttcactatgttgaccaggctggtctcaaactcctgacctcaggtgatctgcctgccttggcctcccaaagcgctgggattacaggcatgagccaccacacccggccacattgcttgtatttttaaaataaaagattaaaaaagaaaagtgtgatccattctctaagctgcttgccaccatgcaatattgagtcagaagaatggttctcagatcccgtgcattaagaactatttgtgtatcagccttctaaagcatggcgaataagacaacatacgcagtggagacacgtttcctgggatcatttgtggtcgagatggattcaggaatgtagcgtgtctgattttattgggtgcaggaactgctttttctatagctcttggtattcatgtaactgatggttaaccccaaatcaaagtgaaaatgtcctgagcaggcatgtttgtccattctctccatgttcttagatcatcaaagggaagttcttgccctttgcaagactagcatctgttgccatttggtcatagtgcacccagcctgctgactctgtatcttcaaaacaaaaacaaaagccagtagggagggagcaaagactcaaaagtgctgtggggctttggaatactgtgagtttctgattttggtaaatgtacatccaagatgttttaaccattaaatgtcccctcttctacattccattaaaccccactggcctttaatcaacatgagaatttctcttgtaatatcttgggttgtgattagacggatagaggaatcctattggtgtgagcttaccttgaagtcaatgaaaaagtgttatttttccttttttttttttttttttttttgagacagagtttcgctcctgttgcccaggctggagttcagtggcacgatctcagctcactgcaacctccgcctcctggattcaagcgattctcctgcctcagcctcccgagtagctgggactacagacatgcaccaccacgcccggctcattttgtatttttagtagaggtgaggtttctccgtgttggtcaggcaggtctcgaactcccgacctcaggtgatctgcctgccttggcctcccaaagaaaagtgttatttttccatctactggtacttaaagtcagcccaggcaaagcctgggtgctgctcagtgcaggagactcaggcgtggaaatgcagcagattgacctgggtccctcctcccttaaaccagtactctgaaatctcaccacgtaactaacaagccctgtactttccaaattgacatcacaatcatagtcttgccgtggccaggtggggtggctcatgcctgtaatcccagcactttgggaggctgaggcgggtggatcacctgaggtcaggagtttgagaccagcctggccaacatggataaacccccatctctactaaaaatacaaaattagctgggcatggtggcacgtgcctgtaatcccagctacccgggaggctgaggcagaagaatcacttgaacccgggaggcggaggttgcagttagccaagatcgcgccatcgtactccagcctgggcaacaagaacgaaattctgtctcaaaacaaaaacaaaaacaaaaacaaaaacgcttgccgtaaatacctttcctccctccccacgcctaatggattaatttttagtcttataaattaggaaatttctcatatagggctgacataaagagtaagcgttattgttcatgtaaagccctgaaatagtttgcctttatcgaaagctctagggtattttcgcaattattttgttgtgttaaaaatatggagaactaccttctaccccaggtggtcctcagcagagcttctgtgtggagcagaaagttttctcctgggatatttttgcctattttaagccctgtcttatgcttatttctgttggtcatttctcccagcatttctcaaaggaaagatagtaacgtattgcttctattttagggattaaagaatgataaatgtatggggtttttaattttatattttaaattgaagctaccaagattcataagccatttgttcatctaattggatcacattgtgttcaagtttcttttcactgtttttgttttttaaaatacaatcttaaatagttaccctttctctcctcaccatcattagaaaacacaagtaagcaaaaaaaaaaaaaaaagattaaaaaaggaaacaattctataattccctcacaaccagtgttaatacctcactgcgtatcttttacatgttcttttctctgtgtgtgcacacatggcatctatcatctgtttgaacaaaaatgagatcataataggttttccatttatttcacttaacagtattttatgaacatctttgcatgccattggattcatttctctctctctgttttttgagtcgtcgtcttgctgtgtcctccaggctggagttcagtggcacaatgcgatcatagctcactgcagctttgaactcttggcctcaagccatcctcacacctcagcctcccaagtagctgggactacaagtgtgcaccactatgcctggctaagtttttctattttttctgtagagacagggtctcattatattgcccaggctggtctcgaactcttggcctcaggtgatcctcccgcctcaacctcccaaagtgttaggattacaggcgtgagtcactgcatctggccaattggatacattcctgcagccaaattttaaattcttcctattgtgctatagtatggatgtgccttaatgtatttgacccaccccttattattgggcttattattgaacttatttccagcttaagtgatagaaacagtgctgtacatcctcctagctaaatctgtgtatacacccttagtgatttccttagcttcaactcttagaagtggaatttctgggtcaaagggcatgcattcttttaaagatatttgatgtttattgccaaatcttctctagaacactatttccactaagaaaatcagcaggcccattccttgcatcccctgcccctgccatttaaaaatgtccaaagattgttccctcactgtggagtttttcatatttgtgtcccatccgtgactcagaattaatattccagcctcatctgtataacacctggatgttatatagtgacttttttttaacctcatttgaagacatatcccagttgtgtttcttatacttcactggatacaaaaatgcttagcagataatttctgggggtgtcattcttgagtttatcggacaccgtgaagtgtgttgctttttgtgtgttaggtgcttgctatatttttctggctattaatgtctgacgatgaggccagtattttaggtgttgtgagtgcaagtacagaatttgagtcagctctaacatttgtcaggtaaagcaataacactgccaattaaaactttattgtaagatgcatcctgatttcatagatgttacagtgtggaaacatgtctcagaatcagtggatatgttattctctcatctacttttctggtcacatggttggtttgctcttgagatgagaacagagacacactggtcagtttgacataagttttggtggacagtgagccaagtatatccttggaaagaattttataattacagttgaatcaacaatgcttcaatgcctttttttttttctttttttttggaaatagggtctctgtctgtcacccaggatgtggagtgcagtagcatgatcatagcttactataacctcaacctcttgggctcaagcgatcctcccacctcaacctcctgagtagctgggaccacagagctgtgttgccacaccctgctaattttttttttttttgagacaaagtttcacccttgtcacccaggatggagtgcaatggcaccatcttggctcactgcaacctccacctcccgggttcaagtgattctcctgcctcaagcctccggaggagctgggattacaggcgcctgccaccatgcccggctaattggtctatttttagtagagatggggtttcatcatgttggccaggctaatctcgaactcctgacctcaggtgatccgtctgcctcagcctcctaaagttctgggattacaggcgtgagccaccactcctggttcaccctgctaatttttaaatttttgtgtagagatggggtcgcactgcatttcccagacttttctctaactcctggcctcaagcaatcctcctgccttggcgtcccaaagtgttgagacttacaggcatgagctaccatggtttgccccacaatgccttttattaggtacagaccatggtgtatatcgccttgtgaaaatgattcttttcctccctcttcaaattgaggatgctgccttgaagctccagcatgttgcagccccttaagtatttctcaggatgaaggagagaccattcagggcaattgcatcttccctggaggggctgttttcactgtgatgcccgcaacataccaagagtggaatcctgtctgaggagtgcagctccggtctcaccatgtgggcagggcaatcaccattaaccccagcccacaggccttcttaattgttaacagacattctgagaagtgcatgccctccacaaagcctacacacatgtgttcgagtgtgactctaggaaatgagcagatgtaatggaaacctcagtattgactcatcccgattgttatatatgagtggaatttgcatctcatttagtgtttatttcagtagattccagttgaggtcatggagtgctaaatttatatgcatcatagcacctttctcaaaggaattgggagctcttttgcaaaacaaaagatgtcttcttttcccttagcccttggttttgtttggcagatggtgtaggtgaagagaacattagttgtggaagaggtatgtatgactcccttgggtacagtcattgatatttgttaaagacagcctgagagtctgttgtcttggcctttctgggggatgaagaagttgttactgagaagcagttttcctgccttcttggaaagacctcagtcaacacaggaaacaatgggagaataacatttgatcctacctaaatggacaacattgtgtaatatgggcggagagggcttagaaattcagaaagagatcagtgtggaccagaataaaaggctttgagaaagaaaggtggaccttgaggaactggtaatatttaaatagaaatgggtactggcttaggagagtttcaccatcataaaagtttggggcctggcatggtggcccatgtctgcaattccggcactttgggaggtggaggctgggaggccgaggtgggaggattgcttgagtctagaaattcgagaccagcctggggaacatgatgagacactgcctctataaaaagtaaaaaaaaaaaaaaaaaaaaagattagcaggcatggtggtgtgtgcctgtagtcccatctacttgggaggctgaggtgggaagattgcttgagcccaggaggtcgaggctgcagtgaactgtggtcttgtcattgcactccatcctggacaagagagtgaggccctatctcttttaaaaaaaaaaaaaaaaaaaagttttggaagtaagaatgaatgtagcacatttacaggagcagggaaaagctgtatctattactttttaatgaatgaattgtatgtatttggggatatattaaagaatttttaggctgggcgtggtcctcatgcttgtaatcccagcactttgggagaccaagtgggaggattgcttgagcccaggagttcgagactagcctgggcaacatggtaaaaccttgtctctacaaaaaatacagaaattagccaggcctggcggcgtgcacctgtagtctcagctatcaggaggctgagatgggaggatcaggatcacttgagcccaggaggtcagagccacagtgagccatgattgcgccactgccctcagcctgggctgcagaacaggatcctgtcttaaaaaaaaaaaattgttattatttgtcaatgtcattggttttccaatcaggcctgttccacaggtgattgatacacaacctgggaagaagttagacacctgcagaacccaatgccagttaagtctttttttttttttttttttaaactcatttgggtcctagtatgcaaggccatgcaagctgtttagatgaccatactggaaaaataaggaatatttttctttggttattcttccctaagtttcttttttattccagcagggtgcagtggtgcaatctcggcttactgcaacctctgcctcctgggctcaagcaattttcccatctcagtctcctgaatagcagtcacgtgccaccacacccagctaatttttgtatttttagtagagacagagtttcaccatgttgcccaggctggtcttgaactcctgagctcaagtgatcatccccactcagcctctcaatgtactggggttacaagcgtgagtcaccacgcccagccttaactttctggatgaagccatttactccataactttgcttattttttcctgttttttgtttttttttttctttttgttttttttttgggtgggggggtgcttcttcattctgcctcttcagaacagcatgactgtttatcagccgtggtgactcttagcccaatgtataattcctagatgatctagtcatcccaaaggtactcaactcctacttggattaggccctgctggtgcaatgagcagcaaacagacattgtccttgttcatcctggaagttacagtgtagttgaaagtgtatattaaacagtgaagcaccgataaatagagaataactgtaataagtgctagggaggaagagcgcagttgatgtgagattgatagttgatggtcacaaggggacctttttgactttgttctaggtactattcacatcactgggtgtgaactcagtcatcttcactgtgctgtggggtagctatccaccactgctcctcccagtagaggaggaactgaggctcagtgagttgaataacttgccctgggtcacagctaataaataacagcctggatttgaacctggtcagttagttcaaaatccatcatctttcactagacctcattgccagtttagaggtactagagaagtttgcttcaagggaacaagagttctcttccttaggcccatatctctcaggatcctgcctccctaaacagaagagcttgcaacacaggacttgtgtaagctctcagcaatcagtaatgtggaaactaatcttgtcaaggagatgaccagttacaggatccttagtttaagaaaatctaaatggccttgggcttactcttacccaaatctagtcttttctacttcttccatcctgcctgtctagacccttaagttagacccccagaacctcattggactctccccacccttagtccatctaacacgaatggcagattccttttccaaaggcactactccagctgggcacagtgcctcacaccagcaatccagcactttaggaggctgaggcaggcggatcacctgaggccaggagtttgagaccagcctggccaatgtggcgaaactctgtctctactaaaagtacaaaaatcagccaagcgtggtggcgggtgcctgtaatcccagctacttggaaggctgaggcaggagaatcgcttgaatccaggagaaggggtttgcagtgggccaaaatcataccactacattccagcctgggcaacagaacgagactgtctcaaaaacaaaacgaacaaaaatcaaaagctctactccataaatcagttgcatggaaaaacatttggaggctccttgatcaaagatttgatgtgtgtgaaagtgttctgaagacagtggagtgctgtgcaattgcacaccactgtgttctggtgacagtaacacccaatgttgagaaataactctctcacctcttaaaattcgagttaaaaagtgtataattgaacagttcttagaatattcagagctgtggaactatcaccactatctaattttagaacattttgtcaacccctgaaaaaaatcccaaattcattaaccaatcagtcaccatttcctcctctccctaacccaaagcaactgctgatctgctttttttcctctatggattagcctgtttcagacatttcatgcaagtggaatgatacaagatcggtcttttggcttttttcacttagcatcatgttttcaaggctcatccatcttgtagcatgaattggtacctttcccattgtttgaatgataccgccattgtatggatgtgccatgttttgtttgtccattcatctgttaacatatatttgggttgttgacgctttttacatgtcagtctgttcttacaaagcattccacctctgggtccctcaatgtctagtgcctagagcgttttctcttttttttttttttgagatggagttttgcttttgttgcccaggctagagtgcaatggtgtgatctcagctcaccgcaacttctgcctcctgggttcaagcaattctactgcctcagcctcccaagtagctgggattacaggtgtgaaccaccatggctggctaattttgtagttttagtagagaagggaattctccatgttggtcaggtgggcctcgaactcccagcctcaggtgatctgcctgcctcggcctcccaaagtgctgggattacaggtgtgagccaccacgcccggcctagagtgttttctttaatcttttccagttatttctacttttttctgtccgagcttatcctttgggctttcccccaataggactgttgagtcagttactgacttagcacagtgaatatgcgtcctaatacattctttattttttattttattttatttttgagacggagtctcgctctgttgccaggctggagtgcagtggcgcgatctcggctcaccacaacctctgactccctggttcaagcgattctcctgcctcagcctctcgagtagctgggattataggcaaacaccatcatgcccagctaatttttgtagttttagtagagacggggtttcaccacgttggccaggctggtctcgatctcctgaccttgtgatctgcccaccttggcctcccaaagtgctgggattataggcgtgagccaccgcacccagccttacttatattcttttatgtgtctacgtgtattcatttagatgttgagctcagttttttaaaagacaattcacccaacaagtatatattgaatacctactatgtgcctggcactagttggcagttggaataaatcagtgaaccaagctaagatccctgcctccatggggacttaaacattttggcaaagcttacattctgggtgacttaaaatacacacacacacacacacacacacacacacacacacacacacacacacttaactgctactcttttatttattattttttttgagacggagtctcgctctgttgcccaggctggagtgcagtggtacaatctccgctccctgcaacctcagcctctcctgggttcaaacgattctcctgcctcagcctcccaagtagctgggactacaggcacgtgccaacatgcccggctaattttttgtatttttagtagagatggggtttcaccatgttagccaggatggtcttgatctcctgaccttgtcatctgcccccctcggcctcccaaagtgccgggactacagacaagagccaccgtgcctggccaactactactcttttatatttctgggtgactttaaaatatatatataggtgtgtgtgtatgtgtgtgtgtgtgtatagatatgtatatataaatataaataaaattaactgctactcttttatatttccagcacctgaccatgaaatgtcatatggtatagatggtcaataaacattatttgataactgacattgaaattttcttttttcctttttttttttttttgtttgttttgtttttttttagagacaagatctcactgtgtcagccatgctgaaatgcagtggtgcaatcatagctcactgcagcctctaagtcccaagctcaagacatcttcctaccccagcctcctggaaagccaggactgcacgtgcacacagccatgccaggctaatttaaagaaaatttattttaagggatggggtgttgctactttgcccaggttggtctttaactcgtgggctctagtgatcatctgccttggcctttcaagacgctgggattacaggtgtgagccactgtgcctggccgtgaaattttcttaataatttttaatgaagccacttaatcctctccagactgtaaagatctctgtcttatttcgtactggcactgtaatcacagttgctgagtttattcatgaaggtgaaagtgtccctttggcgaatagaaacaaacttgggaaaagcacttctcacttcctcctgtatgtgtctttactccagaccctggcctgtgttttgctcctcctggaggccattaagtaggagtcttattctaaggattggaatcttctggagattctgtgggagacagaggacggagggtggtgtgtgttccttacttactgtcaaaattgagaaatttccctcttggccgggcatggtggctcacgcctgtaatcccagcacattgggaggtggaggtgggtaggtcacttgagctcaggagttcgagaccagcatgggcaacatctcgaaaacccatctctacaaaaaatttaaaaattagctgggcatcgtggcatgtgcctatagtctcagctacttgggaggctgaggtgagaggattacttgagcctgggaggcagaggctgcagtgagccgtgattgcaccactgcactccagcctgggtgacagcaagaccctgtctcagaaaaaaaaaaaaaaaaaaaagaaaaaggaaatgtttaggccgggcacagtggcttatgcctgtaatcccagcactttgggacgccaaggcgggtggatcacgaggtcaggagttccgagactagccttgcccacatggtgaaaccctgtctctactttaaaaaaatgcagaattagctgggcgttgtggtctgtgcctgtaatcccagctactcaggaggctgaggcaggagaattgcttgaacgcaggaggcggaggttgcagtgaaccgagatcgcgccattgcactccagcctgggcaatagagtgagacttcgtctcaaaaaaaaaaaaaaaacaaaaacaaaaacagaagaaggaaatgtttctcctcctttctgtcccatagtaggcaagtgtttgttcagttactgacaaagtcgaggcttgtctggtggtgaacatggtgcctactaggaagggctgccagctccttacacaccttgctataattagttgtaattaggcatctttcttccccagtgtcttttggaactgatagtagcagggctttcacagaacactgtgagaattaatgagttaatatttgcagaggcctctggaaatgttaagtgcttggtgttcttatcttctctctgagcttggttgccttataaggctgtccactgaggctgagggacctttgtggggaacagggccagccctgagcccagatgactgtggcagtccatgactgttcccggaatgggctcaggtttcttattttaataggaatgacactacttttttttttttttgtaattattagtgtcagtctcgcacgtactttccccccaactttactacatctatttttagcacctcatctccatggttcttgccctctcaaaaccaattatagtaaaatccatttaaacagagatactccagtccaagttaagttcttacattttcttttcctggaaagataggctacttatcccaagaattatttgaagttggttcattcttttttaagtgctgtattgaggaggagagaaaaatagtagataaaacattccaatagtacttcattttttttaaaccaatgaattaaaatccacacatattcaatagagaggtctataaaagtttgttaacttctcatgaaacagacatttccaacaatagtatgtaaacatggacatttacatattcaaaagctactttccaagatttttccctcctacccaggttgtcagtataatgacatcgatttaggctatcataggccttttgagctggaaggtcacccaagaaccgtatttgtttaacaccctcacttaaaaagatggggccactgaagtccaaggtggtgtctggaacacattccagttttttaagcaggctggacttttctaattgacattgtttttgtttgtttgtttgttttgaggcagagccttgctctgttgcccaggctggagtgcagtggcaccatcttggctcactgcagcctctgccactcaggttcaagtgattctcctgcctcagcctcctgagtagctgggagtacaggcatgcaccactatgcccagctaatttttgtattttttaatagagataggtttttgccaggctggtctcaaactcctggcctcaagcaatcctcccaccttggcctcccaaagttctgggattacatgcatgagccaccatgcctggccagcattgttcgaattgatccctatttctctctctggaaggagagtgggcatctctttctggatcccttgaggtcaagtaaaataacccctatacttttcaaattttgtaagtagagagaatgatagctactctcagcctgctccaagaagagtgctatcacaggtgaatcctgtaagataaataccaatatttggtgcggtggggagcatcaagaaagtggcacaaggttagaatgttagaacattatttcttttttcttttttaagagtctcactctgttgcccaggctggagttcagtggcatgatctcggctcagtgcaacctccgcctccccaggttcaagcaattctcctgcctcagcctcctgagtagctgggactacaggcatgtgccaccacgcctggctaattttgtatttttagtagagactgggtttcatcatgttggccaggctggtgtcgatctcttgacctcatgatctgcctgcctcagcctctcaaagtgttgggattacaggcgtgagccgcatccagctaattttgtatttttagtagagacagggttttgccatgttgtccaggctggtcttgaactcctgacctcaggtgatccgcccacctcagcctcccaaagtgctgggattacaggtgtgagccaccgtgcccagccagagtgttatttcttaaatctttgttgaccttagaaatatttatttttgtcgtgccccctcctcccccaccccctcctctccttttgatgtcatcagaacaacaggcagtgggtcattgattgctgtctatgctggctcagtggctgtcgccatttttattaatgatacacttcttttcgccagggcagatagcttgtaagtaaacataaatcctatttagaaacaatgaacaaatatttttggtgagccttggacctcctgtatctgtggatgtttataggcaatctcttgtttataggaaatggtgcagagttgaggaactttggcctcagtagtggtgggaagtgggacaaagtaggccaggtctgttgctggttagctcacttgattagaacagtatgctaatgaacccaaggtcactgggccatctgtgtatgggtcagccagctctgctctgctgggatcccagaccttggccaggaggctgggcaatatgtatcactggtcatgaggccggagcagatagaaagatcagtactaatccgtcaccagacccagaaaacaaattcaaaacacatgccctatggatagtacactatctgtggctctttaatttatgagggtatcataacagatttttgtaattttcttaaacagatttttttttctgattaataataaactgcatgttattgaggatcctgggaaaataaagtatgaggaaggaaacaaaattcactatttttcccagcactgacagaggttacattttggatttttccatccttgatgttcccttcccttggcctccatgacaccacacttggttgactttcctcttcctccctgaccccacccctacattctccttttcccctttcctcctgaatttggcttgtaaatgatagtgttccttggcactccgtcctgcctcttcatttctcgtggtcctgcattcccatggatggtgtcctttgtcccagacttctgtcctgaaatccagattcaaagatccaagtgtctacaccacttctagctggatgctaatgtgtccagtaaatgatccccttatccccaccatctaacctgcacccctgtgttcctcctctctaggagtcacagccttcacctaggtgcccagcccttcccctcccctccctgactaatccatcaccagattcaacaattctactttccaaatatctctcaaatctgttgacttacctttaccctgctgctgtcctatttcaggctaccagcaaagcttctgcacagccatttcagccttaagccactttccttgtttccagccttgtctgcttttcagtccttgctgtcttcaggagagccagctaacctttcacagaatggaaatatactctgccactctgcttaaaacctttaactgtgtccacttgccagatggtctcatctgcaactttctcctgcagaccctatgcttcagtcataccgagcttcattcacttctgataatgcatcatctctttcatctatccagtaagcatttttatggataatcaattatcagatatcaggttctgggagggtgcttcaggaaactcaagagtcttggatggggagaggccaagacagacctgggagtataggcttggctggaaagtctgtattgactggccttgggaaaacctggaataagactgcttggtgtgttagggcagtgtgtgtacacactctgccttgtgcgatgtttgacagcttttcctctggtctttgaaaaggatgactccttggaagagttattccaggagcatgttgcatagaagaaaagacatactgatgtcttcatctaagagaagtgcttctgaagttggtcaatttgtttttgtgttagccttatacttaaaattactgtgtatggggctaagttttaacgtaacacaatgaatcccctttgtaacattccaagtgatatgtgccattgcaatgtgggattttcagaattgggaaatccctgagagccaggatgtagagtgttgtttcccaataccctagtggtttatgagttgggagaattgtgtataccctagcgatgttccctgtttcttcttgggtttgttttgcatccctcttgccagataaactaaacaaaatgatgaagagtagaaaaggctgtccattagtggagttaatgtttgtgtaaatgttaatccataggacatacagtgttgctttccagtctaacagactctttggccccttatcctaccctcttggtgattttcattgttttgttgttgttgtcctttgttttgttttgttttgcttgagacagagtctccctctgtcgcccaggctggagtgcagtggtgtgatctctgcccactgcaacctctgcctcccgggttcaagccattattatgtctcagcctccctagtaacaggtgcccaccaccatgcctggctaatttttctttttgagatggagtctcgctctgttgcccaggctggagtgcagtggtacgaccttggcccactgcaagctccgtctcctgggttcatgccattctcctgcctcagcctcccgagtagctgggatgtgccaccaggcccagctaattttttgtatttttagtagaggtggggtttcaccgtgttagccaggatggtctcgatctcctgacctcgtgatccgcctgcctcggcctcccaaagtgctgggattacaggtgtgagccactgcaccctgcctttttttctgtttttgagacagagtctccctcagtcgcctaggctggactacagtggtgcaatctcgactcactgcaagctctgcctcttgggttcaagtaagtctcctgtctcagcctcccaaatagctgggattacaggcatgcaccactatgcccagctaatttgtgtatttttagtagagacggggttttgccatgttggctaggtgggttttgaactcctgacctcaagtgatcctgcccgccttggccttccaaagtactgggattacaggtgtgaaccactgctcctggccttgttttgttttttgttgggggagtttgttcttctaagagacagatggaccttttttttatttttatttttttaagctagtttaagaatacagtaaaatcttctgattgtgtttgtgaacactggtaggtttgttacaatgttaaaatattttacttctgtagaaagaaaaccaaatatatcacgatgactggatatttaagcttttaccagaacatttggaattgtccaatgccctctgttttttcttagagccttcatggtgctgattcacagtgaaccttcactacttagtcccagataactgattatcagtggttgaaatcaacgtggagatgtctcagaaaacctgttttatagaaacttctagaaagttgcaaaccaaaaaaacatgaatgtcatcatgtcatctcatttttctgtttttgaaaaattatgaagttttcagtaattgtgactttttaaacatgtaaaagtatggaagtacatccagtaaacaatgccatgtacattccccctcaatttcccaaccccatccccatttgctgtccagaagtgtgaccacagttaacggtttaatgtgcatctttttatgtacttaacatgtctgtaaatatgtcttttatcttttttgctccctcttttaaattttaacttgacgttaaagtttagaacttccatgttagtatgtgcagctgtaacacattctttttttagtagccacatagtgtttcaatgtatggatgttccaaaatatattacccatttcctgctgtaacattttaactttttagaattcaactatgtgtacttttgtaattaaaaatgtgaattttattttgcctatgtgttcttcatgaaacacgatatgtacgttggtatagttgatatgtgttaccatacgtaacacataggtatatgaagaataactacatatatacttgaacaacttatgtgctgtttaaaaatcttttttaaccatatgtcatttataatataacttgttaattctagaacttgtttaatattgagattcctagaaatgcaatttctggatgaaagtgatgtgcgtttaattttgagtagataaggccgaattgctctctacaattacatcaatttatagtcccatctagcttgtccatttctcaataccctttctaacatttgagattgtgtttctttttcttttttaagagaggggatcttgctatgttgctcaggctagcttcaaactcctgggctcaaggggtcctcccgcctcagtctccccagtagctgggacgcaggtgcacaccgcctggcctggcttagagattgtccttcttactctgtaatcattggctagaagagggcatttcattgttgtgttttgtatttttcttattaaagaagtgtatcattttcaagtgttcattagctatttttagtttttccacaatttggttatcttttgtctatttttctgttagattgcatttttgattttgtaggcactctttattactattattattattatttttcgaggcagggtctcactctgtcacccaggctggagtgcagtggcgtgatcttgtctcactgcaacctccgtctcctgggttcaagcgattttcttgcctcagcctcctgaatagctggggctacaggcatgtgccaccaggcctgtctaatttttgtatttctagtagagactgggttttaccatgttggccaagctggtctcaaactcctgacctcaagtgatccatccgcctcagcctcccaaaatgctcggcctcccaaatctgttttagtggtacaggtactcatgcacatgagtaccgctcctggccttggcactctttatacgttgtaaacattgattgtttttgtctttaatatattttagaaatattttccctagtctttttgcttgtccttttaaagataggcccctgttatcatttgctgtaaatgtcatcatctgcatagaaaatccaagattatcagttgaaaaaaaaaaaaaaacagaactaataaacttcagtaagatgtccagatgagaaaaacacaaaaatcacagggttttaattttatttttaaaaatatggctgggcgcaatggctcaggcctataatcctagcactttgggaagctgtggtgggtggattacctgaggttgggtgttcaagaccagcctggccaacatggcgaaaccccatctctattaaaaatacaaaaattatccgggcatggtggtgcacgtctgtagtttcagctgctcaggaggctgaggcaggagaatcgcttgaaactgggaggcagaggtagcagtgagccaagatcatgccattgcactccagcctgggcgacagagtgagattgcatctcaaaaatgtgtgtgtgtgtgtgtgtgtgtgtgtgtgtgtcagcataggaaagtagtacaggtagagagcatttctaatctcaaaatgccccacaatctgaagctttttgagcactgacgtaccacaagtggaaaattccacacttgacctcatgtgacaggtttcagtcaaaacttggttttcatgcacatgagtattaaaaatgttttataaaactaccttcaggctatgtttataaggtgtatatgaagcgaatgaattttgtgtttagacttggttcccatccccaacatatctcattatttttaaaatatggaaatattccaaaatctgaaacacatctggtcccagtcatttcacataagggattctcaccctgtactaatcaattagaacacataataaaaaacagataccattcttgacagcaatgaaaaacaaatttgcaagaacagcttgaagaatactgcattctgaaggacagaaaagacctgaataggtctggtgcagtggctcatgtgtgtaatcccagcactttgagaggacgacatgcatggattgcttgagcccaggagctcgagaccagcctgggcaacatggcaagaccttgtctcaacaaaagaaacccaaagaattaactggacatggtgatgtgtgcccgtagtcccagttactctggaggcttaggtgggaggatcacttgagcttgggaggttgaggctgcagtgggccgtgatcacaccactgcacttcattctgggtgatagagcaagaccctgcttcaaaaaaaaaaaaagaaagaaaataccaagtaaatggagatacagattgtatttctgtggatagatattgtaaagtctcttttctccaaattaaacattaaatgaaattctgataaaaattcccaagtactttaaacagaatttgacaagctaatctataagtcagctggacttataaacatacataaagccaagaaaatttggaaaagaactcggggggactttccacaccggatatcaaaacccattttgaaatattgtagttaaaagagacaaatcaccaaatgaaactgaagtccacagaggtaaagttactagtttaaggtcacagagctagatgggcatttttcatgcgggtcagttgaagtgtttctcagtggctggactgattgcatgtgattctaactttcagcaatgttgtagactttatcgggaggcttcttcatttcccaattagaaagatactatcttttgggaaaattacttatgcagggaatcaacctattagacatttgccgaacttgaataaaatgagaaaaggaaaatctgtcaagccttcgtgtttcatgttgtagtgttttccctgtaaatgcttcctctattgtagcagagtagttcagagttgaagggtcatcagggcagaagatgaagagagtccggggtctatctaggaacagtagttaggaatggtttagaaactttcagtcaattgacaggctagttagtattttagtgacattatcagttaaaagtttaaaatacttacctatttgaagtcatgaaaatggctaattttgatttattttcatcccatgctttaaatttatttgtgctgaattgtgaagatgatgagcttaaaagtacaggttagagatttagaatttgtatgtaattactcttgtgaaaatttgttttcttagggaggtgtgtgtgtgtgtgagagagagtgtgtgtgtgtgagtgtgcgcatgagctggtcagctgcagaaccttctggttagcaaacctgatagcatctagggtggagctaagggggaaacatgtttaatcacatactcaccagcttcctggcactaagaaattatcaccagacagcagccaccaggataatttaactttagttctggacaggcaaatgtgcagcaatcatttaaagtaaatttcttaaagaacatgtaggaattatgtcactactttgtggtgatgtttccataaatcctctatagtgtttttgttatgtttgtgtttcttattaaaaattccttaagtacaaacatcattttcaaatatcatatttagtattcctacatttgaaagccaaacatgacaaattattttttacaaattttctaggtacctactatgtgccaaggataatgtcatatcctcacatgttttatgggttaggtggaaagtattacacacaaggttaaaaaggctgttttactggccgggcatggtggctcatgcctgtaatcccagcactttgggaggctgaggcaggtggatcacaaggtcaagagatcgagaccatcctggccaacatggtgaaatcccgtctctactaaaaatacaaaaattagctgggtgtggtggcacgcacctatagtcctagctactcgggaggctgaggcaggggaattgcttgaacccgggaggcggaggttgcagtaagtcaagatcgcaacactgcactccagcctgggtgacatagcgagactctgtctcaaaaaagaaaaaagaaaaaaaaagctggttgctatgatagagataagaataaagtaataaccaggtaggtaattgagaaaaagttcttaaaagcagtagggggctgggatgggtaggataatctactgttgtttttctttttcttatttttttattttattttattttatttttattttattttattttgagatggagtcttgctctgtcacccaggctggagtgcagtggtgcgatcttggcttccacctcctgggttcaagtgattctcctgtctcagcctcctgagtaactgggattacaggcaccctccatcatgtctggctaattttgtatttttaatttagatagggtttcgccagttggccaggctggtcttgaactcctgacctcaggtgatccacccacctcagcctttcaaagtgctggggttacagacttgagctactgcgcctggccgaaattttcttaaataataataatactaaattttcttagtaatagaggtcttgctatgttacccaggctcgtctcgaactcctgggcttaagcagtcctcctgcctcagcctcccaaggtgctgagattataggcgttgagccacctcacctggcctgctgttattttatatagaaatctgcgcctcatttaggcatgagagtgttccgtagcacctcctttgtaggaacttaataatgtacaagagaaacccaaatgtacgtttctgaacaaatttaaatagatacctgagtgtggattttagaaaactttctatctgggctcattgttttcatctttttcttgtgtagataaccacacccaagaaaatcataggaaaaatacataacaaatgcacttttaaaacaaaatatcccaagtttataattcatggtattggatggatgtattttactgacacaagagttgcattttcaataaatatttctttttatctacttcatgtgctggggaaatgggtgaaacagggaattctatgatcgcagcaagtccctttcttctacaggttcattttgtagccatcatgttcattgcagctatcccaagtggggttgagaaccaggacctggctccaggtctccgagcagttgaaatgtacctggcaaagtccatgccttaggcaggagagctgctcagcctcacttccagcctgtttactctgggttctgaatcgccgtgggctttgttatctggtttcccagcctcgcctaccagttctctgtctaccagtgttgtaccagggctctttttattctttcttcgactggagatccagactctcaaacatctgtaatacttgtccctatctctttgttcatgtgttccggcaccttgtggatatttgtaggtcaccagttctgcttttgcttgaagacctgtctggcagggcttggcacctctttcctctttgtgtatgcagggcctggttgcctagctacctcggaggggacagtgagggctgggctgcaaaggggaaggcctggcaaatcctgagttaggcctgtgcttgttctctagtatgggcggggcttccaggggctcaggggccatctattgtaggagtaacggccacttcccatccatttcttctttcgtctctcttttagttatttatttctgcttgtgtctcaggaccaaacaatctgcagggtgaattggtggggaggaagttgagggttgggggtggggaggggaggacctcccggaaatagtaaatcttagtttagtttttcagagataagtagtcacatgggtcccttgccaagagagaagatctctctcaggaagaaaggcaggatggtgcgggggtttaaactaggtttgtattacaaaaatctggatgggttttttgttttttttgttgttgttgttttgtttttttggagactgagtctcactctgccacccaggctggagtgccatggcacgatcttggctcactgcaacctctgcctcccgggttcaagccattctcttgcctcagccttctaagtagctgggacctcagacgtgcaccaccatgcccggctcatttttgtattttttgtagagacagaggttcaccatgttggccaggctggtctctaactcctgacctcaaggaatctgcccacctccgtcttccaaagtgctgggaacaggcatgagccaccatgctgggccttggatgggctttgatgtcttcatagtgcatgagttttgggtcagccagtgttaggtttgacatcctggtctcctaacctggctctgacacttattagctgtgctatcttgggcaagttactttctttgaagctagttcttcttgaataaattgggaataacaaaatccacaacatagagttgcatatggatggtagcgataattatagatcatgcctcaatagaatgtaaataggtgctcaacaggtggaaagttgctatcattgttataattatttgaaaggggatatcactgagacatgaaatgagggcaggttatagagcagtcggtcaataagcccagcttttgtgacattggaaatttaattataagttagttactaagggtgcatggttatactggattcataactaggttcatactctgctccgtttggctggctaggtgatctttaacctctctagatcttaatcttttcatctgtttgtaagaagagaatgaggataataatgcctacttcgtggagttgtgaggattaaaggagatatgatatgtaaaatgttacacagtgtctggtacagaatttgatctagaaagaaggcccttattattagacatagtaacctttaaagcacggtaaaagcggtgctcagtgatcagtgacaatttcttttttgtgctctagtcctttgaagcatggctgttgtatttccaagttttttgacactcttggattttattttcttgggtacacgcgcgcacacacacacaaattagcattagcccattattaaatattaactttttattccatgtatttatttatttatttagagacagggtttcactctgtcatccacccaggctggagtgcagtggtacaatttcagctcactgcagcctcagcctcccagactcaagcagtcctcccacctcagcctcccaagtagctgggtctacaggcatgcatcaccacgcccaactaattttctgtagtttttgtagcgacaaagtctcactatgttgcccaggctggtctcaaactcctagactaaagtgatcctcccgccttggcctctcactcaaagtgctgagattataggcatttattccattattactacttttatggaaattcctatcttccttcaaaagctaaggctaggttccttaatatattgaaacgtatatatagcatgagtcctctctgcatccataatttaagtatgtattttatatgtgtatatttgatatgtagcgtaattttaatttcttttttttgaaatggagtttcgctcttgttgcccaggctggagtgcaatggcctgatcttgactcacaacaacctccgcctccctggttcaagcgattctcctgcctcagcctcctgagtagctgggattaaggcatgtgccaccacgccccgctaaattttgtatttttagtagagacggggtttctccatgttggccaggctggtctcgaactcccgacctcaggcaatctgcccacctcggcctcccagagtgctaggattatgggcatgagccaccgagcccggcccggtggctttttttcttaaagggttttggtaagagttagtgtacaatttgtcaggcacttcctacgtcccagatattgttctaaacatttttacagacattaacttcctaagttctcctaacaatcctaggaggaggtacagttctgagccccatttcatgggtaaaaaaacagcagagagggaaattaacttgcctgaggtcacacagctgtaatgtgatcaaggctggcctttgagaccaggcggctgctgactcttatcgatggtgttgttcttaaccaccactctatgctgcttcccaccgtgcccaaagagtgcctgcaggcttctctgtctctttcctgaaaagttacttacagtcccttgactgcactgctttaaagacgcagcacggagttcagcagtgaaatctggcagtgccggtgctgaaagatgtgaggattttgacagatgctggagatgctggctcaatgttcatgtcccaccaggggccaaattgcccatctgtaaataaggtttcttgtcttcagattccgtggtgattatttttttcctcagggaccagtcatccttttaatcttgtggtagaaaattaaaatgagtttcactgaagtgtggttggatttttaaagtttcttttaaatattactttagagaagttaattaagtacctgccctgtggatccagcttcctgcattttcctactgttttcactgtttagacgggaggcttttcttaggagaattagattacaaattgaagggtgaatgaataccttatcggcagatcatgaacatttggggtcctgaataggtagcaggcttgcgtaataggacctgaataaagttaggcaaacatgactatctctgatcttaaaggcattgaacaggctgaggttaaagtgtttgtcgtagtttctaaaagtcaagggagcgaggaagggagagtttactttctcactttgcttgcagtgattttcttttttttttttttttgcttactatgtcttggggtttctccaggtggtagaggttgctcggaggtctgactcccagctggcttgaaagcagtgattgttcatgttttgggggatcgttgatccctttgagagtctggtgaagcctgtgggcatcctccccagaaaacacacacagacatacacacaatgttttgttcatgggtctttaagggccacacacctaggctttagagtatatggcaattcaacatcagaacttgtttactgccccttccctttttcttttgttttttgagaaggggtctcgctttgtttcccaggctggtctcaaactcctggagctcaagcaatccccctgctttggcctcccaaagtgctgggattataggcatgagccaccacgccaggccgacctccccttctgtgtgccgtcctcagcctgggcctcgtggctctaaaattaagctaatcggtgaattcagctattgttcttaatgtcttgtttgtaccccagaattatttgcatttgaaagtcttcagaactccatacccactccagctctatcacatgtgatcacttcaggaggtaactataaaggggaccctgctttattggccattcttagccaaatgggcattgatgttgaaaggggtccaggtagctagcctgtcaaatcttcacagtgctgtcccctccctgtctctccctactgccacactgaattccctcacctcacactgagttcactcacctttacgtatttcagcacatcttgttctttacctggaatgcccttccattcttcctccactacaggaatgcctgctcgtctttcagtacccagatcaaatggaagcctcgctgaactcccctggcaaactctctctcttcctgtctttccatggcaatttttaaaggtctgtgttacagcatacatatcatgttgtaattattttttatgtgtttggcagactccaccgcctgtaaactaagtgcttgtcttaatcgtctttgatcatgcagcatgttgtcaggtgctagatatgtttgccatccagagtttatacaagtgggttgtggggttagaacacaggacgcagattctagctttgtgacttgccatctctttgtgcctctgtttcctcaggtgtaggcttgttggggtgggggagaatctgagtaaagtggaatagtacctagtgcatggtgaaatattcagcaactaggccaggtgccatggcttatgcatgtgatcccagcagtttgggagactgaggtgggaggatcacttgaagccagaagtttgagaccagccttggcaacaaaatgagaccccatcttttttttttttttttttttttgagatggagtcttactctgtcaccaggctggaatgcagtgatgcgatcttggctctctgcaacctccgcttcctggtttcaagcaattctcctgcctcagcctcccgagtagctgggactacaggtgcacaccaccacgcccagctaatttttgtatttttagtagagatggggtttaccatgttggccaggatggtcttaatctcttgacctcgtaatccgcctgcctcgtcctcccaaagtgctgggattacaggtgtgagccactgcacctggccatgggaccccatgtagtcccagctactcaggagacagaggtgggaggatcgcttgagccaaggagttggaggctgtggtaagttgtgatcatgccactgcactgcagcctgggcaatagatcaagacgctgtctcaaaaaaaaaaatcagcagtgttaaccattgtgatatttaatcataacattaagcatatcattgagtgaatgagaaactcttaaaaataacccagcataattggagagaacattatatagatgtacagaaattaagttaattctgcattctccaagtttaatctcagcatagataaaataaagaaatctaaatttacagggctcccagagaggttcggtaggacactctataatctactgttcatttccttatattataaagttaactggcatctgtgtgaggaccttaagccatttacaagtacgtactgtgggaatataaggctttttttttttaagggtaagaaaactcatgtacactattttaatggtatgatttaaatgtgttcaaaaaccttgtgtttttcaaatcccttttcaaagtagccccaataagctggggagtatgtgtgtagtggcgtcgccatttgtagctccactagtaacatgcaaagcacatgggaatccatgagaaacaatcatagaagcatctgcttctgcttctaagacacatcaaaggtggtgagaaaaaagatgtcattgaaggagctctttccttagtgtattttatttgtaggcaggatagaagtatcctgctaaagtcataaaatagaatagtattttagaattagaaggagcttgactagtccagccccttcttgctttacagatgaggaaactgaggtcccaaaatgtggagtgatgtcacattgtgctggggatgtggagaggggtgtttgtcatcacgtggatggccacgtggctggctggggggcctcagaggggaccttctattccctctttatacaggagcccctgtctgtcttaagcacatggcttgcttcttgaaagctttcctggactccccaggcagtatttcctttgtgcattttaaactaaattttgactaaattaaaagcaatgaaatccaggcctcctggaagggtatttagttttcctttttagcagaacagttaagctaatgacagtgttagaagcctcaaccaccccatccagtgattgatatacatgcccccaaatttttgtagtgaaatataaaaacagtctataatctgattttgtaatcaaggtctagccaattacagtacatctcaaaaagtccttagcaattgggttgttaagtcacccagcaaaatccctgtcattgacttccttggagccatttcctttcatgttttggcttcttggtgtctacatagtttctaagatagcagcccaataaattgtgctattatctccaggtttccacatcttacatatggtatacatttgctgttgtctccttttcaaaatgtagtccaatttgtgactgtttaatttttaaagtgaaagagggagaatgttttagaagaagttaaataatttaaaaattagatgcccaagccctagtaactttgatttgtggaaaaatacttttgattatagccatatagttacagaatctatacagaaacttggcaaatttgaaaatctgaaatctggcccggcgcaggggctcatgcctgtaatcacagccctttgggaagccgaggcgggcagattgcttgaacccaggagtttgagaccagcctgggcaatatggtgaaaccccatctctacaaaaatacagaaattagctaggcatgatggcgcccgcctgtagtcccagctactcgtgatcatgccactgcactccagcctgggttagagtgataccctgtcttaaatggatggatggatggatggatggatagataaataaattaaaaatctgaagtcttatatgtccccctgttgtcaatagagaagagaatcatactactttatacccatagtatctctggaggagtaacaagttgtacgtcttggttctattctgtaacatggaaccaaggtatttgcaagctgacagcgaagaagaggcttcattgtgcatattcctacactgtattttttggtacatttttcagagtttgtaaagaaaacatcttgtactgagtttttaataacttttcatccatttcccaatgtacagtacaagtatatcaaagaacaaaaatgcagtaatccagcattgtcaaaatcactgctatttaaatgctgtatgaagagagtagtgtttaagttcctagtagctatctcacttatttgttggctgtggtagagtaatcattgtggcaatcattttatacatgtttgagttacacatatagctttgagggacatctactaacaccatatttagtggtttctcctaaagactaaagttatagcctcatgttcatttacttagaaatggataaaagtactattaatttaaaaaatacctatgtcttatagttcatttattccaaaaagatatatcaaatgcctaccatgtagtaggcactatccaagttgctaaaatttaaagacgaataaaacaaggccttcttatttggtgaggttgatgaaaagtgaaagcagatgattaaaatgcagtagcataagtaattatttgtgagtgtatttttaatgtatgaagcggttttcagatgtattctttattagtctcaatcacttgcatttccttgaattgaatgggagaggaggaagatgtggggttgcagtgggttcactgggaagcatgcattattctacatatactggggagcacatggtataactggcagagtgtatccagggggagaaaaaatagcatgttggttcttgattttattgtgtggcatagggtgtcacatagtaaggggacaactcaaatttcataggaaagattgccttacttggaatgtagagtcaaggcctacacccaatcccctgcatttctttctttctcctttctttcttttctttttttttctttctctttctttctttctctctctttctttcttcttttctttttctcttttctttctttttctcttctctcttctcttctctcctctcttctgtcctgtcttctcttctctttcttgagacggactctctcattctgtcgcccagactggagtacagtggtgtgatcttggctcactgcaacctctgtctcctaggttcaagtaattctcctgaacctctagagtagctggggctacaggcgtgcaccaccatgcccagctaatttttgtatttttagtggagacaaggtttctccgtgttggctaggctggtctcgaactccagacctcaggtgatccggcctgcctcgtcctcccaaagtgttgggattacaggtgtgagccaccgcgcccagccctctctttcaataatagtacttatcagtatatttattcctgattatacaagtctgctatgtcaagtaagagtttaaaacattatttgggccaggcattgtggctcacacctataatcccagtactttgggaggccgaggtgggaggattgcttgagcccaagagttggagaccagtctgggcaacatagggagaccctgtctttacaaaaacattaaaaaaaaaatgttagccagacatgatggcatatatctgaggtcccagctacttgggaagctgaggtgggaggatcacttgagcccgagatcaaggctgcagtgagccatgatcacgccgctgcactccagcctggacaacagagtgagaccctgtctcaaaaaagaaccaaaaacaaattttattttgacatttcaaagactttttcttttgaaccaaccaatctcttacttattaacaaagtttgaagtgatccagtagttgtttaaataaactgactctcccggcagaaagtaactattttctatcccattgtctgatgagatgctctgagtctttggttagatggaagactgcagacaagttagccctgcatctcatttacataatattttttactcttaagcaagaaatcttcaccaggtcctcttgtgatctggtgctgacacagaaccatgaccatagaggtgcccatgacttctttctgtgtcccttgaggatgttggtgccaaaggctacttaaatcctccttggaaggaaacgatttcatcagtcaggaattattgttttaatttgtgtcatttacctgttttgccttcctatcgcaactacctccatgaaagtagttatattgaaaaaagatgcttatattaaaatcagataggctttattaataaagtgtagtgtgtaggcttctatgactaatacatagtttaaagtcagggtaatagctggtgtaatgaaaccaaataaagtttctggctcattcataactgtgcagtagtttcgatttattctttgttattgttgaccaccttgttcttgttagaacaaggcagggaataaataaataaataaaacgattccacattattttctgtttgcctaaattgcaacataaggaagcaacaaaagaaagatccttttcgcttaaacattctgttgatccaagaaaaatcacacagggtctggaagcaacttttatttggagaactagacttgagtacgttcaactgaaagccaatgcaagcttctgttcctctaaaatgatgtcttttgcctaagaatagacccctctttcagtctaaaaaccagataaactgtcctacagtgattcaaatagccagcggcctcactccccccaaacttgactaacaacacagcaatataattctaccgtttaaaacttggctgacccaaacgtgaactttcaaagaaaataagagtcattactaaaagagattccatttctttctggggcctaagttaagatgactttccagaactttgaaaaaacttactctttcaatggccacttaattgtgtaacaaagtaaacattcacaagggaggcaaaatataacattccctatgtttagatttttcaaatatctttaaggggtgcattttctttgttgggttgtcatatgtagtttggagtaatttaccaggttctacccaaaagttgtatcatgatcaaggatcgcttgaacccaggagtttgagaccagcttgggcaccatggcaaaaccctgtctctactaacattacaaaaaattaaccaggtgtggtggtgaatgcctgtggtcttagctactctgaaggctgaggtgcaaggatctcttgagccagtgaggcagaggttgcagtgagctgtattcatggccatagcacttcagcctgggtggcagagtgagatcttgtcttaaagacaaaaaaagaaaaagagggtgaattctacctacctggcaggatcattgggataattgcatgaacataggatctgattcaccacctggtacatagtaggaattcatgatattgtagctgttcttataattattaatttgacctggaacttccatgtcctgattcttagatcttgcatgattatacacgtgttatctaattgatgaatttcaaatatgatctatttcaacagttaaatggctgaacagtcattaatttcaggtggtcctaaacccaaatcagtaaattctttgaggtggataaacctacatttcatttgtagtttaaaaagaaaaagtgaaaaaagtatttaaagtcctgggtcatggaaggcggagcttgcagtgagccaagtttacaccactgcactccagcctgggtaacagagcgagactctgtctcaaaaaaaataaaaaataaaaaataaaataaaaataaagtcctgggtcgataagtgactttatccttctaaggtataaaatgaaggagctacactagatagtctctaagcaaccttcaaactctgaaattctgtggttgatattaggtccagtactggggatctgtgattttttaattgctacaacttctaggaaatgaggagtatcaaagattgttatgggagagtgggggtaggggagttactatcattggtcttttgtgaacaagaccaagaacaaaagaaataagaacaaaaaagaacagcaagccgggcacagtggctcacacctttaatcccagcactttgggaggctgaggcaggtggatcacttgaggtcagaagttcgagaccagcctggccaaagtggagaaaactcgtctccactcaaaatacaaaaattagctgggcatggtggcaggtgcctgtaaacccagctacccaggaggctgaggcaggacagtcacttgaaccgggatggcggccactgctgggagcggagatggcaccactgcactccagcctgggagacagagcgagactctgcctcgaaaaaaaaaaaaaaaggcaacaaaaagaagtcagtccagatttgcagaaataacaggagttattcccatataacacacacacacacacacacacacatttagttctcaagaatagttttctctggcagcaaggattttagggaattccgtttaatctgcatctaagggttctcatgggacagggaaaggaagacatcattgtcctcaggaatttataatctgtgatcagcagaaagacataaaatggaagtgttctaagacatatttctgaaggatgaacttccaaagaagacatccatccatccatccatccatccatccatccatccatccatccgatccaaatgcttacaggttaagcatcccttatctgaaaatctgaaatgctccaaaacctgaaactttgagcactgacatgacgcctcacatctcaccctatgtgtcagtcaaacacagtcaaaactttgcagtcaaaacttgtttcatgaacacaattacttaaaatattatataaaattacctttgggctacacatatgaggtatatgtgtaacgtatgtgaatttcatgtttagagttggatcccatctgcaaggtatctcattatgtatatgcaaatcttccaaaatctgaaattgaaaacacttctggtcccaggcatttagataagggatgctcaacctacactacttgtggaggtgctaagctataacaaatactctctggaggcctcttgggatatgttgcctgttgatttggttaattctgtttcataaatcacagattgttgtaatctcatggtaccagtattttatgatacatgacatagattcaaagccttttgctacaatttaagattccattcatatcagtaatccttgtgggtcagagggtactgtgttggtgatatacacagacaactaacttgtggaagcatagagaagagagacagcagccaatggggatgtatgcacaagcctatgtgggggtggatgggtcaatggagtgatgagttagggaagactctacatcaagaatactcttgaagagtcttcaaagataaatcagtgactggaaggaaaagaaacaacctttggttagataattattattttttaagagatagattcttggctttgtcatccagcctagagtgcagtggtgtgatcatagctcactgcagcctccaaactcctggcctcaggtgatcctcctgatttggtctcccaaagtgctgggattacagttgtgagccactgtgcctggcctggttagattatttaaattaggactatattgatctgaaatataaagaattgggggaatgtgggtaagtacagggagacaacaacaatttttctgactcttcttagtccttatgtggaattcagttatttccaataattagctccttttccttttgaagaaaacaattgtcttttctcagagtaatgacatcagcctcctcctttaatcaggtctttttttcactttccccctttttttcactttccccaacctctaagcatttcctggtactaggagacttttattgctcaagctggcccattttactatggacagttccaatggttgcacactcctgggacattcctgtgacttcatgcttggtatgatttctaccttgttgaatgactaccataattaacctacttctctaaaaatatttgaaagctgctgtctaatttctcttgagccttgcttttttctcctttaggctaaccatctctacctccctcaactactttcataggtcatagtttccagttcctttactagcctgattgcttttctccaaatctccaactttaccctgtcagtcgtcagttggaatcttgtgctctgagcatagctgttctatgcaagaacaggggaggactatcactttcctgtatctaacactaataccacttaggactgcaatagttttctcagcacacgtcactttgtttccctgcttctccaagtctagggtatgcagtgtgcctgagcttgctggtgcccttgcattcttccatgcagttgtggtttgcttgtgtttttgttttaaaaagaattcgttgtgtcaaatttataaaggagttggattttgttctaaaagaggttcttgcttaagggcacgtaataaatatttcctgactgtaactgaataaatattgaacctttacgtgtttacactcccttgtcgtgatatatgtagctttttttttttttttgagagggagtcttgctctgtcgcccaggctggagtgcagtggcgcaatctcggctcactgcaagctctgcctcctgggttcacgccattcttctgcctcagcctcccgagtagctgggactataggcgcccgccaccatgcccgctaattttttgtatttttagtagagatggggtttcaccgtgttagccaggatggtcttgatctcctgacctcatgatccgcctgcctcggcctcccaaagtgctgggattacaggcgtgagccaccgcgcccagccgatatatgtagcattttgacctagatttgttgggattataagtcaaaatgttaaaattgatcttatcagagcctgccacttggaaaaataactttacttcagaaaaattttgtattgaactctttgaaggcttttttaaaaacgatgttattggctgggcgtggtggctcatgcctgtaatcccagcactttgggaggctgaggcaacaggatcatttgaggttaggagttccagaccagcctggccagtatggtaaaactccatctctactaaaaatgcaaaaattaggctgggcttggtggctcatgcctgtaatcccagcacttcgggaggccgaggcaggtggatcacctgaggtcaggagtttaaaaccagcctggccaacatggcaaaaccctgtcgctactaaaaataaaaaaattagccgggcatgatattgcttgcctgtaatcccagctactttggaggctgaagcaggagaatcacttgaactcgggagatggaggttgcagtgagcccagatcacgccactgcactccagcctgggtgacagagcgagactccatctcaaaaaaaaaaaaaaaaaggtagccgagcgtggtgggcacatgcctgtaatcccagctactcaggagactgagacaggagaatcacttgaacctgggaggtggaggttgcaatggaccaagattgtgctactgcactccagcctgggtgacagagtgagactccgtctcaaaaaaagaaaaaaaaaaagttgttatttttacttaggaaatgatttatctattttgcaagttcatcttagagcacaattatagctatttattacttattattcattcctatcttcccctttcctctgataaataacctggtagtttttggtaaaataagctaatcagcagggttctctaaataatacagtctcatgcctgtaatcccaacactttgggaggccaggacatgaggatcacctatgtagccaggagtttgagaccagcccgagcaacagagtgagccaattgcttgtgttggccttttactttccatgttttaggttagtcattacttttatcaggtacagagtataaccaagtggatttttcccttctgtcctccctgtacaatgaaggagactgaccgtaagtggaaccaggaagtgttgacgtggtcattactgcaaggaaggaggaaaaatagcagccaaaaatgccatttacgtgaaacttgtgacttgattgaggaaacatttgctcaagcaaaagcttaactgactacctctaaactgaggaatgtaagaattaccatatttacttctgcactagaattaaattctttgtgtgatcactgtctttagctcttattctaacacactggggcataatgagagaggcatttgaatgcagatattatattattctaccttaataaatgtttttctttgtctttgcaataatgatattattagataggcttgatgtcccatgatttttgtcatcaagttcgcatcgtatctatatagagagataggaagatgcgatcttactttttttttatttattttttttgaaatagccttgctctgccagccccggctggagtgcagtggtgcaatctcagctcactgtagcctccacctcccaggttcaagttactctcatgcctcagcctccttagtagctgggcctacaggcgcatgccaccacacccggctaatttttgtatttttagaaatagagatggggtttcaccatgctgtccaggctagtctcaaactcctgacctcatgtgatccacctgctttggcctcccaaagtactgaaattacaagaagatgtgacttattttaaatgtttgtttgctgagggggaatatctgagtttacctttaagcgtcaaaaatactctgatactgcagtactagttgttattttgttcttatttgagactaaattaacagctgtagtcagttactatgctcaggaaataatgtttggagataaactttgtgtgtgctctccgtacatttcatagtatcatttaaaagcaaacctctttaatcaaagtcaaaaggaaaggatgtgttttctttcttccatgtttcttggcagatcttacaggtgagtgggaagtcatgaatgggcaatttccaagaagtacaaaagtaattttgttcataaagcaaaatattttcctttgattcatgatttacaaggaaacccatagcttagcacctacgagaaactttgaataggctgactttgcagtgagggtctcaaagaaggaatgcggtgagcaaatcttttgacattgtgatgatacattcttctaaaggttaggaggaaaaacttctttcttagagtttggctcccccacaccccctcttgcttccctcttgctaattgcccgttttttgacttttttttttccttttgttttgtttttgttttgagaaagggtctccctctgtcacccaggctggaatgcagtggcaccatcactgctcgctgcagccttgacctggctcaggcagtcctcctacctcagcttcctgagtaggtatgaatatagacatgtaccactttgctcagctaatttttgtattttttgtagagacggggtttcaccatgttgcccaggctgtgcttattttttataattaaaaaaaaattaaagccaggtgcagtggcttacgcctgtaatcccagcactttgggaggctgaggcgggattacttgaggccaggagttcaagaccagcctgagcaacatagtgagacctcgtctctacaatcaatcagtcagtcagtcaatcaatcagtcattcgatcaatcaactgcagtaaagtacacaaaacaaaagtttaccatcctaaccatttgtttattttattttttggagacggggtctcattctattactaaggcgggtgtcaaacttgtggcctcaagcaatcctccttcccaatgtgctaggattacgggtgtgagccactgtgctgagccctagccttttttaagtgtacagttcagtagtgttgagtatattcacattgttgctccacaacttttacatcttgcaaaacagaaactctatacccattaaacaacagctcgctgtccccacatccaccccacctctaaccccttggcaaccagcattcttactccctttttctatggatttgactagttagatacatcatgtaagtagaatcattcagtatttgtctgttactggctttaagtcagcctaatgtactcaaaattcatccatgtcgtagcgtgtgccagaatttccttcctttttaaggcttccatcgtatttttccatccttctgtcaaatggatgtttgggttgcttccaccacctggctattgtgaataatgctgcaatgagcacaggtgtgcaaacgtctttttgagatactgcttttgttctcactgggtctactactactgggtaattgtttttgattttttgaggttctccatagcagcttgcattcccaacaacagtgcataaaggttccaatttttcccacatctttgagaacacttatttttttaactttttttttttttttaagagataggttttcactatctcacccagggtggggtgcagtgccatgatcatagctcactgcagcctcaaactcttgggctcaagggatcctcctgcttcagcctcccaaagtagctgactggctaggaccacatcaccaccacagtcccccgccccgcccccctccagctagtttgtttttttgtttggcttttaatttttttgtagagacagtgtcttgctatgatgcccaggctggtcaagcaatcttcccgcctcagcctttcacagtgctggaactacaggagtgagctaccctgcctggactattttgagttttgatagtagccgtaactgtccatttttaatattaaccgtaatgatgaaataactttgagcacctggggttggacaaatgtgagatttgtgtgcgatctgcaaaggtagagttaaaatttttttctttcacttgctcctaaacactgttttggggtttttaaacttacagcgggtctggtgcagtgtatcattgtttcttcttgattttcagcacagtctgtgtgggactgtgtaggtagaaaaagcagtggaacatcatggtagctaaaattgcagatctcaaacttggcagaactattagaaaaaagtaaagttcagtagaacagattgtgaggaaagcattattcatgtcacaagagtttacaaataacaggtgtacaatgcactgggatgtttcttgcccattaatggaaatgctctggagactgtacagtcaagaagatggataaggtggtagatctcttccgctctctcccgtgattgattttttttttccctcatactgcctaacttcctctgttacagacgctgggtagtatcaacatatgtttccttatcgttcgatctgaaaaataaaccctccaaaaaattaaaaaggggtaaaggaatgttctgatttatctgccatcaatattttttattcgtggattctcttaataccatatcagaaataactttatttttctttttttgagacggagtctcgctggagttcagtggcacagtctcggctcactgcaatctccgcctcctggattcaagcgattctcctgcctcagcctcccgagtagctgggattacaggcgtgtgccaccaggtccagctaatttttttatttttagtagagacggggtttcaccatgttagccaggatggtctcgatctcctgacctcgtgatccgcccgcctcagcctccccaagtgctgggattacaggtatgagccaccgcgcccggcctattttttattttgttgtttctttttgtatagtcttgctatgttgtccaggctggtctcgaactcctgggctcaagcgtgggaaatgtctgacctaagagcgcgtggctactgagtaacaattctaaacagtatttcctgggcctttactgtgctagatgttccctctggtgatacaggcaaacttaagccaaaatatgaaataaaacatttaggcttctttacactccattttctccttccctgcctcaccaagtctcagtcgcttttcaccttggcccttcgttttgttgcactctaggatcctggagccttgcaggtttttctcagctcattcccactcctttcaccctcaccgtggcaactccagaatgtgggtttctggcgctttatcttctgtttctgtaaaccttcgcagccagtcgctgccttttccattttaattgcattctcccacccccgcagtcttcctggaatgcttcctgttttgttcacggtggggccagtcctccagggatccgcatctcttcgtttgccttcgtctggctgagccgggctggtgcgctgagctctaggtgcaggcggaagctgggtcaggtgcgcggccgcacttctggttgcgcggcccacactggccgccattgtggtggaagtcggagcgagtctcctgggcccgaaccggctgttggaagtgcgagggcaccgagagccacggtacctgtgagggatctctttaacttcctcagatgggatgggggaaagatcagagggtgacacttcgggtgaccgatgcctgaactggggcttccgggggaaggctatagaaagacttggcgataagctctccgaccgtgactcctaccattacttttatttacttatcatagctttttaaaaaactttgaaattaataataattcccctgaaatatccacctgtggcagtggagcaatgaaagcacgtgcttaagtattctcgtccacacagttggcagtggctcctccgtacggaaagcagttgtgatagagtcacctcaagccctgcagcttctccacaacccgaatctggaatatgttgcgtggatattgcctttttgtaaaatattggaatccgttggcccaaagtcaatatactcctaaactgtaatacttaatattttttctctgaagactattttaaatagttttttaaaatggtgtcctgcactaatgtttttggtaattatggctaaaaaaaaattaaaaacctttaatatgcatgatgtaaaaacaaaaggttgcgtagtatagtggttaagagcccaggctttgaactgcttgagttcaaatcaagctctaacaccagctgttttgattttggacaggttccttaacccttagtttccttagctgcaaaatagctcctatcttgtagggttgtggtagggggaattgggtagatacaggtttacagttgcttatctgaaatccttggggtcggatgtgcttaaaaatctttcaggttttttttgttttgtttttgtttttaagacaaagtctcgctctgttgcccaggctggagtgcagtggtgcaatctcggctcactgcaacctctgcctcccaggttcaagtgattttcctgcctcagcctcctgagtagctgggactacaggcgtgcaccaccaccacgtccagcgaatttttgtattttagtagagacaggatttcaccgcgttggccgggatggtctccatctcttgaccttgtgatctgcccgcctcggcctcccaaaatgctgggattacaggtgtgagccaccgcgcccagcctcagattttgtattgatttattaattcactgagacagagtctgtctctattgcccaggctggaatgcagttagctcactgcaatctccacctcccaggttcaagcgattctcttgcctcggcctcctgagtagctgggactacaggggggcaccaccatgcccggctaatttttgtgtttttagtagagccgggtttcaccatattggccaagctggtattgaactcctggcctcaagtgatcctccggccttggcctcccaaattgctgggattacaggtgtgagccaccacaccctgcctctttcagattgtaaaagataacatagtacataacccataggtaacataatacagcaatgtctaaggtagcacatagtaactaagcacattaatttttctgcagtgaaacatgaataatacactaagcgggataaattaaagctataaatagttttacatcacttcagatcaggttttgccacccagtgagtttgcaccgcccttctcccagactcagcactataggctttcagagcatttagattttggagttgtggattagaggttgtggagtcatatgtaaaccatttgaacagggcctggcatttagtaagcaccctataaatgttagtgcaaaactgaattcttcctatactttatgactagattgttattatttaaaagagtagtttaaatcatagtggtttaaagtggatgtagtgaaggcctacataagtatctgtgtgtatttttcgcatattatctcatttgggtttcaggtctgtttttcccatggtaaaagaacaagaaagacagaacaaagaaggcagagcagaaaagttccatgttcctcctcactccatcttgcctagccaaaacaattgaacagtttcagatatctatttcaaagatttcagataagttctaaaatgttttcttttgttgtgacttcagccttgacttgcctctactcttaagcacacggtaagaaccgaaagccaccctgtgcatcttaaatcttttaatctgctttgctgccaatggattatttctagaacatgatggtgtagaaaattcttaaattttaggcaacttaaatgcttctaagatttttttttttcttaccaaagagaggtggcttctgagttgaggactgtggggttgatgtttcatgtgagttcatggctatattacatttggcctgaaagtctagtgatctggtatattttatcctgtgatccattaatatctattgaaaatacactgtagctcttacagtgaaaaataattagacctatttcatcctctctttctacttaatacacatatttacccagtctaagcctgatcaaaaggacaatgtgggaatgcatgaaagaataatgtgtgcttttcaaaagataagccagatactggaagcagaaactctgaaggacaaagttaaaatctaaaggtaaatcttgctatccttgtgtctgtaagatacatagattgacaaaagtaactataatacagagctatttagataattcaaaagaattacatctttagattattttattggcttatatctgaagaactataagttccatttttatgcataaattagtagcctattagtttcttttaaaaattctctgtagatggaaagcttacattggagttttcatcttttctttctccttgccatttcttcatcagttatctttagtctattacatgtatacacacacatatgtagatatacacacggatatatatatatatatatatatatatgtattttcctgaaacaaggtgttgcactgtcgcctaggctagggtgcagtggtgcagtcacagctcactgcagcctcgaccaactgggctccagcgagcctatatcaccttagcctcctgagtagcgtgtagtacagaccaccactcccagctgatttttgtattttttgtagagatggggtttcaccatgttgccccaggctgttctggaactcctggactcaagtgatccacccgcctcagcctcccaaagtgctgggattataggcatgagcctctgtgcccagcctgtaaatacatttatgtgaagactttgctaaagaaagagacaatgaaatcagtgaagacaccaatatggtacatgaaaaacaacttggagcattaaatcaaaattgccaaagatcacctttttcaagtgtaaggcttgtttctttgtatacacttatctcttttgcaacttcatgttatcctgatgtctgggatattaactttaaagatgattttatcgttttattatggtagttattccttcgttcactttcccctttattgtggttaatctgcgaagtagatttggtcatgtaatacactttatttttagcagtctcacagtgtcgtaaatcttgtattttattgcctttaatgtaagaatgaaggccagcaatcagggtgaggctgttctgtttcaaacttgacactcaaaaactaacttctgtgttttctattttaaggcttactacaggtagactacttcagccatcaattaaaataagcttttcttaaaaatgagatgataattagtgacagcattagaatccctaatagtgcgtgtatgtgtgtgcatgcacgtggatgcagtatgatagtggctgcagcgacagaaaaccaaagtaatgtggcttaaccataataggcatttatttctctctcatgtaaaagcccgaaaagtggtctatatttatcagacttttttgagacagggttttgctccattgcctaggctggagtgcagtggtgtgatcctagctttctgtagtctcaacctcctgggctcaagcgatctacccacctcagtctcccaagtagctgggactacaggcacatgccaccacacatggcttgtgtgtgtgtgtgtgtgtgtgtgtgtgtgtgtgtgtgtgtgtgtgtgcgcgcgcgcgcgcgcggtggagggtagtggggtagagatggaacttcagtattttgcccaaggtgactttatattttgattctctgccatcttcaacaggtagctgtcatcttatgatctaaggtgggtgctctacttcccacagtcatcttctaggcaacaagaaagcaggaaaaaagctcttattttatttttgattttgttgcataccaaaggaatgttctcttttcaaggcaccacctggaagttgcaggcatcacttctgtccacaccataggccagaatttactaatatggtttgagtatccaaaataatgctccagaatctgaagctttttgtctactgacatgatgcccaaagggaatgctcaatggaaagtgtaattgcaaatatcccccaatatggaaaaattcgaaaactgaacacttctgggcccaagcatttcagttaaagggtactcaacctgtacagtattaactagcaagggaatttaggaaatcatgtgcccaacagaaatttattactacataaaatagagaatatattagaggaagttagcggttagaatagtaaagtgtgtaatagtgcaatgttttgtgaattttggatactcatcattataaacatctgacaaaaagactgaactgcattatagagctgctgggttctataaatcaccagtcttgagcatccctgcaaagtatttccttccagcctgtcacccatgtagaaaaagatctcctaattcttaatttaggaaagactttgtaaggagacattattatattaagaagtgaaacatacgataaaaagaaaaatgaattccataacaaaggggagaaagtaaacgtctattcaactttcattgaaataaatattttcagaactttattgtgtctatacaaaattgtatctgcatctttttttttaacttagcaatgaatcttagactttatatcagtaatggagatctaactcattttaaaaatgatacgtagtaatttggggaattttaaaacagtgttaatacataactgtcacatatctcttttgtgattacatttttttgctagatgatggattatagatagctctctgatacaaacaggagatttctaaaagcctcttagtcctcttacctcagcaatctatagtccatcctttcagtgttcctaaatttcctctgtgagaatatatatgctgttaaaagttaaggggactctgacacggaaagcaaataaacaaaaattattagatggtttacaattgtagtgcccactgtttaattcagaatggaacacagaaaaataaattaggcttgttctaaatgtttgcctaattcttttagaatattagaatttaacttattagctgtatgttgggtaagcattgcaagagttaacttgtatttgacatttttcacatgcccttaacattaagcatgtgtgaggtcttcctgtgtgcatatttggatgtacagcctaactgaggtggaaaacaccaagatgtttgcagggcagatgcattccaagtatgtgttcttattgctcttcctgccattggcttcaagatgagctgtcctgcctgttttcagtactagtcttaaaaccaggtccttttccattccctcccatcttgactaggttgcctctcaaattcaagtcaaggcatgttttctgtcaagtatacactttcaagatgaaagcagcagtgcacgaagcagagaaaaaagcctgcagaaatgtgtaaaaactagaaaaagtatacagagagcagtgggtagaaatgggtataatggttgacagctcttggacccaggactcatgtcttgttcaagattcaaatcctggctctatcactttctagttatgttgaaccaagttattttgaacttcagtttccttatctataaagtggcgacagaaatagaatgtagtatctgttggattcaggattaaatagttcatgtaataaaatgcttggcagtatgtttggcaactattatacaactctatatactcttcatttcttttctatgtccagattattaaaatattacgagaccatacccatgggggggaactttgctgtctttcgtttaactgctgtcctggctagctttcttactcagcccctgggattgaagtcaggcctagaaatttgggagtttggcatgttaaactttatagctgggagtactggagaatgacaggtaacttctgcaagggtaaacagtgttgagaaccttgctaattgcacattgtcaggcttttgaacagttcccattgtggcacgtattccttcaatgctttgttgtgcctgaaaatgaaagaaaagaaacaaaaaggaaaactataatgtttttaaacttggattttgttgttgttgtttttgtttaagtagtaggaaactaacatgatcttttctgacttagtcttatgttcagatatcctgaagcaacttgaataatgtcctgtttcttgcccccacccagctcgattggatccttttcctcacatctcctctttttttttttttttttttttgagacagagtgagactcttgccccggctggagtgcaatggcacgatttcagctcactgcaaccttcacctcctggttcaagcaattccccctgcctcagcctccggagtagctgggattataggcacccgccaccatgcccagctaatttttgtatttttcatagatacaggctttcgccatgttggccaggcttgtctcaaactcctgacctcaggtcacctgcccacctcagcctcccaaagtgctgggattacaggcatgaaccaccgtgcccggcccacacctcctttttaaatggagacagaagcaagcactgtcacctgtacctcacacaaggagaaacttggcctcagggtgattcactggaggtgcattgctgctcctatgaggcttgaggccaggttttctgcttctctgatagcctcttaggcattttgcctttcacagagtacttttccattattttataaagacctccttcagggccagattctacagttttatagttagaatttggtttcaacagaaaatcttcaaaaattacaatttacttttagttacacttcaagtcaactaggatgtcctgtttagaagcagggctccaagcctttttaaagaacagtttatctttcttttaaacaaatgaaggtattaaacggctcacagatggaaggcaggttgccgcattaaaataagttagtgcatggtttccttttcccaaataactttcctcttaaagtgagggtatgggagaatggattaaaattatagattgctacatatagacactttaaaatcaacgagcatagtaactagttggcattttaatattcttttaaaagtaagttgcttaaaaaccctggaggtagactatttaatcatttgcatgctagtttctaagaattcataattaagcaattcagcatgagatggatttatagatggactatcttagatttggtgttctctagcaggcagacttagtttcagtctggtggaaacactggatggtttcagcccagtatctgtttgcttttactccctaaacccacaactggactttgaggaggaggtgggaaggatgtcatgggaggtcacttcaggtagagtcagttcctgtgatactgactggcagctcccaggtcatgagcaaatggcaaccttggtagtatgcctccactgctgtccaggccttcagttccacttcttgtcttggaattcatgacacttgaaagagaagaagtcatctcataaagtgctgcatagtatttccagagagctgcatggctgtgaaaacataattggagttctaaaagctggcacagtcttttataacaacaggtaaatgcagtgaccagtttatttgtggcttttggtttcccactgcctgaaagcaaaaaaaaaaaaaaaaaaaaaaagtgtgtttttgaaaattaaaggaaggactttcatttaaaaataaagaagcttcagaataaaattacttctcctttgccttttatggtactgactgatgaaaggcagatatatatctggtaaaaatcctacaatgtatattaaaatgagtaaaaaatatcaaaaaatatggtgactagccagtatcttaatatttttgaaaaaatagactccttgaaaagccctggaggtagaaaatgtaattactttgcatgccaaaagaaatgtttccatcctggggtcttgtacaggctgagggttctggattataacaagtgtgtccttttttgtaactggctctgtagtagaagtaggtggactacaacacatttcactgccctgggcttctgaggtctttagattcacacctgccatttcaatgccctgagacttttctttctcctatctctccaagctaaaatcgttgaatcatatcctgtcattggctgttctgtttataataaacttcatgtgtaaaatgacatattatcaagaattgcttcagccattgacatagtgtctgtactcatggggctttgttgttcaggcaagactgagatgtctttcattatttagtgggtgttttgatacaggtcgtgtgaatgttgtctgtcaagcaaagcaacagtgctttgcccaggaactgagttgagattctgatagatatggattattatctccactgtcccctgcaccccaaacagttttctctttggaatagctcacgttatttcaggctctctagaagtgtgaatgaggctagtgtctttctcagggaaactgccattttactgatttttttcccagcaggcaacagtctgttggtgatggatatactgctaagaatagagaaaaatgagaaactagagatacttgcacaggcttcaggggcaaatttcattcatggagacatttagcccatttgttttttaaatatcaaattgtaacaaatctcccaaatctctcctatcttttagggactgggggacggcaggcaaatagaacagtgttattccaggcattgtcattagcccgaaaccatcatataatgattgtgtttcttttctatcatatttcagccacagtatcatttcaggtgtccctcagaaagacgtcacatccatagatggcaccttttagggaggaagcagcagtcaagggccattagtactagaacacaggccttttctgtcaagtgctttgtcctccatatcactctgccttcctttgcgagatgccttaacaaggctgcattcgtgtgtctgagagatcatcagtacaggttctaaggccaaacaggttgtaagaagaaggtgatgatcaagcatggcattttacatcatcagtccttagttaagaaaaatatgggcattcctgagggctgtcataagtggccagaaatcagggtctgtaaagtccaaggtacgggagaactggaagcaatgagtaactcatgtttgatgtacagagatgattgtacccagtgttaccatttacagagaaggcatccaaaccataataagcaaaatgctagactagatgtcactgggcagggctgggattggggggtgttggaggtagaatatcaccaggtggcagttagatactcattgctggcattttatccagacaccagaagaacatgatcattgtaagtatatttgttatctctcctacctccaccccctacaagaattcttaaaaatactgctagtgagtgcatagggaggatccgtatctcatttcttttgtgtggttcatgtaattctgtcatctttgacttctataatgatgcctaggtagggaagagtgccaaatggtccttagccctcaaattcctgccaattgctgagttgctgatagtattctctactgcaggggatataccaggacaattagctttagctcaaaaccatttatcagagaatgtgggagactgactcctggcacttgtttgtgtcatgtgagatatgctatttgtctaaaaactatccttttcacatttaatagttactgtttgctagtcagaacttccaaaatcttttccttggagatttccttctgaaaatgtcagtatctcctgactttcagagcaaattgagggttactgttcttaacaggtatctcattctgccttcaagtgtggttacttgatacagatgtcttctttccccttcctcgtggattcattgtggtctctgcagcagtatttctcagtgtgtgttctatgggctgcctatatccgcatcatttagagtccttgttaacgaggcaaattccaggggcccaaccttacttagagtatccaggattcttcactttaaatagccatcatactctccctgtggtccttaatgtatgttaaagtttgggtaacggttcatgtagaatcttgtaatatgatctgtgtacctgacagctagttcgaaatgcagaatctcagcccccacgttagatctactaaatcagaatctacatttcaataaaatgctacatgaaaatatggatgtgaattgctttacaactctttataagtaggaagcactcattaattaatcactgactgttggtttgtggatctgcttttcatatattctacttttctaaaaaaaagaaacaaaacagcttttagcttcttggaaattgtgggggtgtctcagaagaattgttctcttattacattattcacagtaaagaataatagtgaaagttcatgctatcactagtataagcacagatttagctatttcctcctaaataactgcagaagtaccttataaaatctaattgcaaatctgtttcttatacaaaagggtctaatttttctctgcctgtgtgagattcactcacggcctgattcaaaggcctctgctccaagatcaagaaaatcttcccaacgatcttcagtggcacttggcaataggagctttcaagggccacaatctcatctcagtgggagtaggtacaattgaatgttatttgtatgtttttttaaaactagaaaaccttcctgtggatttagtcatatttcccaaatgtgcttgatcaggaagttcatctgtattgcttattaaaaattcatactcctaagcctcatccccagatcgactgaatcagaatttctgggagggatctccagcagtctgttaacagacatcctggacattcttgagatcaggcatatttaagaaatactgaattatgtgatccttctcccagcagattacctttctgattatatttttttgaactcatatcatcccttttgttttcttgaacatactttaccccagcagcagtaaagaggcagctcaggattgctagtttagtattgaaaaccagaaagtgtgtatagctaaatactgcatgatattgtttgtccataatgtaagcatacttgattaacgagtattaacttagtgtgagtttattaacttattaacttattcatactattgtctgttccatggatagtgtcctgaagatggcaagtgttacatttagtctgcaaggaaacaagatctaaaacagtaaaatggcgaaccgtcatgaagtacattaggggtatatgtgtaggggctgatggggagaggttatatgtgtgatttgccatgtcttactctgcaactccttttcttaacattaaacttgtgagtgtgcttcaacctcagggacaaattgttgttatttagagaaatgaattatgcattcttttccttataattacatagtttatgtaccatcctctttgaacgtagcagaaggatttgtttcttataaagaaataaatgtgttggcctctaatttagtattggagtaatccttgtgtctcagacaaaaagatgaattatcaaatactttagggtactactgtgttacacattgttgaatctattatttgtgtgtataaatccatgattaaattaagtagtgttatctaatttgagttcttaaattcttgggtttctttttgtttgtttggtttgtttttttgagacagagtcttactctgttagcccaggctggagtgcagtggcatgatcttgtctcactgcaacctctgcctcccgattcacgcaattctcctgcctcagcctcccaagtagctgggattacaggcacccgccatcacacccggctaatttttgtatttttagaagagacggggtttcgccatgttggccaggctggtctcgaattcctgatctcaagtgatccgcctgccttggcctcccaaagtgttaggattacaggcatgagccaccatgcccggcctcaaattcttgtattttataaatcatttcatgggtttaaattcttgcttatgatggataagtgagaagggagtcttttcctcttaaaactaaattcctgaccatttctgtgaaataatttaaatactacccagttagggctttctctaagtgagtgtgtcattccaatgcaaaaggaaacttagatccctggtctgaggaaatttaaatctctgattcaaagttatagtgataagtgaatgagataccttgcctactctcaaggaatttataattaaattggagaggacttaactaaagcctgtgaaacaattaaaaaaaaagtaagtcctgactgtggtataaacaatgcattaggagtacagaagagaaaaagaattggggcagtggggaaagctgctttggggaaggagagtttaatttgggcttctaagagtagaagagagccttctctggaagtaaagaataattataagagacaatgcaggccgggcgtgggagctcacgcctgtaatcccagcactttgggaggccaaggtgggtggatcacgaggtcaggagattgagaccatcctggctaacatggtgaaaccccaactctactaaaaatacaaaaaaattagccaggcgtggtggtgggcgcctgtagtcgcaactactcgggaggctgagtcgggagaatggcatgaacacaggaggcggagcttgcagtgagctgagatcacgccactgcactcgagcctgggcgacagagtgagactctgtctcaaaaaataaataaaaataaataaataaaagacaatgcttttattcgggaataagcaatgtgtggtattaagactgagccagtagaacccagggaggtaatgaatggaacatctgaaggccagaggcttggggattttgttttgatataattggaagaaactgatgcatgctagcagtgttgaatgaggtcagaagagcaataattttgttgtgtgtgtgttttttaatgcatttcaaaaactagatgtgtgtctttctgtgtgtatgttatatatttatctgatatttgttgttttttagcgtttctagtttttgtcatctaagatgacactgcaaataaaatcgaaaatttctgatgagtggtatactctccagcaaagatgaagatatttgggcaaaaaaatgatgcttgtgctagccttaaaaggtcatcgaaggtctgtgagccagttgtctaagcgctgcttacactctgatggtgttgagggatgaggtgtaaggctaaggggtccatattcttattccctgggtccatagtacttttgacacagtttcagttagcaaaaaagtattgcatgtggtgtgtgacattaaccacactaaaaagatttttttttaaaatcatggttatattgtagtttaacatacatatacagtcttttaagatttctgatgagagtttgtattttattatatttagaatatttggaaattctttcactgggatcggaacaaattacctgtaattaacaatagcttagatgtggccttgcaagagtgattgagaacctttgggtcacgtgtggtgtatcatgaggtcaggagtttaagaccagcctggccaagatagtgaaaccccgtctctaccaaaatgtacaaaaattagctgggcatggtggcgtgcgcctgtagtcccagctacttgggaggctgaggcagagaattgcttgaaaccccggaggtggaggttgcagtgagccgagatcacgccactgtactccagcctggaagacagagcgagactccatctcacacacacaaagaaacaacagaactttcagaacctttggcacaacagaactgcatatctgggatgttggtcgtatctttatttggtcgtactaaaacacagactctctggcactgtgagaactgtttgcctgcacatatctttgcctgtgttctggccaatgctggcctgtcataccaggttccaaagatcactgacaggctgggtcatgtctgctctgaaacatccttcatatgcccccaggttctgacagttttgagagaatcctttctcagttttgagaacagttttggaaactgcccgagatgtttgaaattcacaaaatggaaaatattgagctggtttctgtaaaatatgctattttatttgtgctctttacagatatattacaaatctgtattctcattcacaggttaaactttgtaaattccaaggtcctgaaaggtggtggtcatggtggtagtagtataaataagcatttcagactggaaattcagtattaataatgaaatatttgtgtttaatttgtttagtgatatgcaatttgttcagtggtaatgttctgtttctttaatagcaattgaagcactgttttattatgggtaacttctcaaaatatctgtagctaaatgaaatcctaagttttagaatttgatttacattctttttttttttttttttttttttttttgagatggagtcttgctctgttgcctagtctggagtgcagtggtgcgatggctccaacctctgcctcccgggttcaagtgattctcctgccttagcctcctgagtagctgggattacaggcgcacaccaccacacccagctaatttttagtagagacggggtttcaccattttggtcaggctggtctcaaactcctgacctcgtgatctgcccacctcagcctcccaaagtgctgggattacaggcgtgagccaccgccctagccttgatttatattctttaagtattttttctgtccctgctagcagaaagtgtaacaaggtagcatttgaggagtttatatattcatccctcagtatttgtggggggatcggttccaggacttctgaggataccaaaacctggatgcccaagtctctgatataaaatgggcatggtatttgcatataacctatgcacatcctcctgtacatttgaatcatctctaggttacttacaatagctaatatgatataaatgctatgtaaataggtatactataatgtttagggaatgatgacctaaaaaagtctgtacatgttcactacagatgcattttttttcctcagaatatttttgatctgtggttggttgaatccatgatgtggaactcacagatagcaagggcctactgaatttgtttaacaaaaaaaccttgggtcctacttagtctctctgtcaggtacttttctgaatgttctacaaatattcactgatttattcctcttagcaaccctgagaggtaggttttgttatccttcctattttgcagatgacactaaagcactcatttaattaatagttggtccaagattgctcagctaattggtgttggagctgggattcaaacccaggcagtctggctctacagtttatatgctttaacactattctctactgagtaattctttcacaagaaaaaaaaaacaaaaaacaaaaacaaatagatttagtcatggctgttaggtcagtgtctgtgatgaactggttgcacatcagtaattctgtagtccatttcccttgttttgcactgacaattctgtgctaaattctttaaatttgtggcctcagacactgttttttgagacgggatctcactgtcactcaggctggagtgcagtggtgcaaacatggctcactgcagcctcaacctcctgggctcagttgatcctcctgcctcagtctcctgtgtatctgggaccaaaggcatgggccaccacatccagagctagcttttgtaaagatagggtctcactttgttgcctcccgaagtgatgagattataggcatgagccaccacacccagcatgttggctttttttttttttttttgagacggagtctcactcttgtcacccaagctggggtgcagtggcacgatctccgctcactgcaaccgccacctcctgggttcaagcgattctcgtgcctcagcctcctaagtagctgggattacaggcgtgccaccacacccggctagtttttgtatttttagtggagacaggatttcaccatattggccaggctggtctcgaactcctgacctcaagtgatcctcccatcttggcctcccaaagtgcttggattacaggcatgagccactgcccccagtggttttttttggttttgtttgtggtttttttttgttttttgtttttaaataatgagatctctgttgctcaggctttccttgaactcgtgtgctcaagtgatcctcctacctcagcctcctgagtagctgggactacaggcatgaacactgtgcccagcttcattctattttaattattacatgaaacataaatagattgtacagtttaaataaatataaatatgtggtgaaaagtggctcgattgacaggttctcaatggcaagaagtaggtcttcccacctggtgttcggtgacctctatgcttttaacaaaagcctttcattatacctttggagttggaatggaacttggagatcaacccttgtacactttcatttcataaataaggaaattgagacccaacaaggtcagtccctaagccctcaacagtttgttctaaaacagaaacatgatttaagccacactcctcaatttaatggtcttttcctcccattatagtcattaaaaatttatacagtgccagattaaatagctcaataaactttaaaaaatattttagatcaatttaaaagtacatataatcatgttaacctagattatttctcaaccacaaacctcgccctttttttcctctcacatttgttgtcttttgttgtttccagcaggcacataacattgctagttgtacatcatagcaagacttgtaagatctgtgtctctttacatagttacacatgcatataagcaacatataaacttaatattgacttgattcatgcaaccacataaatggttaacagacataattaggtggttatcagattaaacaaatatgtctttggtggagagtactaagtaggatggggcatattaattgtagcctaaatgtactgaatgtattctgaaatttgaaatgcaaacaattggaaaagctaatctaaactaaaaatccaaacttaaaaatatctaaactttaaaatggaagtttgcttttttactggaagtactcattatcagcactgggctttatagtgttaagtaaactagtttgcgaattagagaaaggcactaatgtaaaataggttgtgttctaaaaacttgtatttcagccatgtggtgttttaaatagtggctggatggatttttttctgtagaaacagttttagaaaagtggatggttcttagtagagagctcaccaaagccctgttagcctacatatacatctatgctctgtgaacgtccctaggcttgacactcttagtctttttcctggtattagcttcaaaatattttacatttatattattgctatttattttctatattacatcagatatatctggaattaagtatagatattaaaggagactatagctaagatttcttatactaccgtaaaaagtagtgattaaacaaatcaggaaaattataagttgaaacctctctttttaaagggtcgtgtttattttattgccttttagattattgaatctagtcaattaaaattaatggagctgggtgtggtggctcacgcctgtaatcccagcactttgggaggctgaggtgggtggatcacttgagctcaggagttcgataaatgttttgacattttgtatttctctaccaaaaacacaaaaaattagccaggcatggtggcatatacttgtggtcccagccacttgggaagctgaggtgggggaggatctcttgagtctggtaggtggagtttgtagtgagccgagatcacaccactgcattccagcctgggtgacagaccccatctgaaaaaaaaaaaaaagaaattaacgggaaaaagaccagtcttctggtgggactttaaagtaaaaatgcatatgcacccctaactacatagcttctactgcctagctttaccaactgataccaatctcttcattgatgttgatataattatttattcctgacaggattatggcatcataaagaagtgatttatataatctaaataggccccttataaaaagtgacttgataacttttagggacaatttttcttcaacatttttaaatatttaagtttatttaacgtatactgaaatttgcttaactaaacttttaaatttgacctcattgtagtttcacatacagtgtgtttgtttgtttgtttttgggagatgaagcctcgccctgtcgcccaggctggagttcagtggcccaatctcggctcactgcaacctctgcctcctgggttcaagtgattctcctgcctcagcctcctgagtagctggaactacaggcgcgtgccaccacgccctgctaattttttgtattttttagtagagacagggtttcaccatgttagccaggatagtcttgatctcctgacctcgtgttccacccgccttgacctcccaaagtgctgggattacaggtgtgagccaccgcacccggcctcatgtacagttctaagaatacagagagatcacttgtgccctttgcctagtttctgcctgtagtaacatcttagaaaactgtagcacaatgtcacaatcaagaagttgatataatccactaattttgtttctgtgaagttttattatatgtgtgtgttcatggatccaccaccacagtcaagttacagaacaagtccccactacagagatctctgaggttgcttttgagtagataagtgggattatgccttatgtaatctttagagattggctttttttacttagtgtaattcccttgagagtcgttcaagttgttgcttgtattagtagtttatttattctcattgctgattagtatcccatgttatggatatatctaatttgtttaaccattcaggtttttgtgtgaacatgagtttttatttctttggaataggtgcccaagggtacaactgctagattgtttggaaattgtgtagtttgattagaacctgttttctagtgtggttgtacctttttgcattcccaacagcaatatatgtgaaagattctgtttctctgcatctttgccataaccagtgttatcattgtttttgtatcatatgagatacaatcaggtatggattttaatgtaaatataaagtagctaaaataccatatactacaataaaaagtgatgattaaacaaacaggaatattataaaattaagtaacattatacttttttgtttgtttgtttgttttttggagacagggtcttgctctgtcacccaggctagagtgtaatggtgcaatctcggctcactccaacctcctcctcctgggttcaagtggttctgcctcagcctcccgagtagctgggattataggcctccaccaccacgcccagctaatttttgtatttttagtagagacgaggtttcaccatgcaccatgtctgccaggctggtctcgaactcctgacctcaagtgatcggccatcccagcctcccaaagtgctgggatcacagacgtgagccactgtgcctggcctgattttttgttgttgttgttgtttttaatctcaaaaatggaatataaagagagacagagattttcctgatgggccaaaagttgactgagatctaagaaatggattttggaaggatgcatgaggagcatgatggtggggtgctggccagagtgaaatttgcccgcggccttttacaaaggtagacagagtgatggtaatgaagagattttgagtcatactattggggtccgtaatacgaaaaatgcttctactttgagttatgcattggttccttttaggatgcagacttactttctctcttgcccacctcaagcctgtgtataacagttgcatgataataccatcacatgcaccttctcttaggattgcctttggtacatgaaaatgcatcttttttgtgaacattgtaagccaccttataatagataacatttttctgagcccttactatgaaccaagcattgaaatctatgcacattgcatgtagttaactcatttaatccttgcaaaaactatgtagcaaattaccccaaatttaccagcttaacagttatttaggagcagcttggctaggtggatctagctcagggtcataaggttggaatcacaacattttagctggggctgcggtcatctgaagacttgactaggcgtgggagatctgcttctaagatggctcactcacatggcttttggccagaggcctctgttactcatcacgtggaccaccccatcgggttaaaatattatcacaacatgacaactggcttcactcagagtgagtaattcaagagctgcttctgctaaagaagccagaataccttttttgatgcagtcttagaagtcatacactgtcacttctgccatactctgctcactagaagcgaatcacttaagtgaagccatgctaaaggtgaaggggattaagctccacttctttaagggaggaatatcaaagaaattgtggacatagtttaatatgaggaaacttaggaagggaaaggttaagtgatttgtccaagtgcataccttgtgagttgcagaacctggatttgaatcccagcagactccatgtgtttttggttgttctgtgaaccacatgctttgagcacttaacctcttgaatgcatattcgaactcacaaggtttggtggcccaagcctgtaatcccaggacttggggaggtggaggtgggtggatcacttgatcccaacagttcaagaccagtctaggcaacatagggagacctcatttctacaaatacagaaaacaaaaaaattagccaggcccgctgtgaatacctgttgtcttagctacttgacaggcttaggcaggaggatctttttgagccaaggaggttgaggctgcagtgagctatgattgtgccagtgcaacccgtttctttaaaataaaaaaagttataatgactttcttcatatttacgtgttcatatctagatattcatgaatgatacggccctctcttttatatctggtttagtactttgactcaatttttacattcactcatttagttgatagatactgatcacctcctgccaagtactgggatgctcaccatcatatgggaaagaactttcaatttaaaggtgaactaactgacctggcaccaaggaatttaaactatatattgggtaatttctgataactaaatattgggaaataaacctccccccaccccagctttctagttcacaccttctctaattgttagaagcatattgcatagttttaagaatgcattgtaaactgaagttggcaatgggatgaagttcctcagatagagtttgtctactgctaatatcaaaagcaataaatacttgagagtcctgggcaatgttgaaactgtaaactgccaatgtctgttttttcttcctggtactttaaatgaccatgaactctgtgttgtctgggttagttttaactaggtagtttgagagatgtgaaatgacttgtttctttgaacaaatctgttttgtaaaatgagtcacccagattatgcaaaaagagaaaggaagagaggtcttagaattttgataagatctttttcatattctgtgcttgtatttcattttgtcagtccatggaaaagtctttattgtggtgatcattttgacattaaacttcagggtacttagggtgaaaccgtaagggcatgtacaccttagggcattagaatgcaactttatgttcataatacattggactgatgtatacatttaaaaacttaatgttttagcagtgtatgcagtgaaattgtatgaaaagtaacatttcataggctgactagggttgaaatagagcaagccacctaaaaattagttagaagaactagaggatggagtaagaacaggaccagagttaagggatgaagcatcctgcctttataaggaacttcttgttgaactctaaggatttgacaaccatgtttcttatttgacagcattcagtgaatttcctaatatcaaggttaagttctctcatgtatacacacatatatctagtttcctgtctagcctaattcacacattaaattcttgatttgtatctgatatacctccctccttctgtgtctgacagtactaagggaatttcttaataatgaggttaagtgttcacatgtgcagacacttctcttgcctatactttggcagcttaaaatcctaggaattctcactttttctcttttccttttagatatatggcagacatgaggaatggcctgagttggagtttgcttcttaagaagtcctatcaggcggggcacagtggctcacgcctgtaatcccagcgctttgagaggctgaggcaggtggattacctgaggtcaggagtttgagaccagcctggccaacatggcgaaaccctgtctctgccaaaaatacaaaaattagccaggtgtgatggcaggcgcctgtaatcccagctacttgggaggctgaggtaggagaatcgcttgaacctgggagaggtggaggttgcagtgtgccgaaatcgtgccactgcactccagcgtgggtgacaaagtgagactttgtctgaaaagaagaaaaaagtcctatcagaattagagcttaggaaacattctgattagaagtcagcattggattgggctgggattggctcctcaaagattgaacatagtggtgtggtatacccagtgctaacttgctgtccgtattctctgaacatgtctgagcagtgctcaggtcctgccttatgaattatggaacatcattgttcttctctcttccacctgtgctcccattagtcttccttcttcccattatcctaccaaaaactttgtgatcaccttggcaaagggaccctggtttccataggccctaaatcagggtatgaatttggttattctacagattgtgtcagccaataactgtcacttacagcaaatactagtggatccctcaaaactagggagtcacgtactctggataattattaatatatggatggctttttcttttagaaaggaaagagcaatgattaatattaaaatagcctaggtgtgatagcttacacctgtaatctcaatactttggtaggctaaggtatgaagatcacttgagatcaggagtttgagactaacttgggcaagacctcgtccctacaaaaaataaacataataagattaattggatgttgtggcacacacctttagtcctagctacttggttggctgaggtgggagaatcacttgagcccaggcgttctaggctgcagtgagctatgattgcaccgctgcactccagcctgaccagaacgagacccaaacctgggagtccataacaacagcacagtggttttggtttttctttctttcttttttttctttttttttttttttgagacggagtcttgctctgttgcccaggctagagtgcagtggcgcaatctcggctcacagcaacctctgcctcccaggttcaggtgattctcctgcctcagccttccaagtagctaggattacaggtgccgaccaccacgctggctaatttttgtatttttagtagagacggggtttcaccatgttggtcaggctggtctcccatttcctgacgtcaggtgatccacctgcctcggcctcccaaagtgctgggattacaggcgtgagccaccaaacccggccagtggcccttttctaaatcctatggttagtcaatccttggtgtctgtagcaatgtgacctcctgaaccaaaacttgccttcccagggcacagaaaaggaacaagtcttttaagtccaataggtgaccattatcaggaagtaagaacttgaccacctgcttttcttgaagtcagtgccaactagaaactggagcttgaccaaagccagttcatttctgctgagctgcaatcagaattaaatgcttgacaggccatattaatggttgcagtaatccattttcatggtggcaaggcctgaatgggaaatcctaccaagccaacaaagccttctttggaaatgagatgaccagcagtcctcagcagggttcagtcttgcaacttggtgtttcagctcatggttacaaagttaacaaataacttaatagattatttaaaaagagtaaaagaagttaaccagtgtgtaaaatttacaagctgggccctgatgccccgcttgtgcattaaaacaccctagctgtatgcgatttatgctgcatgggtatgtggaggccttaacttctcagtttctgaaacccaagtttatattacatggtctgtcagaagagggatggcactgccataggtatgggagtgatccctcagttcttatcttagtagagcagtcacaaagcaagaatacccctttgactgaaaccaggatgtttctgctcctggggcaaccttagtcactggttcccctttttggttagattattttttcagaagtaaagaaacactgacttttggtcagaattgaaatgtgaagcaagttacatgaatatatttttgccagatcaagcttgtccctgaggatcaaggacagggaggaaaatgagaaagaatatttctaaggacagtggacatgctgagtttgtattttcaaacgaaggaaatacatttgggcttggatttgttctcatttttaaagtagttgtttatgcttgtaatttaaatgccaaaatgtataaatacataaaatgaaggttatctataattctaccttcctctccactattaacatatagataatttggtatgtattcctttgataccttttttttttcccttgagcatgtactaacttataaaaaccctaagagaattaaagtgggaatatgggcagttcctgctgtttgctttttcccttaataattgtgaaccttgttctttgtcagtagatctggatatctacttactcagctttttaaatatacaggttaatgagtttgggcttttctttccccaaaaaacttcaagtatgaatttgcatttgttgaaattggacgtatgtatttgtaagtatgttttaattatcataaattaaaatgtggataattttcctggtaaccatatattgatcactattctggtctatatggtcctgaattttttttgcactttctctttttgggtctgtctccatttcagtctatctcttacatttttctccttgattcagattggtttttatcctacttccctttcctcccttctaaatttctttataatactaatctctcctgacaaacacatataggtgtttgtcagttgatgttgtgtaactctattgataaattgtgactgggaaatgccatcttattttgcttgccatgtcaccagctgaactgtttacaagcaaatatgtatatctccatggatacaggattatgtaaatccttggatttgcatatgtttctaagtcagtcgagatatttatagaacatacactctgtgcctaggactgtgttatacactacaaataacagccttcaaactctaaaatgcccatagaaaggtttcatctgtgaatccactgtgtgtttcaagaatggtttctccaaaacaatgattcaaacatacagcacatttaaaagctgctttgaggtcttcatttatatctataagaatatgggtagatagagagagagatgaatgtagccattaacaccatgggtttactcaagagtgtttcaaataagtaactatacagtcattcctgagtcattagaagatagttatccttcccagttccatgaatttaagaggaacctcaagagcccagctcagagcagctagatagatgaccttaaaacttttatgaaaaactagaacatgcagagaaaatgctcatagtctttggatactatgtgtttaccagatgtggctgctagttgaaaagtgtctgtgattattctctgttgtgtactgaagtcgagcatttttctattgctttttattttcatgcctagattaccaacaagattagatatgctctttattaaagagagggccatttcaaggcctgcttttggcctttctctccagggaagctcaagactgccacaaatggctttacttactgaatcggagtttattaaatgagaagacagtcaataaaatgtgtcttgcctttcctagtgggagctggcaatgccatttaagaacacgtggccagtttatccaaaatctaactgtagcctctgcaggaatgctggataatggctaagccaagaacactcttgctcttctgcccagcacaggatgatttttactagcatttattctttcagtcctgttggggtaaaaaggaagttgaaggtacatctacaaatctttttgagtctctttgggacaaagctgtcagcagtttcatctcttgaacttctatgaggcatgttgtgtacttgtctaagaaatatgtttccccatgtgttccataaagtaaacatctgcggatgctaaaggcatagtgccaggcacatctgtgtccatagacattgctggtaaactaagggctgctctggataatgctttgacctgctgcaaagttcagttggcgtagtaattcatttgttatttttggggaacagttttgttaatgagtatttcatcataaatttacatgctgcttatgcttgtatcttactcttggggtttttttagttactttgtgaatgagctaagctttctgttatcacaggcagccattacatattcagtttatttcactgacagtaagctccctgaaggcaaggatcatgtctatgaattcagtaggcttagcaaagccaaaactctgaagtgccctccctttagtggctcagatgaaaagtatgatggtaataagagtagagaaactaaaatgttttaaaatatttctgtgattctaggccgggcacggtggctcacacctgtaatcccagcactttgggaggccaagacgggcagatcacctgagttcaggagttcaagaccaggctggccaacatggtgaaaccccatctctactaaaaatacaaaaattagctgagcgtggtggtgggcacctgtaatcccagctactcgggaggctaaggcaggagaatggcttgaacccgggagacagaggtctcagtaagccaagatcacgccattgcactccagcctgggcgacagaacgagattccatctaaaaaaaaaaaatctgtgattctagatcccagtcaccatagaaaagcatgaatttgatattcagaaagctattttttccattcattattcgtgattttttaaaacttgcttgatgactttcctagtctgaggaggtctctaggactccaagcacattatgtttccggatttaagtgacctctagttggaatcaaatacataatgtaagtattcaaaaattatttcccccttgtcaatctattctactagaggaaagaatatctcagtgagtgagatgagatattctggtagatttctgaaacaatagtggacttcatgagattctaggtaacctaagtctcgtccatgtttaaataaaatgccaaacatctgatctgcctccagtttgatgaacaaagcagagttgctttgagcctcttggcatctatgggtgagtggcaaacttaggcctgacgggagctcagattttctttttccccatgtatgacaattttctattgaaacactaagataagaatctcttcgctttccattatggaatatttacataagaaagaatttcctccataaactttataatataatattgatacaaatattgactttgtttctagtcccttaaagaaagggaggtaataaattgaggtaattctcaacctaataaaataaacttacagtatttaatgcatatttattttagaaagatggaaaatacaaataagctaataaacattaaaatcagttactataccattgaggctaaacgatagaaacatttgagtacacatactataagataaatttttttcctctaaatacttatatgttggctactttatagaacaaagtggaactatatatactttttccttgaacgtcatttttattggctgtgtaatatttcattgtatgatacagatgaaccttagtttatattaagtaaccttttgttcataatccccagatttcaagtaacctctgttggtaaattgacatttatgaagcccttttctctataacaatattataaataatagtttattttctaggttaactcctcaaattctaattcatatttatcacatggtaagatgcaccactagataaatggcaccatgacacttagaacgtaagttctgcttatcgtatcatttttgtggaaatctctgtaatccagttagaacctggcacagtgtcagagagaaaacaggcacttcccaaaatctgaataaatggaagatggtattctcgctctgcccaggttgtcctgaccagaacagccaagtggaatagatggtgttcactttctggactatgggaggagagttgcgggtgacagggagggcacactggattagcaggatttcctcactgtttgtatctttgacacttgtcagcaattctgcctcagcgaacttcataaagaccaccaggaacttgtttatctggtggcaaagttgggggtagtggaaatgaggatgcaaaagatacagaacacttgaacaacaaacttgatgtaattgatacttatagatcattccacccagccccagcagaatacacatttgttttaagtgcacacagaacatttaccatgttctgaaacataagacaaggaattgatgggcattaaaaaaagcatatacctttcatatataggcattccacttctaggtgtttatccaaaaagaaagaaagtatacatccatacaaagatttgtacatgaatgttcatagccattttatttgtaatagccaaaactagaataacctaaatgtcaacatgtgaatggataaactgtggtgtatccacactacagaatacttctcagtaataaaaaggaatagactgttgatacattcaacaacatagatgaatctcaaagtaaatttcacttcatgctaagggaaagaagccagatgaaaagggtacatactctgtggttccctctgtatatgtaagtgtttgagacatatatactaatataaagagatcagagcagtgattgcctggggatggagaatggtgggacagagtgggaggaaggattaaaggggcatgaataaacttttggtggtgatagattgtcttggttgtgatggtggtgatagattgtcttggttgtgatgtttcttaggttatacatatgtcaaaacatcacatatttcaagatgtgtagtttattatatatcaatcataacctcaataaagctgtttataaatatatcataaaataaggcattcagaattctggggctatttacatcattatagtgtttatcaaacatacttacatgcaaatggcatgacattttactgtgtactgtgctgggtcaataaaagggccttgcttggtgattcgcacttctgtgtaacaggaaacagtgaaaagtgttaggaatctagaaaaagccaggcgaggtggctcatgcctgtaatcccagcactgtgggaggccgagatgggaggatctcttgagctcaggagtttgagatcagcctgggcaacatggtgaaaccccatctttacaaaaaattagccagacatggtagcagactgtctgtctgtctaatattctccccatctttcactgaggaaaaatctttcatgtatatattcatggttaacaattgaacaattgagcatcgaattttcaatcatgttgcatctgtgtttgagtagagaaaaacaaatagaaaatatgatgataattcagtagctactccttgcctattgaatcaagatcaaattcctgagccagtggcttttgatgttttgtgtgtttgaccctaagcttcttgtttagttttggcttgcccttccccaagaatgttttcttcttctcctacttcactgccttggtgaatccttttctctgcctgtgattcttagggatcccacctcatcttttggctctatttggtaaatgcccatcctttcgattcttactcagatgctttctctggtgtttcccctgtgttctgtgttttagtagacactaagcacatagtgtgtaccctacactttgcactatatgtatttacatatgtgtcttgaatgacttttattagtggcaccgtagccaggtaccttgtacatggtggcctatgtgttgattgtgccttaaacacagtgggtggaagacagtatggcgattcctcaaagatctagaagcagaactaccatttgacccagcaatcccattactggatatatacccaaaggaatatacgtcattctgttaggaagatacatgcacgtgtatgttcattgcagcactattcacaatagcaaaatcatggaatcaacccaaatgtccatcaatgatagactaaataaagaaaatgtggtacatatacaccatggaatactatgcagccacaaaaaggaacaaggtcatgtcctttgcagggacatgggtggaactataagtcatcctcagcaaactaacacaggaacagaaaaccagacaccacatgttctcacaagtgggagctgaaggatgagggcacagggacacatgatggggaataacacacattgggcttgtcgggggcttgaggggaggaagagcatcaggaagaatagctaatggttgctgggcttaatacccaggtgataggttgatctgtgcagcaaaccaccatggtatgtgtttacctttgtaacctgtacatcctgcacatgtaccccagtacttaaaatttaaaaaacaacaacaacaacaaaaatgcaatgggaacaatagtcagtgaggttggccctgctgttttggaaccgaacagatgaagagttaatgcattttggttactatttaggtgcattgggcttaactttacttttacatttattaaagttattgtaattaatgcctatgaggaaagcagcaacaaaacaagcaggaggaaacaaattgtttttatattatttttgaagcacattatataggcgatatatttagggcagaggagtggcagatttactgtgctcatgtcatttttttcttaagctaatatttaaattatatggaacctccccccatccttcacatttttagaagtgtgcaatggctagttgggaaaagttagcttgtaaatttaaatcaactagatgtaattcactctgaataattcacatagaaatattcaagtgttggcttaggggatgtaccttaagattacacagaaggctgcatctcccctaaaatttaaaaaggaaaaaaaagtgttggcttagtggcatcttaacagtgaagtattcgttgtatcatggaaagagcatgaatttagtatgagttgtggaatatttggaataatatgtttctgagatatcaggtgagagttaactctctggagtgtccacacccttgatcacttcctaaatttatttttccaggtccggaccctatttgtcagtggccttcctctggatatcaaacctcgggagctctatctgcttttcagaccatttaaggtacctttttttatctttcagaaattataaaatgagacaaaagtctgtatgctttctgggagctttttgaagcaagaaatgaaatatttgagaagaaaacagatgtttttaaaaggttaatgagtaaaggagatttaacaactgagttctaatgtacagtctcacttaggataattacatatttatatttcaaatgcagtaatgtaagtgaagatttatttctagtttcataccttattatttgaaatagtactgttgatactgttctttggaaatgtaaataggtttttatgaactgagttaagaacctaaccaccgttattttttccatggcaaaactttcaaacaaagtaaaacaaaattttaaaggatacctaggtgtaagttgatggtaatatttcctggtgtttattgaaatatttaatgcagttacctgtccttcctatggaaataagatcacttgatagatacttaatgttgctaggattgaaaacttcataggaaattaaacaccaagcacttcgtagaaactaagccaaaatagccttgctgccaagaagaaaccttttgaaggttggcctttggaggataggagaaagctggagctgatcgaatcggggccctggaagggatatgttccttctctggaagggcctgtgctcaggaagtcttaagttggtcagtgtggatgtgttagcagcagtgcctggcagagaccacacttatgattaggtgatgggctgtcttgatttctggttaaagatcattctcactgaagcaggtccccagtgatagaggcatgacaggttgagggataggattcagcttcttaggaagacggaattggatatgacaactaaaaactctagtgttggggaggaggaaggagggatgcaggggcagccagttagaaccaacaaagataaaacagtctagcttatgtgccaagagggcaccatgtcataagggacataagtccacctgacagccatcgctttaatgcaacaataatgatgatggcacagggaaacagaggtcaggtgccaggtcaggtgggaggaagtgggaaaggaagagaaggtggtatggagagagtgccaccttttatagaatttcctgagtttcttctgccgggttgtacttttataaaaaggaccatttttctatcctttttatagaatgcaaacttttaacgcaaattgatcttcttagtgtataaaatactgttatgttttggggtgtatagagagaaagacattcaccagcaagccctttatatgaattattaaagtattgtcacaatcctttcaagtgggtgagtctcattttttcaaatgaggaaaatgaaacttggagctgaataaattgtgctcaagtttacacacataaaaattggcagagccaagattcaaaccaagcagtctgactctgccctctctgttctgaactattatgttatactgcttttctgtttgtgacttgagaacacagtatatccctaccagtggtgttttacttgagtgaaatatccagttgtcctttgccttcaagaccttcatggtgtttaaacctctagttttttcagaagagagcaccttgaagaaaggaagaggcagagctgtgaatcatgacctctctggccataagagctcaaggcctttgaggtgaaatgtttatagtagctaattggtaacatagttctctgctgggaagatgtaaggatgaatcaatctcaacatcctgcccagaaaccccgactagaaagtcagcaccctagtacattcctgacaaccctcttttaattaaagtccctggaggctgaccctagtctgcaaatctgtctctgcgctgatgtgtgtagtggtcaatcacgtcaagtggtgtgtttttcccctgtgtcgtccgttaatgcaagccaccagctattgattattttcagaaataaacacattttgttatccttatcttgaggagccgggaggggtgaagagagggagtgaaagagggagggagtgtttctgtcttccttgagcatgagctggaataaaaacctgaagggattatttttgcatgtccccatcagaagagcaacatgaaaactggttccttcagtaagttagcaaagtaactcaacaaaattcaacatcattgcctgcttaaccatttctggcagttttgaaaatgtggtcagggagttttaccaactatatttttttgagacggagtctggctgtgtctcccaggctggagtgtagtgacgccatcggctcactgcaagctctgcctcccgggttcataccattctcctgcctcagcctcccaagtagctgggactacaggcacccaccaccatgctcggctaatttttttgtatttttagtagagatggggtttcaccacttgtcgatggtctcgatctccagacctcatgatccgcccgccttggcctcccaaagtgctgggattacaggcgtgagtcaccgcacccagccccaactatattcttaatgttttattgttgttattttatagcagctacatgaccaatacatggctctgaccttcctgttgtattaaatttaccctctttccttgcctatttctgtaaaactcctattcttatctagaccaagaaaacaaaaagattgctattaacagagacactcatttttctaccattgtgtaatttcatgaaaaaaaaatagaaggaagagaaacacagataaatccatagattgattttttttaaaggccccaagaatgcaaacaggtgtgtgtgtgtgtgtgcacatgcacatgcatgtgtgtaatttgctttcccagataacttaggagacatttgtaggaggagttaggtaatcaataaagaacttatttttacatgaacaagatggtattactacagttacttttggctaaacttggtttttctttattttcagggctatgagggttctcttataaagctcacatctaaacaggtaagaatttcaaagtggcatataaagatcacttttttactttcctcaggaatattgctggggcttgacattctttttttattcccattagaatttgaggggttttttgtctttaaaattaaaagtgagatgtattaggaattagcacaggaaaatacttcataattctataatcttcagctggaatttcagggactgtcccagaggaagataaacacagtgatacattgagattgattttgtatgttcaatgaaaatagtggtttattatttaaattcacttttattcccaagtctttcccatttcttttaatgaggttaaacaaacttttacaatcaatgtgaatatcagatcgtgaaggatcatgctgtctgtcaaacccctaaattaaggcagagtcccgagtccagaatggaacagagaacgtacaaaatggaagtggtagtcagtgattctaatagttcctacaagcttagagattgtagctatatacttttttttttaagctaaacacttggcatacacacctctcgaatcactattcatctctctggctcatgagaagaatgatcttggaggcacccttctgtactgaaagatagggagtccaaagggattatggcctttctgtatttactcagaacagcctaattaagaatatgatttttttttttttttttgagacggagtctcactatgttgccaggctggagtgcagtggcgcgatctcggctcactgcaacctccgcctcccaggttcaagtgattctcctgcctcagcctcccaaatagctgggactacaggcgcatgccaccacgcccagctagtttttgtatttgtagtagagacagggtttcaccatgttggccaggatggtcttgatctcttgacctcgtgatccgcccaccttggcctcccaaagtactgggattacaggcgtgagccaccctgcccagccagcacaggattttttaaggcatcccttaggatttgagataggaatgttcactttgtaattttggtcatgcagtgagagtccaggggttttatcattgtgtcattgtattcttgcacttacagtgtaccaaaaggtgattcggttctctttccattttaaaagatgaagaaactgaggtacagtgaatttgatttaggaaagtagagcctctccaacccaagttttcctctattcccttgttcactgctgttcacctttcaaccacttctagatttttttatgattctctaaatccccagctgtgctcttgaagaactaccctcaccatccctttgattcatattagaaatttggctaagccactgagtcatgattcttcgggacttcgctttcttatttctgcccattgcctgtggtcatttctttatcttagctcttcagtttgatgtcacccttgacctagaaaagtagacatcatctgattttttttcttcatatttctctttttttttctcagcctgtaggttttgtcagttttgacagtcgctcagaagcagaggctgcaaagaatgctttgaatgtaagtactaatgatgtaattgtagggggtttccatatgaggtggtgggaagtaatggaatctctttggacgggaaatcaagtggaaagaatatgactgcacagtctaagagggagggattcatcaatttaattagcactctaaagagctttttccaagaattgtgatcagatatgcagattattaaatagcactctgctttttgattgctctgaatgaaatgctcaaaatatctgacatctgatgatgtgggtcttattttaatctagccccatcccatccaatggtggtgcgtagtgctgctttgttttttccagaggagatatttgaggcgttagcttgctcatcattatactctaaatgactatgctcagaatagattgaaatcctggctttttttatttcatgaggctttccttttagatatgcagcattaaaaaaaaaaaactggttatagcctttattctggttgattaaaaatttacatataaggctttcccaaaagacgtgtgttgtaatagaataaattacagtcatttgtaattgagtagatatatctgtatttggtttgtagttatgttgtttgccatgtgttttgagacttttaccagtattgttttggtgaatatttttcctccttagtatgttgaaaaactaaacaatttaagggaactaagttagagaaggtggaaggaagcagaatgtggtttcagatgctgaggatgaatcctcaggtgaggagtctcagcgaaggctggctccatcatgctctaggcagttggcctaagtggctgtgaacaagtgctgactgaagcactcagagtgtttagggtgcttcctacaaggcaagcggccacttgactggttgtaatacaggtaccattttggaggcgtctgggaacttgcgtctggcctttgtgttgctgtggtacctgcaggtacccctggcagctgctcctttgagtagaccatgcagagtgctgttggagagacctgatataggtgatgacttagaggtctaaggaaaagtctttatacttcatataatggtgtcattgatacacaaccttaaaaggtttttagactttggaacaaaaatgtgtacactctgagaagaaacaccttaattcttgttggtttttcatataaagcatataggaacatcttaggattccaggaattccagagtccagactttttctggatttggataaatgaccttcttgtcagaataactgcctactcactctgttcctctcctgtataacaaagtataaaccaattatttattgagcaccagtggtatacaccgaagcacggtgtataattgaatgttttgatataaaagttgttttatgatttttgcattgaatacgtaaaaaccagaattttctcagtataatgacactttaaacttaaaagtagaaccacaatttcaatttagcagtgttttattttaaccaggtgggaaccttctaaatgcagaaatattctgggtcctttaaagttatgttagatgaagttttcaccatgttcttttcattgttcttacaaaggaagtaacaagcagttgaagcttcacagacttggctctcattgctttactatacttctcctatgtgtataaagatgtcactgactcattttctgaacaataggcttttatagtgacctgtcatctgacaaggcaacattcccttaggtgtggtaggttgcatttttgttttttaaagataactgaagggttttgtttgtttgttaaagaataaagacatggtgttgctgtattgcccaggctggttggtctccagctcctggactcaagtgattctccctccttggccttccagagtgttgagattacaagcgtgagccaccacacccagcctgaagttttttgcttgtttgtttttgtttttgttttaatgtttaaatgataatagtcaaaaaaaactgtgtttcctcatcatactgagtacagcgaacataatttcaatttttcttggtgcccaaaggttatcattacaaatagcaggtaatgaacctagtgtaatataatgatagaggtgtttaaccctgtttgcccctgtgccagctggccgcagatcactgttgtctggtcttgaggtctggttttaggttattcttcttgcactaggctctccattctttttttttttcactggcagtacgcctttctttagcactgtcctctcctttaatcattaatagtttgctacttatgtgttaataacttgggaaggaccccaaataaaacaggtctaattctgtcctgttttgtgggcctgagggaaaattcgtatttacctatggaataatgagcctgggctttctgctgcccaaagctgacttacataagagtgtaggacatttactgagctcctggctgatctctttcttgacgttttgaacttttctatgtaaagtagtagaggtattagaaatctttccgatgttgtagttagggaaacagacgtggagaggatgggtgattaagtcagcatgtgtaagtttagagctccaactaggaggcaactaaaagtaaacttcttgcatctaagccttgtccattttatacaacatccttttgcttgctttgtacatgggatgttgctgcatttttccttgtggcagttacagagtatttaattcacaatgtccaggacaaattgccaccataaagtttggtatgtgaccatggagcagacccattcaaggtaatgtatttagtcatgaagctaataggtatattctttgtgatccaacatattaggctctttttagggtcatcttttctaattgatgagttaaaaacatatgatgcttgtagccattacagaattttctcctcccatgtcatctgtccagggttctcttaacattttcttacttacctttggagagagaattcaatattgtaatgttttgttttattccactattgagaaacatatgcctgaatccagtaaatttctctgtgtataatacttcagtgttatgaacgacttctccatgtttaatttctctttttgttgtttctgtcttgattgctatctggttcagttgttagtattagtgattagtcttttctcaaaatgactaatttttaaaatctattttctcatttttggactgggcttcagccattttgataattgtgtggaaaaacatgctcagattgaattaagttgtaacagtgaacttttatcagggaattaaaccttctaaagttaaatacagtacgttttgtttctatagcaaaaagtcccacgttaggcaaagaataacccaaacccagacttcttttcaggttatctttggtctcattaatccacatcattaaaaacccctcctttctttaacctgacagcaaaatatctgacctattctttgtctttaactcactttgtaatttctgtacctgttttgaatttccaagctaaaggaagggggcactgaaaatcttaagtatcaaattatttttaggacttgtttataattttggaaagtaaatcaaattcactaatataggcagttagctagatttaggaaaaattctgatttgtggaaatttttaaacgggacacaggaagcagcgcatgttgaagggtaaagatccccagcagatgtgggagtaaaccatctagctatttccagcaactgtgaggacctcaaattgtcattattgtctagtaggaatcttgtttttataaataagaatgatttgtagttaaccttcaattcaggcttgtgcatgatctctgctaacctagagatctctgtaatgacctgttatggcattgttttgtcttactggtgtttggaaattggtcattactttaaaaagttttggactctttagtatatgtgccattcatttgctatccttccttccctgattttggatagttgttattaggctaggttttatcttagactgtattatgttacacgagaactagagaagtctgtacatcactacaaattgccttcccaaccaaaattgcttaggctagtgtagtaatttgctttactctcaaactatactcattaatctaagtgatctctaattatcagtgaacctccaagttcagtgttgtttttcttccagatagctcttgagatgtaatttgcatatgattcacccatttaaaattttcaattcaatggcttttggtatattacattattttttttaattacggtaaaatacatttaaaattttgctattttaatgacttttaaatgtactctttcttggcattaattacattcaccatgttatgcaatcattaccactatttccaaactttttcatcaacccaagcagaaactctgtagcccttaatgcagtaaatacctccccattctcccttttccccagcccctggtaatctctaatctgcttgctttctccgtgaatttgcctattctaaataatgaaatatttgtctttttgcttctggctcttctttcttagcataacatttttgagattcatccacgctgtggcatttaccagaatcaaattcctttttatagctaaataaaattgtattatatggatatgtacattttgtttatccattcatttgttggtggacacttagattgtttccatgttttggctattgcgaataaggctgcagtgaacactgatgtgtaagtatctgaatctgttaattcctttgggtatacctaggagtagaatttctgggtcatgtggtgatcatatgttagctttttgtttactttggtttgtaattttttccatagtggttgcaccattttgcattaaaaacttgttcctgtttgtaaaattataaccattctagtagatacgaagcaatcgtggattcttgctaaatgctgtttgactgattttaatagtagatttgatttctgtaggaatttcacatgacttaaaatgtttcttttagcagggacaagtaacatttctgtgacagttctaagtaatggaactgcgtttgttttacctgtcaataagtaacagaagggggaaaaactcaaccctcatattactcttttaataagacagaacttgaaggaaaggtattttctcaaggtctaaatagattttagaataaagagttgaaaagcagttttgtttaaaagaggtaaaatggctgccactcagacttccattgcaaagaaaccttaacaataaatggaaaaactgtatgtaaactaaaaatatataagatattaaattatttcttgactattgaaaaattttgattcaatagtatttgcagttaagagagaattttagaaagctttaatttgtaagaaaatatgctgagaaaagacttaatagtgtcagatgttgaaaaaacagctgatatgatcaggaaaacttagccctattttcatttccataaattcctggcattcaaataaacactacagttatttataaatatcacagtgattacagccttgtacataatttgttatactaaatagtttgagctttccaactaccaaggttctttacaattagatataattaattcattagttctataccaagtttctcatttgtgagatggaggtattatttacttcgaaatggtaaagggaaaacaagcaaaagcatttgcaaatgctctgtaagtaaacctatatcatgaatgtattttcttggccagaagtactggtacagaccgttaagtatggagggataccagggcagtcaagacctgcactgggtacatagaaacattttggcttggttagacagtctctgtttcctgtaccacaggttttcctgacagcctgtgcaagttaggacttttgatcttaatatttgtacagcttgtgagttaggtgaattatttccaccaaacaaaacattttacgaatataagcatccagatggcctatctcaactcccatggcccccaccagacactatatcaatatgtttcttatcagttttgaaattttctccttaagtttcatttagcatattgctgaaagtgggttaaagaggcccaattagtgagatcccagctgggacttttagatgggaaatatgcaggattgccagatgagatcatgggcctgatctagtgtttatctgttaaatctgtttataactgcttaactcttgacttgcagacttttaaggcagccatttgacgtcacagggttgggaacgaggcttgtgccagtataaagccgctgtgatgtggggccattgggcccttctgtttttctcaactatgtgcatgcactttggagcttgacaaacagccgtgtccagtgaactccccccaaagaaaattgaagttgactcaccgtgaaaggcataccaccaaaagtgactcctaacccatgtacaattcagaaagaaagcactagttaacaagtgcccagtgtgtgattatttagttctagaatctgtccagattttctttgttctggctctgttctcttcatggtggccctgcagtttttagatgttataaaacctccctacgattataatagcatgtaagttaaaagttgttgtgaaaaaacaaatgaagatgcatttataagtagtcttcagtctttgcctgaagaagagtaagttggttatttgaatttatgaagcatttacataggaaactagaaaataaaacactaataaaagcgccttgccaggagcagtggctcacgactgtaagcccagcactttgggaggctgaggtgggcagatcacctgaggtcaggagttcaagaccagcctggtccaacatggtgaaaccctgtctctcctgaaaatacaaaatttagccaggcatggtggtagcctgtaattcccttaggagactgaggcacgagaatcacttgaacctaggaggcggaggttgcagtgagccaagatcgcaccactgcattccagcctggatgacagagcgagactccatctcaaataaataaataaataaataacataaaaaaaaaacaaaaaacagggttcagcccaggtctgtatccagtgcccctactttttaccaggctggccaacatggtgaaaccccgtctctactaaaagtacaaaaaaaaaaaaaaaattagctgggcatggtggcggctgcctgtaattccagctacttgggaggctgaggcaggagaatcgcttgaacccgggagatggagcttgcagtgagctgcgatcacgccattgcactccagcctgggcgatggagtgagactctctctcaaaaaaaaataaaaaaataaaagaatctcaaggaagtttaaagaaagaaaagtagtcggaaattttagtagcatcctttccctggagaattagggaggaagaaccacacgttctcacacatgaaccagtgtatattccaatgacaagtatatgtggaaatctcaacttcacccagctcttctctaggtaaaacatttccatcagataattacatgactgtgtgaaatagctctcagaattttccttatggccttttatgaggatctatttgtttaaacttacataattttaaaactcatgccatttaaaaaatgatacctcatttgaccttgccctttctccatggtttttcagacatttcagaaagtgctatgaatctaatttgcctctgttataaatgtaaatagaaaatatagttagtgtttgtggaacatgaagtgccgagtgagttttttgctagatcttgttttggctgctaagatgccaagccagttttagaaccaagaagtcttaatcttaatgtcttgactgtcttgactacccacattactgacggttctgcagggcagcacattttggcagcttaaatcactgtcttctttgttctcttttacttttagtgaatgatcacatcatcacagtgactagggtcttcagagttccctttcacacactggcttaatgcttctgatagtccataaggatttgaacttttgctccacaaagctagaacccttggtcttactctgtaactggaatgcattaaaacattttaaaaccttagggagtcgggtaggacttaaccatctcaaagactgaataaggtgttttgatagagactagttaattattgtactctttcaagtatatgcaatatgaggtattttctttataattaaatgcaggctttttttgctttttatagacatttaataattacatggatgtgttaaaaaattttaatgagaaaattacaaatagtcaaaattttttatatgtaaaataagtgagggagaagaaagagtaaatgtttatagaatgtgaaaaattatatatgtaatacataataaatatgagactaggaggaataaatgaaaccaaattttagtgaacattattagactaatctagaatctaaaagataataaaatctgttaaagctaacatttatagaaaaatacaccgtgaagtatatttttaagactaaaacttcttttctaaaaatctagtgtaaagtttcagtagataacattttgaaaaaccaagtgatgctttgagtaacctggtcattgcataaaaggatatataagattttttttttcttggccattgtgcggcaagttaatttttaggattattgtttttaaattaaaagttcaaaataatttccccagaaaagcagttgggtagaaaattccttttctactataaacctatgaccaacagttctcttgtattttgaatttttaaatctggtttctcctttatttgccttacacaagacatcagtcatatgtaaatgaatgaataaatacacagagtacttaaagagttaaatttgtaaacacaggacatgaaaataagtttagatggaaaaggaattcacatcaagttactttataacaaaggaacaaaaacaggtaaagtataaaagcattatttgtatgtgtactttcaaaaataagaataaaaatacaatccacacaaagtaatttctgtataatgtctcacagaatttaggtattcacttagaagtcagatgtaatgatgtccaaataaaagaacattgaatagaaggcagaaaaggttatttaagattacaggtgatagatacacctctgtggaaaaggcaaacaaccaggtgtgaaacagaatctggctgttcacacctcttagaatgctcaataaatgagtgacaaaatgaatggaggaaaggcttttaggcttagggatgaccctaggtaactctagcaggaaaatgttgattttaacaaaatttcaccctgtccccttgatttatctgtagaggtgtttaccaaattctgaaaacacacttgaaactactcttaaaataaaaaattttaatacactgacattaaaaacatactgtgtatttgatgttagggtagttttatgtatttctgcataacatcaagtgttagtgagtttgtacctgtaaaaaggtactaaatttgttaattgaggctaagaagagaacaatggaagtatgtcttcttgataaccaatcatgtgggtgtccgaatccagcggacctgattatatccaggccctgccactttactgatttgggggctcttcttcaagccttgattttccttcctatgctgttgatcgtggccacctcaaagggtaagaggatcaaattaaatgagatggtgggtgtttttgttggtttttgattttttgttgttaagacagggtcttgtcctgttgcccaggctggagtgcagtggtgccatcatgactcactacagcctcgacatcctggccttgagtgctcctcccacctcagcctcccgaatagctgggaccacagacacatgccaccaggcctggctaatttttttatgttttgtagaagtgttgtctctctgtattgcccaggctggcctcaaactcctggcctcaagtgatctctcacctcagctttgcagagtgttaggattatagctgtgagccattgcgcctgaccgagatgggtatttttaaagctactggcattcagtaatggtaaaaatgctgttaattaatgataatgacaaccttcacaaaggactggtttttattcctaaagtctctttttcttttcttttctttttttcgagacagtctcgctctgtcgcccaggctggagtgcagtggctcactgcaacctctgcctcccaggttcaaggtattcttctgcctcagcctcctgagtagctgggattacaggcgcgcgccgccacgcccggcgaatttttgaatttttagtagagatggggtttcaccccgttggtcaggctggtctggaactcctgacctcgtgttctgcccgcctcggcctcccaaagtgcagggattacaggcgtgagccaccgtgcctggctaaagtctttttttctgtacactggtgtttttattttttctttttttctgtatactggtgttttttgttttgttttgttttgtttttgagacggagtctcgctgtgttacccaggctggagtgcagtggcgcgatgttggctcactgcaacctctgcctcccaggttcacaccattctcctgcctcagcctcccgaatagctgggactacaggcacccgccaccacgcccggctaatttttttgtattttttagtagagacaggatttcactgtgttagtcaggatggtctcgatctcctgattttgtgatcctcccgcctcggccttccaaagtgctgggattacaggcgagagccaccacgcccagcctctgtatactggtttttaaaataattttggtggaacctcaaattccagtggattcagagtatttctaaacattgacttatagttaatggtaaaattattcatccttcctttcttggagctcatcagggaaacacagttgcaatgttatccttaatattctcaagcctataaaatattgtaacctgaacaaacacatcctcatctcccttttattttatcttaattgtgcacatctttctccatttcaaattctaattgaatctctgtttcgaagacccaacatccattgattataatgtttctttagcagccagtgagattcctgacttagaggggttttgtttgttattgttgtcttttttttttgagacggagtctcgctctgtcacccaggctggagtgcaatggtgcaatcttggctcactgcaacctctgcctccggggttcaagtgattctcctgcctcagcctcctgagtagctgggattacaggcgcgtgcctccacgcccggctaattttttgtatatttggtagagacagggtttcaccataccatgttggtcaggctggtcttgaactcctggacctcgtgatgcgcccacctcggcctcccaactgacttagagtttatagataagcctttttgcagaaggggagaaattcagcctcagtttggttagatcactagtaatctaattgcaaggattcattagagtagaggaagagcactgatttcagttgtgtagtggcgagataggttttgcctcactttgttttggctccctgtgcagcacaggaagtactttgcagtgaacttcctaagtttggacttgactgtttacattcttttcaactaacttgtgccttaagccccaagttcttggttggaaggaggttgcaagccatttgatggtgtgtgttagaggtgttttaaaaaatagggttaaggagcaaatttacccactttgcttatttctgtacttttatgaaattcatcagtgacatctccccccaaccctattgattaatttagtatatggtattagtaaatgatgttgaggaccagtaaataatgtattggtataaatggctcatttttatccttagtgaaataaaggatataaaaccattgacttataaaattatttgtattttttaaatgtactacagctttttctttctaaaaatttgttgtcaagttgtacagtttgaaaattagtagctagatcaagatagtgattatctttgggggagggggaagaaaacaagaaaatgcacgttttctacttgctcttggtatttcatttcattaacattacctaaacttggttgggcacacacagggtgggaggtttcactggatcctgttgggggctggggggctgattgctaaaatactggagagcagaaacaggattgtgaaaatatacttggaggcctattgcggtctatgtctgatctttaaatagaaatcttctcaaaatggttttggaaagtttaggcaactgttttttttcaattgtagagtttgtttatgtcagtactgttttctctcctcctcctacctctttttttcttctgcaccagccactaataaaagctcaaagtaaactttgcagaacgatccttaaaacatatacagaaagttaagataggtcctcaaatgacctaacaagcacttaaggtgaagctaaaagaagagctcgttaaatgcattctcttagcctgcctacctcacaagtaggacttattcttcatgtgcttttccatgtagacacagacacccccacccctcccccaatggagtttcgctcttgtcgcccaggctggagtgcaatggcacaatctcggctcactgcaatctccggcctccacgattcaggcaattcttctgcctcagcctcctgagtagctgggattacaggcgtgcagcaccacgtctggctaatttttgtatttttattagagatagggtttcaccatggttgtcaggctggtctcgaactcctgacctcaggtgatccacctgccccggcctcccaaagtgctgacattacaggtgtgagccactgcgcccagccgacacacttgttttttaaaataattctctgagactttttatattacacagtgttaattattcaacttatctttgagtgcataaagcactttcacacatgcatgcatccattgtctcattttgcctgataagtgcataatatgtattagatgcaaaagtaggttgatctccttttcagtaattagaagattaatgtgtaattatgtataattagtcctttctttaaagagctgacaccacgcttgtcaacaccagtaaccctttgacttaaaaaaaaaataccccttttatctttaaaggatctagatcgtcatctgctaattggatatgaaattagtaagtatttcaaaacccatcccttccaagtttaatcctgggttttgtacttggcagaagctgtatgggcacatatgtggcccttatgaatgaaagtgattctctcaatttgcaatcactaggaaaaaaaaatacaagctacttttaaagttgttattgataatgaatttgcacataaacccccctactttttcactggattcactatgtaaccaaaggggtgtgtattttctagactggcctgtttcagtaatatagactggcttctttaagaataaggttgtgatttcttttgtccattttattgttgttttctttttttcttactctttttttcctttttggtgccaaattcactgatttaagcctatgatctgagctttacagagatgaatcacataatcgggaaatcatttacatgttcacattgacagggcatggtttctatgccacatttctgaaatttttgatgtgacacccataaggctttagtcaaatacaaggacgtgctttgttgaggcaaacccactgttgatttcccaagtcagtgaagttggccattaaaattctgaagtttctttggtgtcacttgacagtgaccgacatcagactggaatgtcttgggccaacattaagccaatatggaccattaaaaatttgtttataggttttccccaaatcaccccaaggtctctatcagagttgaaaatttaactgaattgagagctattgcctaggatctgcttcctttaagctttcattttgagtgccttcatttagcaggtagcaggagaaaaagacattgatgcaaaggggaaagaatgtatgccaatgggtttattcattatccttacagtgagacaggagaggaaaaggcagtaaggactctgcaatgaaagggactactggcagcaccagccacgtttggtgtttgtgcattaaggattctaagggatgtttttatgcctaccagagcagttgacctgctgctttaccttctgttcaccttcagagttctcggtgtaaaaatgtgagcatcaggattcctgagtaagagagtaccatctgcactctggcctatgtttctttccatgtaatattatctatttcaaagtgtcactgtaaaatatttctttaatgggtaactgactgtgtttgggttagaaacagccctttcctatcattgtcagggcccaggtctttcaatcatccttttcagaatggtttgagaacatagtggcaaaagttcaaacaatcacgccctctcgaccctttggaaaataaactctgcttgtctctgattctcttgacatgttaaagattgcgtttatcgcttcttcaaaggccctgtcatgactttatagtcatcctatacaaagcagattctcctagggcatggttatatacataggggtggttggctaacacaaaaagtaagtgtgtgttgtagaaaagaaattaattgggctggggtggatggtcaagtcagatggagattccagataccttcgaagtatatctgcctggttcctcctacaaagggaatccagtctctgcaattaccagccaggcctctaagatctactcagactgtgtgaaccaacagacatggggcaggagaagcaggacacacgtcagctccctgtgggggaaacacaggaaataaaggaaactacacagcatcagactggacagcagctcaggtgtcctgctgctttctcccaattggggcagtctcagagcagagtatgaatctcatctttctctttctaagtaatagaagaacctctccaaaaaagccaaaggagaagaatccccattggttcatatttggaagaggagctccatagctgataagcactgggccatagggattagtgtttatcagatgtcaggcattaatccggccatttacaagatctcatttaatctttacaatgaatgctatgaaatatggactatattcatccccagtttacagcagaggactgagacacagaaaggttaaacagtatatccaaggtcaatactggagtagtatttgaatctaggaagtcagactcttaaatccacactcccgattctcacagtgtaagcctcttgttcctggggaggttccacaaaattgattgtgatgctgagttgggatgtctcttttataattgtgactataattaactctagctgatggtactcctagacacctagttttctcgatacctttgccagttgtagaaggggattgattaaccaagaccttcttctcctggttgcttttctaatccttctaggttcgggggcagacatgaggttttccccattttgttattggagcagttactacataccttaaacacaatgtattgttttcaccataggaatttggcttagtggtgggagggtgtgagtttgagtgccacagtttattcaaaggaataaaagtgaagccaaatgtacattgtattttaagaagtggcctagtcactaggaaatattaaaatctttttatccctctggttaatgaggatgagattaggcttctctatcatggccaatattattcttttataacacttagcttgttacagatattatcagaggagaagttacacaggcttgaaatcaaagataaacctgtggaaacattctagactagacatggaaacatattcctgtctgttactaaaacattcaaaagaggataaaattttattgcgttttatggaacatctggtttagaaacaattatgaaggttttttttttttttttaaattcaaggggttaaaaatcaaaactgacttcaagatatgtggtaacctaacacttcctggaagactgttcaattaggcaatcaagcgagaaactgtgcccagactcatggcccagcatcacctctaatggctccatgggcacgtataccacaggaagccttgggaaaggggtctctttctccaagtgcagtatagctgttttaccaatggacaggcaaacatgttttcaaatgactgatttaggcaagggaaaaaaggagtattaaatcagattattctaaggtaaagccagggcaagcactgggaggtagttggattaagaaaaagaatgaggcataattggtgtgatacagtttctcattgggcagtaacccagcagcacaggctgttgtattaacagtcctgatgtctttgcaagcaatgcccttatttaggaaaagtatgaaatacggtttacatctgacggattctttccctcacttgttcattctctgttggaatccatatctacctaagtttcatcacaatgcaaactgaacaacagcctcagttattatctggaaacaatgtagtctttataaaagaaaaatcttcacggaactgtaatgtcctcacacacacacgctctattgggaatttaaaaattggattgtgatatggattctaccagtagttagctgggaatttaggcacattatttttctggatcttttttcatctgtgttgggaagcctattggcattttggatgagaattcttaacattgtgtgggactatcctgctccttttaggactttatcttcctgcctcctgcctaatgaatgcctgtgtggtattcagtcatataacagccttcagatacccttgcgcatttctttttttttttttgagacggagtcttgctctgtctcccaggctggagtgcagtggcatgatctcagctcactgtaatctccaccacctgatttcacgccattctcctgcctcagcctcccaagtatctgggactacaggcgtccgccaccacgcccggctaattttttgtatttttagtagagcgggggtttcaccgtgttagccagggtggtctcgatctcccaacctcgtgatctgccctccttggcctcccaaagtggtgggattacaggcgtgagccaccgtgcccggccaccctcactcatttctaaatactcctaaggagtagggggaaagggcaatgaggagtactaaccatggctgagaactaggcttgatgaccccaaaagttcagtactaattatgaatttcatgatttatgttgacaaacctgtattacttatcagagaacctgacccagttctctactagcttcccattcctgtgatctttactcatagttttctattttaaaaatgtttgagtgtcacaagttttcacttgtaacacagtgatatattaataaatggtagaaaacttctactggttcatttttaactcacctgcacactgttgtctctcagtgagtcctgtgctctccactgtaatagattacccagatgcgggtttatctgtggcctgtcatggagtcatttcaggctccaactgagcgtaacaattgttttcacagactcctggggaaactttcgactataccttgcctagtttctgtttctgatataaccgattatgatgcctgtggcagagaaagctgacaatactcaaaaaactaaatatattttaaccttggaccaatatttgagagctcagaatctctctaaagtatgtatttacttcctagtttctgatggaaatgacatggctatcaattttaagaaacagtttatattcctaacttatgtttttaacttctaaaaaggcaaaaaaaattctttctgcttcatttccttttctcctgttgaaagatttgtggtccccaggatatttccttttcttgtgaccaaaacgctctttgaaaatagtagaaggcttttattgtggctcatgcctgtaatcccaacactttgggaggctgaggcaggcagatcacttgaggtcaggagttcaagaccagcctgacaaacatggtgaaatcccgtctctactagaaatataaaaaatcagctgggcatggtaatgcacacctataatcccagctactcgggaggctgaggcatgagaattgcttgaaccccaaaggcagagaggttgtagtgacccaaaatcatgccactgcactccagcccgggtgacagagtgagactctgtctcaaaaatgataaaccggtagaagacttttattcttagctctctctagaaaatggttttttttgttgttgttttgttttgtttgtttgtttgagatggagtcttgctctgtcgcccaggctggagtgcagtggcaccatctcggctcactgcaagctccacctcccgggttcacacagttctcctgcctcagcctcagcctcccgagtagctgggactacaggcgcccgccaccacgcctggctaattttttgtatttttagtagagatggggtttcaccatgttagccaggttggtctcgatctcctgaccttgtgatctgcccgcctcggcctcccaaagtgctgggattacaggcatgatccaccaagcccggccacaaggtcacagagggatagtagcaaatttgaccttgagtttcattggctgtgggttttcatttggagttggccgtggaggaaggggcagtataaaggttgttagaatcaattgaagaagtctttcagcctactagatgggatcgtatattactactaccttactatttttatcctatagtaaaaggcagtttcatctagttcagtacatatgcctcagatctactggatcaacagatcagaatggaagtgtaggaagctctagcagaatctgataggaagctcttaaagaagtgacttgtggctgtatcccagaggaggtagagcctttgattatttagaagcttccttggagaagttcagtatctcagaaagtcaaagcaggtggggaggggagttggaattctagatcctcagcttttagtcaatatttataatatatattcataagtgggttagcagaaagatgaatgggtcgatgaatcagctttcacttttgaaatggtagaatagtttttacttgctatgaatgcataggcaaagtggagacaacaaggatggggagagactccaaattgaagacagaaacaaatgactaactgtatgtcaaatgaataacacaaccacactgaaggtggggggaatggggaaactaacccacaaataatccaaataatatacatattggcaacatacatttagactaaagacaaaaaactgtaaataaatataagttgtagttaatagactttttatagtggtatcggttagcaattgtgcatttttgtattgagcaaataaataaatgtatagtagataatgagagctaggattctcgctattagaggagttacacataggcaaaggagagggatagaattaaccaaatggtgttagattggaattggagctatcagtatgaacttcaatacatctaaatatattttaaatatattaaaatgtgtttattaaaataaaaattaaaaatattttaaatatatctatatgatgcagagaagtagatctgaatgttagggcatgtatgtgtacacaactgggacacttggaacagcaaaataaataatgatagtaatgaattataaagcatagagctaaatataagtctgtaagtcattactgatgtaaataattaacagggcagaagggagagcttttccatggagtagaaagctgatacactgtatataaaaggagcaatgaaggcaatcccagctactcgggaggctgaggcaggagaattgcttaaacacaggaggtggaggttgcagtaagccgctgagatcatgccgctgcactgtagcctgagtgacagagcaagactccgtctggtggcagcagggaggagcaatgagattactaaagcaccatttggcaactacaatagtaacagttgcttcaggtaataattattaataggtgttaaaactagtagatttttttgaaaaacaacatatttatatagtctggaaatatctgtctataagaaactacttaaaaagggaaaacagcatctttacaatagagaaacttggcaaatgatcaaagctaatatcactcgtaatgggacaaaagtgacatcatgtgcctcttgatattatgcactgtgcaggacatccatctctgatcttcctgccaaaaaatgcgtaacctgaatctaaaccaaaaaaaaaaaattagataaacccaaatcgagggctactctacaaaataaatagcttgtagttttcaaaaatatcaagctcatgaaaggtaaggactgaagaactctttcaggagactaaagtgatgacaactaagtgctgtgtgattctggattagatcttggatcaggaaaacaaagagatgtccttgtttttaggaaatcaaactgaagtaaagggtaaaagaatagcatgcttgctacttacttttaatcagttcaggggaaactgtgtgtgtgtgtgtgtgtgtgtgtgtgtgtgtgtgtttgataaatgtgaaatgctaacatctaagaaatctgtgcaaagggtatataggaattatactatgtctgcaatttttctgtaagtctgaaattatttcagaataaagttctttgttaaaagtaactagtttttaaaaacatagctggttgaatgctgtgtcccagtaggaaatcccttattccacctctctccttttgtttttaattctgtattggattttataaattatacatagttgtaaaaatttcaaatgatgcaaaattgtacaaaagtctgtgccctctctcacccctaccactaagttgtctgctattattaactggttggttgtctcattctaaacctttctggacttacacagatagagaagtatacatgcagatgtatatacagtctcctctacccccatactaccaaacattgttgagtatcttttttttttttttttcaggctaatctagccatggacatctttctcaatatgtatatatagctctgctttgtttctaagcattttttttctaaatgagtcattccattgtccctaaaactcattgtcaaggactgatggactaactttagcgcagaaccatttgtaacaacactgggagcctgaagctaacagaattgaagtactctgtttattgtaccacataaccaagactgtatcaggtatgagggtgctctgaagacctcagtgacaggaatttggagactttttctctagtgagaggctgttacggtgactcagctttggtcaacaccattttctgtgtctctatataggctcaaggttgaaatccttataagagaaaacaggttttgtcactttaggctgcagctgccccttaaataggcagctgtggtcagaggaataagggcacagaacacagacattggcccctgagtacccttcccaaagaagaaggcttagagggcagtagccatctcatcccagcttctcttcccagggctgctctaatggtttcatatctgatctgttctagtcccttcattgagtctgtcttccctaccacccctagagttaccgccaatcactgtgattctcaaatgtggtccctacacaaacagcatcagcattaccctgaacttgttaaaaatgcaaattttcagattccatctcagagctactgaaccagaaactctagcaaatcctccaagttgatgctgctaacatttgagggtcacagacctactacataaagctgatcatattatcccccccatttttaaaacctaatggcttagctgagcacacactccaaagtcctcagtcatggcataagaggtcctttgtgatctctccccagtctgcttgttcagccaccccacccctgacccctcccaccccaacaccctttctgcatcctgttacagagaaatttgctgagccctttcctgaactgcacctggtgaacttctactcttcatcacttcctctggtgccttccctggctccctggcatgaaactgccctggtatacttttaagtatactggacgaacaagaatatgttgtttctcagcagtgtccttttaaagatctcccagaatttgccctgagtagggaattcagcctctgtagattatatggaacctgcatttgtagagactgttggctgtccagtagccagtcagattggggtgcttgtaagtaactgtttatattcaaattaatatactaatattcagaaactgtcctttctggtccatgtaataaataggacaccatttacatttggaagagaaaggttctctgttcattgtgagaagaacggtgaattatgagcaagagaggaaaaggttgcttttgaaagacacaggttcaccctttcacttggcagtaatcttatcctgacagcatttaatgtggagtaattgtagccagagaagaatcttagtaggctttaattaaaaacacaaggaatttttttctcttgtcttcttcctatctgcctctttttcttttttccctcttcgtttctgtgttctcccttttcctgcccctcttttttctcctcttcatcatcccttaacatttaaaatgtttttggcttggctaatccctatggatggaaacttagctgcgcaggatattgattaccaaatatggtattgctgctaaagatgttagaggaatgtggcttgtattctaagcctccggcctctgaataagctgccaaacaaattaggtcattttaacttctgagctttttttttttttttttaaataaggatgctggaactttgatttggaacatgatgttgatgttattttagttcaaattggggggcgggtatgaagaagggggcagggagtaggggagacttagttcagcatgttttaggactcaagccgccagcccaggttgtgtaagaggcaaacacatgatgtggagcttcagttgattctggaacaccagtgaaagagctgaggcatagaattcacatgtgcagcctcattttctgaggctagatgctctagaccacaactaggtcccaggatactcttcacatcatccccagtggcctgggccacaggactcaggttaatgtgaactcaggtttaggaaagttgcttcttcacaggaaggttggtcaagtttagtgccggggaggacgtcctgaagttgatggcaagttgctactatgtgtgtctgatggagtgtggtgcaaatgaggaagtccttttacagcatacctgtacgtaacacccagggactgtgcttgcctcccagcagagaccacagttcttaggtccattcttggaaatattaattctgttgtaatattagctttgttagggtggaagttggtccacctcagtgaggtcctttgtgacctcaccccagcctgcttcagaatgcagctttgctttttgtttttgtttttccttatatactttttcttcaaaataatactgaggtttcccaaatttaaaaaacaaaaatacaacacaatatcagttaaagaaaatgttcttatgtttcacagaacaggcactatctgttcgctttttggtgttgattaggtatgcacaagggtattctccacatcccttttgctactgccctcagttggtttcttctcagaatgagtgagtcatgctcatgaagttccacccactccaagacttctgggtcagggctctgtggcttttgttaggcctccctaaggacctctctttccttccccttccccccttgtttcctgttaatgccattaccatccagccacaggctcttccttgtatacttgaagctgagcctgtgaagttcagagttgttcatcctggtctctagagtaagagagtcttgtttttgtggatatttctttttttgagacagagtctagctctgtcacccaggctggagtgcaatggcgcgatcttggctcactgtaccctctgcctcatgggctcaagcaattctgtctcagcattccaagtaactaactgggattacaggtgcatgccgccacgcccagctaatttttttttttttgtattttagtagagatggggtttcaccatgttgcccaggctggtgttgaactcccgagctcaggcaatccactcgcctcggcctcccaaagtgctaggatgacaggcatgagccacaacgccctgcctgctcttattttttttcaagctcattaggaagaatggtggcgagggggcgggggatgctttggagccctcaggcccatgtgtgtacattcagaacactaaatggcaactgtgttcttaggagactcgttttcaggactccagtccctttccagaccacaccatgaaaacatgggaactgagtgggtcccatgggtgcacatttaaaatacactctcttgggatatctttttgacacgtagggtccagaattcatggtattggatgcttaataatgaagacattcttgaatggtggaaaggttccaaatagacttgtcttgcgctagtgtctttcatagtgtctgtgatttgttttactgaatataatctattttaggtaaactgcaggaatagggtcagaggtaactgaaattactatatattaaagtgtgtaactgtgctaggaatttgctggttcaaattttaaactgaaaagtttttgtctaaaaagaaaaggaatagttgaaaatctgtgtaactacattttttaactaaactaaatcccactgactttcgggacactttgtgttgtcatttttcatgtaacctgtgtaagtagtaagaatgagagtggttgctgaccttttttcctgatagaccagggtttactggtgtgtttattttgtcaccattccggtttgactcaaaggaaatgaaaacatcttccatttgttctctgtttccaaagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatgtaagtcgatctacttttcattcaaaagtaataataactaagaactgttcatgtgctgcatgtgaggttacaccatgggacatggagctggctgagtcttattttccatttctgtgaagaggttgcctaggcgttcttggtgtcagaattccaaatacagcaatcttgtttgtgattggcttcccaaaagatggttcagcttgaatagaaccataacttcagaatatcatttgatgtactacagatttccttaatgttatattgaccatcatgagtatgcccctagttgccttgggtataaacccttcattcccccctgctcggacacgagagctggttctcagcatttactttaatccatttgttgaaggacatcagctcggtggctttggaaaaataggatattaaaagagaaagaagcagatcttgggaatttggttctattcagtttagccataactctagggggaaaagtaaacacatacaaagaatgtatatattggaactgtcagtctagcaaactaataccagtaaaactttaaggaaatttggggctttcttttccaacttaattggataaggacactggctaattgctcaagacgtcttctaccccacattaataagcttatttcattatatgtccagactaccatttctgcctttccctgaataactttaaaagattgaatttgctttctcaagctcagtcagtggcagaagtggggcatgagacaggccttaacttctcctttcattgcagagccatatgtgatttaatatggcagggcattcaaggaaacccaagtgacttggattccaagttatttggaatatttctgtcctgttgtttttggtctgctttctaaaccacacggttgtgatcttcttccttcgatagtacattttaactcttcttattgaaattgaaggacacatggattccttgctccccccatgtcatgtgcatgtcagatttaatcaggttatctttggaagtcacagccattctgtagttcagtcactcttggtactcatcagtagaaactaacagataagtctccctgaatgttctaaaataaatgtttctatgaatccagaaagtcataatagattaaaaaaaattattttgttctttcaccttctttgtcccagggaaactagaaacctttgcttatttgggaaggaaatctaaacaaaagttacatcttacagtgtacttgtagtacaggaggatataggaacatcttttacataattcttcatccttatagtatctagcttaatactttgtatattgtatatatttaatatttattatagtgagtggataaattgatactgaaattgggctacttgtagaactgtagatgcatttgtatgcctcttctctctgaaatttcttctctcttgatcaaggcatcaaaaaagagtatttttaggatgcctgatttagtaaaaataacctaaagtaattctttgcctttttagtgaatttgccagcctcagatctcagagttctttgaaaagattaattcaggcaggaaatgtaatgctggtgatacttaactttaccttttcaattctttgctgaatgctctttttaacaggaccacgaaactttttctgaatttcctacaacagccctgtgaaataggtagccaggaaggttgtagccagattacgacatgctatacaaaagcaacaaataggaacaaactggacattcacaagtccctgaagttacaggagagcatagaaactgagcttagaactcttttctggcaagctctgctcacctcccttcccagcatacagaacagtgcaaaaatggccagatagtttccatgacagggtaaaaacttgcccagctgttcacagcaacacaaatttgaagtttaaaaaaaaaaaaaaaaaaaaaatccaagcagccagcagtgtattcttgaggaaaataaaagtcagcatgatttatcttaatatagctcatttttacgacacagcatcttgaggagagcaagtccactatggctcaggtcaaccttattatccattgccattccctctgggaactgggaacttgaccgtcacatacaacttgcttacctggaagcatacggcaagactaagaacactgtgttgggtctacacggacaaacccacttgcattgtactcagaattggtactcaaggtggtcagtttaactacttatcaggtgtagaatataatggaattggagaatttgaggattggaaaggccctgaaggctagtctttgttgtaggccatagaggttttttataaatgtttcttttggttactgtttttatatggtagtggctgaaaagcactcgttgccatcactaaaggaagaatgttctgtggtttgattatacaacacacatacacttgaactctcaattctccataaatatatgaacttaatgaacttaaacgagcacccaatgtgctagaccctggagaagaaggaaattggttgctgccttaaaagagctgtcgttccggggaggtgatggtggtcaaagttgtcagaaaaacttggccccatatgaaggacatataagagattctgcagcttagttgagattgaccccgaatcagactgccgtatttgctgagcacctgctctatttgtgccagggatggagagtgagaaaaccaggtgttgcaacttagctgggtagatggtggcctgctgtggagaactttggcttcaggctagaagatgtcactgagaatcctgtcgataattctgccaattattgacaagctttgtgacctttaagagaaaaaaatttttttcacttggttgtgctcctattctctcagctgtaaaataggaataatactttctgattgttaggagaggtaaataaaacaatatcccaggattgggctgaggattaaatagatatagtgtatgtaaagtactaggcaaacgtaaagtacaatcataatttgttaataaaaagcattgggttgcctttctttcctaatagttacagcagatattgatcttctgagttgtcatcacagtttgagtgtagccaattgtctttgcaagttaggagaaaggatgagtgaaattgacatacaatttcaagaaagtagtatacctacctgcctaaattaatagaattgatcattaatttgagcttttatttctcttccttgtatgtaataaagttggaaaagatctgtgagaaagcgggagttaagagatgaggaagaattataaattacattaaattctcttagattgtgcattaggttgtacaggaatgtagtattctataataagaactctgctttggaggtgaagaaagagtaagtcactgttactgatttttatttttctcgtctgtaaagtgatgatgctgtgtgccagatcctctcctaagcatttttatgtgaattatctcatttcattctcaatagcacttattttccagttgaagaaactgaggcctgggaaagtctagtaactttcctgagttaacactgtcagtaagtgtgatggctgaatagtgtcccccagaattcatatgatgaagtgtctgttcctagtacctcaaaatgtgaccatatttggagataagatttttaaagagatgattaagttcaaatggggcccttaggggtggagccctaatccattatgactgctatccatataagaagaaaaagagacaccaggtatgtatatacacggaggaagggccgtgtgaggacagaggacaaagcaaccatctgcaagccaaggagagagacctcaggagaaaccaaccctacagacacctctagactggcctctagaactgtgaggaaataaattatttgttgtttaagccactcactctggtatatcactatggcagccctagaaatacaatacatcaagtgatagagcctagacttaaattctagattttttgtcatttactagttttgtaagtttggtttagttacctaacctctctgtgtctcagttttctcagctacacagcggcaataattagggccacagagtcagtacgcagtgactgttagtgtgcgtgtgtaaaaatgggtacattcacgtgccttttgtccctcataattaaaagacctgtagtttttctgtgtttgtatactcagcatctcacatctataaatacataatggatttttttttttggtaacataccatagttttatttttatgtttttttcaattgatcatgattttcttattcccagcaagtgtggagagaggtgcccttcaaagtactttttaaacttacagtgttactgaggtctgattgggatgtgataaaatgcacatatttaagatggctcatttggttagtttgtcataatacatatgaaattaattgaataaatgttcttgatgagtttatactctttgcaatataccttattataatagtgcccttaaaggtggaggcattcaacacttaatagagcctttactcagtttagacagatcctgtcctttcgattcagtttttatgaagcagatatcaaaaggctccagaactctgcagtaatgaagattcctgtactccagctccaaggagtccggttctgcaggtctgggctaggacgtaggctctgtattttaaaaaaataataattgttcttattttcctcccctctaggcttttaaaagctctttgggtagttttgatgcacagttgagagtcactgataaatcaaggaatttttaaagttaaattctccttcctactttcatattcttctcctttgcccctgcacctttcttccttcctcccttcttccctcctcccttccctctctcagacaaaagcttgctctgttaaattagtactcttagatacctgatcagcacataacattttggtgactaatcagattacttccttgtttacctgccatgtccctggaagttcccatttatccagtaacaacctacgctaactggaagtgagttctgtgtctcatgtctgaagagaccctgtgaaggttcaggagagcctgtaaagtatctcacacattccctcccagagacaacactgagcaaataggaaatctcttaacattcatctctgcgggacaaggtcatccagggcctatctaaagcttcctgtatcccatggtacagagccctggtgcctgcattttttccaaggcagcagtgcatggcatgcacaattagaaagattggcagatgtcttgtcagtttcacgcctgctctccagcggcattgtttatgaagactgactgggcaggaggaatacctaatcaatctgggcagaaggaacgggacacaagggaatgactaaaagttgcaggtgttctgagggcaagactttctatttcatttttttctcataaccaaaatcctacatgcttctcagaagaaaaattttcaggcagtccagcaaaaaaataaaagtcattaaattctactacccagagacaatcaccattaacaatttggtgcttatccttacacaccttttaatatgcacataataaaatgtatctctttctgcattttgaattttgaaatcatttaacttacccctttatctttaggacaaagttttgctgcaagtgagactaagtggctcagtagggccgaaaataatacctgggctctcacaaaacatcacctcagtctctgctgctgttgctgtagagcactgtgtattcatatggcacagatacgcttgctagaatcagagcaagaggaatagtggcagagagaagtctctcttaactctgatgtctcgagtaaacccaaaccagctcctgagctgcttgaattctggcatttgattgaatgattcataggcctttatttaatggatgggaagaaaggaaatgtttattgagcaactactctctttccttaagaattatatgtaaaatacctattttacccctaaggagactgaaactcaagagtttgagtagctttcccaaagtcacatagctcattttaaggcgtgcttggctctaaaactcattgctagtctcacatcaccacactgccttttttttttttccagttatgtttttattatttacctcccaacctgctccccctcctgcccttcaacattgcctacctttatggtccatttcttgattgattggcagggtttggctctgtctcccaggcaggagttcagtggcacaatcatggctccctgcagctttgacctcctctcaagtgatccttctacctcagccttccaaatagctgggactacaggtgcatgccaccacacccagctaaatctttattttttgtagagatggggtttcgccacattggccaggctggtctcctgggctcaagcaatccacctgccttggcctcccaaagttctgggattacaggtgtgagccatgactcacttctttttgaagtagcccatgggtgctgacagctatagttctttcgaagataattccttagaaggtgctttaaactcactcagacctttgaaaatgcacttactaaagagatataaagtcaggatttcagggctggtcaacttcttattgaaaaaaatcaaggccaggcgtggtggctcacacctgtaatcccagcactttgggaggccgaggtgatctcaagtgatcaggaggtcaggagtttgagaccaccctggccaacatggtgaaaccccgcctctactaaaaatacaaaaattaactaggcgtggcagcgctcacctgtaatctcagctactccggaggctgaggcagagaatcacttgaacccaggaggcagaggttgcagtgagctgagatcgtgccactgcaccccagcctgggtgacagagcgagactctgcctcaaaataaaacaaaaaatcaagcttcagactgggcttggttgatcattcctgtaatcctagcactttgggaggccgaggcaggcgggttgcctgagctcaggagtttgagaccaacctgggcaacatggcaaaaccccatctctttaaaacaaaaaaagaaaaaaaaaaaaaaaatatatatatatatatatatatatatatatatatatatatttctgtgtgtgtgtgtgtgtgtgtatgtatagatatatatatttgtgtatatatgtgtatagatatatatatttgtgtatatatatatttgtatatatatgtgtgtgtgtgtatatagatacacatatatatatacacacaaaaaaaattagctgggcatgatggtgtgcgcctgtaatcccagctactcaggaggctgaagcatgagaattgcttgaacccgggaggccgaggttgcagtgagctgagatcgcaccattcctctgcagcctgggcaacagagtgagactgtgtctcaaaaaaaaatcaagcttcagtataattcagtagcatcaaatttgatggccaaggtgcattaactgtaaaatgttagctgaagttgaaccaccagatcgtttatatttagttttggtgtacttttttctctctgggaaaactaaaactaacataggaatgtgagggattgttttacataatattgggttggttattcagggagataaaattttcagtccacgttaagagaacatgcctcaagtcagtcagtctctctctgtttttgaagattgggccttgctatgtcacccatgctggcctaaaagtcctgggttcaagcaatcctcatgcctcagcctccagagtagctgggagtacaagcacataccataccaccttgcctggggtttcttcatgtatttccttttttattatttatttttgtttacttatttgtttgtgtatgcttttttgtttttgtttattttatacataaatatctatgcatttatacatactgtataaaaatacagcatatggcaggttttttggttggatttagtttagataaaacatggccatactattcttaacatgagttctcacctcgtggacccctttccatccaggactatatatccaaagcattgttttttttgttgttgtttgggtttttgttactgttgttgttttttgaggttaggtcttgctctttgacccaggctggagtacagtggtgcaatcatagtcatatctcatcacttcagtctccaactcctgggctgaagcccgagtgatcctcctgcctcagcctcctggctagtttaaaaaaaaaaatttgtagagatgggatctcgctgtgtctctaacttctgggccttctcgctaggcctcccaaagtgctgagattacaggcaagagccactgcacctggccactgaccatactatacttaaacaaattctcacctcatgaacacttttctatccaggtagacttcatcaaaaccgcctccttaagctctaggaaactgataagagcagaactccatatgatctctttcgtgtagagagaggagttcagttagtggtaaataaaaaggggaaggggcctgccctgaagtttcttcttgatatcacccgaaatgctactgggtgggtagatttggaggtacacttagaaaggcagccttcccaccccaccccaccctgagattttgggaagaggtggtagtgagggcacacgtcattatttcacccctttttcttgcctccagtctttgctggtgagggataggagtctcagtgtgaagaacaggttgtggggagaaagtaatgcagagtcttggggcagcagagccctagggtgatagcaaaagaaagaggccaggaagtgagacacagaggagaaagacttcagactgtggcatcagagccacagcacccagctgaatttgtttctttattaaatcattgaacagctgtaaacaaataacaggaactcaggtgccaggcacggtagctcacacctgaaatccagcactttgggaggccgaggcaggtggatcatgaggtcaggagattgagaccatcctggctaacacggtgaaaccctgtctctactaaaaatacaaaaaattagccgggagtggtggcaggcgcctgtggtcccagctactcgggaggctgaggcaggagaatggtgtaaacccagaggcagagcttgcagtgagccgagatttcaccactgcactccagcctgggcgacacagcgagactccatctcaaaaaaaaaaaaaaaaaaaaaaaaaaaatcagggactcgaatctccttggatatcacatatttctattgtaatgcaaataattgccccaacttttgttttatgaactcaaattattcattatattcttagagatgaaagagtaaagggagttgatttactgggacaatccaaaagaaatacaagcttaattatttgatgaccatttctcacctcacttgctcattgtgaaggaaggtgtttcttacattgttgatgcaggctcccttttacttcccttttgtaatcctcaaataaagagctatcttttcttttacagtatggcagttctcaaaagcatggtccacgcacccctggttggtctctgagattccttaagggagtacatgaggcctatattattttcacaaaaatagtttgcttttctcatgtgtagtagtggacataactactggcaccttaatacatatcaagacagtggcaccaaaatacattagtaatcatttaccaatgtgagcattagtaaaaagtgtgcagcagtaaagtgtgcatcctcactcctgcacactttgttaagaaaaaagccaattttgcctaagaatgtttttgataaacaggtaaaaattaacgttatttaacctcagctcttcagtgcaagtcgttttatgattgtgacagaatggggagtgtacataaagctgttctgtagttcttttaaggtatgaagtaaatggctgcttcctttaatccatttttacttgacactcataaactatggttattcagagttggattttggctttttcttgaaaaattgtgagatgtgcctgtcacttcacggaaaatgacagtttttgttccaaataataaaattttaggtttaaggcaaaaattagaatttttgaaaacttgaccaccatgattttgacagtttcccaacagattggtggtgatgttaatgaattttttttttaattgagattgagtgtcactctgtcacccaggctagagttcagtggcttgatcggctcactgcaacctccatctcagctttcccagtagctgggactacgggtgcgagccaccatgccgggctttttttttttttttttttttttaatgtagaggcggggtttccccatgttggccacgctggtctcaaactcctgacctcaagtgatccacccaccttggcctcccatagtgctgggattataggtgtgagccaccactcccagccatattaatgaatttttaaattgcctaatgaaatgggtcaacatttagaagatccacataactcattgaaccattatcttccaaatgaccaatgtattatattccaaaatcatgcatgggtaaaggtctgtatgaaatggaacaatggatttttaaaaatcttttttagtttttactttttattagagaccatgtctcactctgttgccagtggttcgatcatagcctcaaactcctcccagggtcaaacgatcctctctcctcagcctccagagtagctgggactacaggtgtgtgcctccagacccagctaatttttaaacattttgtacagatggggtcttgctttgttgcccaggctggtatcaagctcctggtgtcaagccatcctcctgccttagcctcccaaagtgctgggatagcaggtgtgagccaccacaccaggccaggacaatggattttaatggaacataataggaaagctcattgataaggtttcagattccataatccaagacatctttaataaccaccccttaataagtgttggtgtaatagcagagaagaatatccagttacctgtaaagggtattgaaatattactcctttgaccagctagatgcatgtctctgtgagaccatatttttttcatatactacagccaatacaatatgttacaatagatttaatttgaagcaggtataagaaaccagttgtcttctattaaactagatactaaagagatttgcaaatatgtagatctaaagttttatctttttttctaaatatgtagatttcactaaaatattttaaaaaacatgaattaataaactttttttcttttttaagagatgggggtcttactttgttcttcaggctagagtgcagtgatgccatcacagctcactgcagcctccagctcctgagcttaagtgatcctcctgcctcagcctcctgagtagctggtactacaggcacgcaccaccttgcctgtctaattttctaatttttttgtagagatggggcctcgctttgttgcccaggctggtcttgagctcaagcaatcctcccacctcagcctcccaaagtattgccattataggccttaggcaccgtacctggccccttaccttttttaacttcaaaagtttataacatggtacaaaaccacacaaaagttcttttaggcttgatcgtttttacgtgtgtaaaggtgtcctaaaaccaaagtttaaaaacttctggtcctaataatttaaaattaacattttttggccaggcacagtggctcacgcctgtaattgcagcactttgggaggccgaggagggcggattacttgaggtcagtagttcaagaccagcctggccaatatggtgaaacccaatcattactaagaatacaaaaattagccggctgtggtggagggtggggcacctgtaattccagctcctcaggaagctgaggcaggagaattgcctgaacccaggagggagaggttgcagtgagctgagatcgtgccactgtactccagcctgggggacagagtgagtgaaactgtatctcaaaaaagaaaaaacacctgcaagcttttgtgtcagcctctcctttaaaatgggtcttttatttctgctgtgtattctgtagtgactagcccacgagtaactggttgtatgatgagctggataacataccagccgttcatatagtacctccttgggagactctacccaagtatctttcacaaatgcccaattctctcccaccacaataccagttccaaatgtggtacaagcttatttcaagaaatgtggaaattaaacaaaaattttttaatacaaagatgtaaggcatttataaaattttttaaatacaaagatttaaggcattccaaaaacatagtttttataatacgtgtatataaaaccaggtatagtggcatacgcctgtagtcccagctactcaggaggctaaagcaagagaaggagttgagcccgggaatctaaggctatagtgtatcttgtctgtgaatggtcactgcactccagcctggccaacatagcttgactccatctctaaatacacacacacacacacacagacacacatgagttttcctcatgtgaattgatttttttaataatataacttatttcaatctgtatgttttaaaaattgaatgctgaaaattatgttacccacccagagataagtattttaacattttggatgaatagctatacagatatacacatagatattgtatgaatgggatttgacattacatcctgctctgatacctgctttcattctcagctctagaccttattttttttgtttatcaatagatatataggccaagaccccgtgtgtgtgtgtgtgtgtgtgtgtgtgtgtgtgtgtgtgtgtgtgtgtgaaataccatgtaaccaaagctcttttcattttggaaaacattggcagaaatgatggtcgcttagagagttaaatctctgggtaagtataatgtaatctgtgcaaactcaggtcccttatccttcttttcattctgtgcttcgtgtagccactaggaccctagctatactgagatacagtggaggagcagcagtatctctacttaaacaaaatagtttaattagtggctgaaggtggaggggtgtctttctgtcttttaattaaatagccctcagaaggtcaaggagatcaaactggtcaaacattaacagttctgtgcaggaaattatggtgagttcctgttctaattttctcacttgagtttagcaaacatttgaggggaggtgagagattaaaaagctgaataaggtacagttctgctcttggagtgtttacacatagtagaggaaacaggcctgtaaggagctgccgtgtgtaaggtagagcaagtgttcagttgaagttatagacaatgcttgtgcaactgatgaagccaatcattattcagtgtatgggaaagacctggtggtcttccgcttttagctgaacatgagaaagatttcagttaagtagaaattgtggaaacagatcgacagactgaaggggtgtccagtgtgaggatcaaaaactgaaagtgtagggagaaagaaatcacaaaagagctggagctcatgatccagtgcagctgaagagatgcccagaaggaaacagaaagcagcagcactgggcagggatattgtgccgcatttaggaaatctagataccatttgttctgtgaataggaggaaacttttcaggattcacagaacacatcttaccagcatgctgctttagtcgtctcagaagtagcatgtatggaataggcaaactctgataaaggagtatggagacgtttcttgtgttttttctttgttttgtttaaaacgacttacatttactatgttacacattctgtagggcagaattccaggcacaggttaactggatcctgcttatggtcccacatggctgaaataagtgtgttggctgagttgcaatttcatctgatgtttttccattcccccgtggttgtggtagaatccaggacctcgaggttgtaggcagttagctaggagtatgactttttcattcattcattcattggttatttatttatttatttatttagagacagagtcttgctctgtctcttaggctggagtgcagtggcatgatctcagctcactgcaacctccacctcctgggttcaagtgcttctaatgcctcagcctcccgagtagctgggattacagttgtgcgtcaccacgcccagctattttttttgtatttttagtagagatggggtttcaccatgttggccaggctggtcttgaactcctgacctccagtgatccgcccggccaagcatgacttttttttttttttttttttttttttttctgaaaaggagtatgatttttagctgtcatttaattgaacccccaccacatgccaaatacaggcacatgcatacattatcgttaacccctcctgacctcagtgtaagccagtatgacctacacttgatagatggagcagagagtaagtggaatgctgattacacctcacaccctgagcaggaaaatgatgtttttcaggtgatattgctagtgtcctccacccaaaagcctgaatttagttggaaaggaaaaattttattaaaaagtctctcccttgtgactttgaggaagaaggaggggcatgtttgcaaaagaaacactgctaatgaacgtttccctgttaaatcacaaacatcttaggactcctgtctcatggaatcagtatcttcttggcaggtttacaaagaaaccagtttttaaagccacaatacagaagagattggtgttttccatggcttgggttttatctgcttggagggtatgtgtctaattctctctttccctctcatactggtaaatataccaaaatatagaaagaatagtatgaccaatcccaaaaacgaatcattcatgtttaacagttaccaagatttagccacaactttttgattgcttctttctcctcctcctcagttgtctttttacaattgaattggtcagtccatatattgcattagttatgtcttttaagtgccttttaatctagagcactttctctcaccctacgtgggaggatctctctcttttttttttttttttttttttttttttttttttttttttttggagacggagtctcactgtgttgcccaggctggagtgcagtggtgcgatctcggctcactgcaagctccgccttccaggttcatgccattctcctgcctcagcctcctgagtaactgggactataggcgcccaccactgcgcccggctaatatttttatttttattttttgtatttttagtagagatggagtttaatagagagactattgtctcgatctcctgacctcgtgatctgcccacctcggcctcccaaagtgctgggattacaggcgtgagccaccgcgcctggccggatctctcttttttatgccattggattattgaaaaaagtgccagccttcctgggaaaagattctcctgggtttgtctgttttcttcttttaggtgtccttttgcttgttcttgtgtcccctctatttactgtaaatataaaagcttgatgagatttgcaaggtttggttaaattcagccttgccatttctgggtatgaatacatcataggccatactgtgtactttatatgacatccctttataaaataagtaatttgggggctattccatgcttggtgtaaactaagaggggtttgtggattcaagcctacattgtaaggtccctatcaccttcattttaacgacttcatgtattgatcttttcctcattacttcattagtgactgaaaaatgttgatttttctaattggttgtttaccctgaaatacaggtcatccaaaaaagcaggacaaatgcttaattcttttcctttcagtgcaaattttccgcctaagacattggtgcctggtaatctccattggtgatcactgttttgtggggggttgtttgttgcatcgttgttgttattgtttcccctttccctacttttgagtatcatcgtgaactcgtgttttttagtatattttcaggggtttcagtataccgcagtcattattctttctgatgctcaggggcagggaagggacagtatctttttgatagaaggaaacaccaggactgcctcagtggaccttgttttggaatgtccatcatttgtaggaatgatggagtctcacttcctaatggttcagaaccattagaggtgcttccctaggtgcccaatacgacctatcactgttagagtataatgcatttctttggctatttatctggttaaagcaactcctttatccacagaaaaggaggttgaggtaggaagatccctggagcctaggagttctagtctagcctgggcaacatagtgagatgaacatccacagaaaaacccacttttacagctttgtgagaataaaatttttagaaaggaaatagattttttttttttaattactaagattctttgattaggaactacagtagaacactgggattactagtggctatacgttgttattttcttcccaattgtaaggctttgtcagcagaacatgaaattaagctaaaagtggaaaggtgggacatgtaatagccagaatgttcatcaacaagaaaagaaatttatcttgtaaaaagtgtgtctttgcacgtaagataaacataaaacagactgagcactgatattgactagatgctttaaaataagcagaaggggcagaaagttaaatatttagattagttcaaaatgttagctttatagtagtgtgccattgatggagcattcctggaacatgtcttctctgcttgttttaacacctgaccttggtccctgaaatggaatgtatagacaggaagacagtgatatgggtgggtttgtttaacattttctctttgtttgaataagccctttagttgtttcttaatactgttgaatatttagtggctttctaggaccaagacagtatggttctgtcatgattggtttgggtttattgacgttttccccaaaaggacgggacacacttgaatctgaggttgaatttagttgactttttcgttgtacgtttatgaagaatagatgaactttgtcaacaaagatggtgcctggcagaaagattgaaacgtagtaggctcttggtatgggaatgcttatttccctgcttctctccctcagttagggttattatcgtataaaattattttagattactcatataattgtgagtaacctaaattatatgagtatcatgtgggcataatgtcctccatgttcatccatgttgttgcaaacggtaggatcctctcctctacccccctttttttaggctgggtaatattccaattcatgtatacaccacattttcattgtcatttgccatttagattgcttccatgtcttgtcttttgtaaataatgttacagtgaacatgggagtacagatatttgttaagagggtaaatcttaggttgtgttcttaccacatcctccaaaatcataataaataaagaagatagaatggggggattggagaaatgtcggtcaaaagaaacaaattttcagttaggagaaataagctcaagagatctattgtacattatggtgactgtagttaataacaatgtattgtatatttgaaaattgctaagagagtagattttaagtgttcttatcagaaaaacctaagtgtgtgaagtaatgcttatgttaattaacttgatttaaccattccacagtgtacacgtattccaaacgtcacattgagtcagggccagtggcacaggcctatagtcacagctacttgggaggttgagttaggaagatccctggagcctaggagttctagtccagcttgggcaacatagtgagaccccatctctatttaaaaaaaaaaaaaaaatccagcctgggcaacaagaaagaaactccacctcaaaacaacaacaacaacaacaacaacaacaaaccatgtggctgggtggaggggatcatgccagtgatctcaacatttggagacgccaaggtgggcagattgcttgagcccaggaggtcaagactgcagtaagccatgatggagccactgcactgcagcctgggcaacgcaccaagaccctttctcaaaacacagacacacacatgtaatgttgtacaccataaatatataccatttttaatttgccaatttaaacaatatatgtcaatttttatataatttttaaaaaggataggaggaaacttttggaaatgatggatatatttatgatattgattgtagtgagagtttcataggtatatacttatctccaaactcatgaagttgtagacattaactatgtatagctctttgtatatcagtcatttctcaattaggtgatttttaaaaaataaatacttatgtttctgacaggcaaaaatggcatgacattttagtagtttattaataaagttttttgtcatatacttattaaccatttaatttgagaatggtattttccagttatttgtccatttcttcttttccttattgataggtctatataagaagaataatgctttcttgactagtgtagtttgctttcaggtggatactttcctcattggttgaaggagaagctggtgattctgttctctgttttcctatccctcaaaattaataatatgagcatctccacagctgatggtttctctttaaaataatgatgaattaggctggctgcagtgcttcacgctgtaatcccagcactttgggaggctgaggcaggcagatcacttgaggtcaggagtttgagaccagcctgcccaacatggcaaaaccccatctctactaaaaatacaaaaattagccaggcatggtggtgcgtgcctgtgatccttgctgcttgggaggctgaggcacgagaattgcttgaacccgagaggcggaggttgcagtgagctgagatcgtaccactgcattccagcctgggcaagagagtgaaactgtgtctcaaaaaaaaaaaaaaagtaataatgatgatgaatttcctgttttgttttacctcactgagctgtaatagtaggaatacaatgagataatatactttaaaatgtgttgagtactacataatggcatgttgcaaatacagtccaaggcttaagcagcttcatttggagtatcatttgagtaagattcctctagaaatctagtgtgccagggctttagggtgagcacatgacaggggaagaattcctcaaaattgtaactgtaaagataaatctaaccttgatgctttttcttttcttgatttctgggctcttgcaaagtccataaattgcattatacttaatatagacacattttgtgttctcataactgcattagcatgttaatttctgctgagtgggttagtaatcaaataaccaagtggctagacaagaaaagagactttataagtggattatcttgctttccagtgttaccatttttaatgatggtctactcatttttcctttaactttttgttatggaaaatttcaaacatatctaaaaattgaaggatttttagcataatgttttattgttttaagttgtttgaatcaacattcaatatgttccctctcattctctctcatgttcttgcttgcagtttatttgttgtggaacccagattgtttgtcctgtaatttcttagagtatctctgtgattttgtttagcatgattctgtttctaaattatctgcaagttatcttttatatatattttttatcttgcaagaatacctggtagtgtgtacttcaatcaagaggcacataaggattagtggtctctcattttgtgatgtttacagccattgattatcaggatctaccaattgcccattcctttttatgtttgtttattgtcttttggttatgttaatgtatttcattaaattaaaaaatattttataataatttgccaaacagtgctgtatgaagattataccaatgtacacagccaacagccatgtaccagaatatccaaatttttattttcttattttataggtaactgatgcttaaggagatatgtagttttccccaagattacacagctattcagtacaatactcaggtctatatatgtaaattttgccttaatctcagacataacaccaattttcttctctccttccactacagtcccaggttattacccctcttcattttttgaaaaattatagaaaggcagatataagtagggcaaggtgagatgaaaagaagggaactaagcagttaacataggagggttaaagacccaaatgtgatttccagaacattctgcactttcttctctcatactgattctctagtgcttaaaactatccagccattgataatcattacttagatctactaattcattccctaaccttttgtatttttcaaaataagcatttgatcacattaataactttagaaacttaatttcaaactttatcagtaaaactactttttcgtagccctttaaagaccattattagtactatttataaaaagtaccaaagctgggatcctattggaatattccaagtttagtctatcataccatttttgctagcactttatcagtggatatatttatgaaaaaatttaatctagatgtgtttgatgtgtcattaaaagttatttcaaaaatcattttattgtaaatgtttctcaaacttaagttctcctaaaatagcaatttaacttgatttctggtaaatagttaaagattagcaaagtttttaatgtcataatttttagtagaagttaaatttaggaattagcagtctcctacttcctagttcaaatccaagttaacttttaaaagtctaaaatatactggcctctctcaagacctagacacagatatcaacaaatgccaaaagagatatgcaaacaggaaactatgtgattcttttaacaaatattttaaatcatataatcatttttccacttgacccttctccttcctcctcctccgcaataaaaagaatctacagtaatcctgtagaaactttagaaatctttgtttttcttacccacaactccctatttatatatgttaagtgctacctgatatggcaaacacatgtaaatgatatcctttcaaagttcactggcttcctctctgaagtcatctaaaattcagaagccataaaacaaaccatcagataaaagtgagactttatactgaaatagaaccataagaacatttttttgcagtttctgcaaggaattgtgttacttactcctttcagtgaatcagtaatgacgttttaggtcaggagattggaagctgcttgcgggggaacgtaggtaggtgactctagtacagagaaaggcatttgatgtggcacagccctaggccaggtaggtggcgggtgtcaggacccatgctgtagagctctctgcaggttgcagctcctccagctggccttcctagccctgaccaattactctgaggcttcccagccctaagctgcttctcttgaattctcctctgaatagttatacagtgtgtgaaagaattccttgccactcatgagaaatgtattgatttatttgaaaatatttgatgcacttaaatcccagattagtagcagttatggtaacagatgtccttttgatgaaaagccatttctgatagatgggggatccccatagtgaaatgagaagagcttcacttcctactttgtagagtccaactctttagcacggtgtgcaggcccttcatgatctgcgccccaactccttatccccagattcccagccataaggtctccttcaaagccatgctccaacaatactcagctctgggagtccaaacagagtccatcatgtattcgctttgccttcaggctttttgcttagagagcccaatttctggccataaatttaatccctttacaaattagctgcttgtccttcagaagtcaccttaaccatctctttcttcataaagcttgcctggctctccaaatgtaggttaattgctctaccgtgttggttactgctgtagagctgtgtttattcaggctgcggcattgatactgactacatttatgtaggaccattggtggaaggcaagttccccaaagtgaaaacaatccactgagataaattttctaaccgcaattttattttactgaaggctgggaagccctcaggttgcttcttgaagcacacacagcctggagaaaagcaattctgaacgtatgtggctaccccttgatttagatgaattacattccagtcaaaaggaagaacagatttgaaaatttaatggcaagactgacttcattcaggaaatcataactaattttaccaagctaggggtgagttgatggtgtgcaataaatttgggaagaaggaagaaggaaatgggaatgctagattacagttaatagttttctttaattcaaaaggtattgggaggtattgcagatctggaagaaggagaattacattatcagaaagaactcagcaacagattttaaaggagatgtggctttgtcttaggtattttctcatctaaaaaaattaagagaatgattaaaaatgcatcaccaaaagtgccagggtgatgattcagatagcgctctgtagctccatcctaaaaagggcatgctagcctgttcttctgatacatacttacaaaactttcccagttctctctccacctctatttatttccagcaccatttgcccctttggacctgattctcatctaaagatactctgttgtgggaagtaaatacatcctgagaaaaatcactttctggcaaaaccttgaagtgagttactgtaaaccctcagacacgctactcattctatatttgtagcaggatcagaggaattaacagatgaaatggccctggaagctggtgtgagcatccacaccccaggccttcctctcgtccctaatcacacagctaccctgggaaaccttttctggggtctcccagcctcactctgggtggagtttgttctttcctcaactgccagctccccaggtctctgaattaaattttgcattctcatctcttttcataaattctctttgaagatccagagacaactcttccaacagtttctattccctctgagacatttgtaactaccatctcgtcacccactagctggcctacaaccgttggttacatacacagcccagtcttttcataatttaccatccaagccccacactgtgtgtgctgtgggcttcatgatccatttaccagactattcccagccccagcatcctgtgctgggcctcagcacagtgtgagaaaaggaaaacttggaggggatccagcatgaaaaaaatgaaagattggaaagaggagtgtctgtgagaaaaggatggagaagctgggtaggtttagctcttgagaagagatggagaatgagacatatgttgagagattacagtcagcagtcccttttcttgtttcactttctccatggttataatatccttaaagataggtttaaaatgggccaggcatggtggctcacgcctgtagtcccagcacttcgggaagccaaggcgggtggatcacctgaggtcagaagttcaagaccagcctggtcaacatggtgaaaccccgtctctactaatatacaaaaattagccgggcgtggtggcgggcgcctgtaatcccagctactcaagaggctgaggcaggagaatcgcttgaacccgggaggcagaggttgcagtgagccgagatcgcgccattgcgctccagcctgggcaacaagagcgaaactttattccaaaaaaaaaaaaaaaagataggtttaaaatggtaatccttgtttagtggtggattgtgtgtgtgggggatgtcacattgctttcggagaggtactaaggtgctcaagcagtctctgcaataggatttggttccctgtcttttctatcccttgtctgatcagccctgaaattttactggtacagagactggagaaagaggggtgggtggacaggacatgtaggatgggggaaactcctgcaagtatgtttgccttatgggctccagatggggagccgggacatacctgtgaccatggtgggtcattaggtcttaacatagttctgggaactggtgaaacctgaggtcattagatagtgcatgtttgacctttgggcatctttaggaatgagaaattcaataatgaggatgatagcagctgttactcattcaagacatttctgttaaacacgttatattcattatctcattcaatcttcacaacaccctgttacataaatatagtcattatcctcattttacaaagaaggaattaagctcagagttttttaaatgtgcccatggtcacatttggtaagctgctcatctgaggttttaagccaagtctgtcaggtcacagaccccaaggtgggggttttttggtttgttttttggtttgttttagcagcgttattgagctgtaattcacataccatacaatttaaagcatacaactcagtatttttttttggtatgttattaatttttaaaaattgtggtaggcccagcacagtggctcatgcctgtaatcccagcgcttttgggggccgaggtgggtggatcacttgaggttaggagttcgagaccagcctggctaacatggtaaagcccacgtctctaccaaaaaaaaattaaaaattagccaagtgtggtggcatgcccctgtggtcccaactactcaggaggctgagcgggaaaatcgctggaacccaggaggcagaggtcacaatgagccaagattgcgccactgcatccagcctgggcaacagcgagattctgtctcaaggaaaaaaaaaaaattgtggtaaaatatatatgacataaacctgccattttttttagtgtacaattcagtgacatcaattatattcacagtgttttgcatccatcaccactatctatttccaaaactttttcatcaccttaaaaactctaactgcatgcctgtaatcccagctactcgggagactgaggcaggagaatcgcttgaacctgggaggcggaggttgcagtgagctgagatggtgccattgcactccagcctgagcaacaagagcaaaactccacctaaaaaaaaagaaaagacaaaacaaaacaaaaaaacaactctaaccattaagctgtaactccccattccctcctttccttgtcacctggtagctgaaaatctactttctttctgtctctgttaatttgcctcctctagagacatcatataagtggagtcatacaatatttgtccttttgtgtctggcttctttcccttagcgtaatgtcatcaaggttcatccatgttgtagcatatattagaacttcatcctttttttttttttttggtgagatggagatttactcttgttgcccaggctggagtgcaatggcatgatctcggctcaccgcatcctttgctttccaggttcaagcgattctgctgcctcagtctcccgaatagctgggattgcaggcatgtgtcaccacgcctggccaattttgtatttttttactagagacagggtttcaccgtgttgcccaggttgatctcgaactcctgacctcaggtaatccgcccacctcggcctcccaaagtgctgggattacaggcgtgagccaccgcacccggccagaacttcatccctttttgtggctgaatgatgacccattgtatggatatagtacatctggtttatccattcatttgttgatggacacttgagttgtttccaccatttgcctattgtacagagcccaagttttaactggaatgtatattacaacacaagctgagaaccaccccaggatgagatctcctgatttcaagcttgggcatcacaccatgttgcagagaactggtagcctcagtattgagagtgaggctgacctgagttttgaaatacaagtctatcacattagttgtgggacgtgggtcaagttatttaacttctcagactctgggtttctcagtctccactatccagacaggtaatcacaacaacacggttgaatatgtgttctgtcatgggaagttttctttttttcttttcttttttgagatggagtttcgctcttgttgcccaggctggagtgcagtggtgcgatctcagctcactgcaccatccgcttcctgggttcaaacgattcttctgcctcagcctctcgagtagctgggattacaggcacgtgccaccacacccagctaattttgtatttttagtagagacggggtttctccaggttggtcaggttggtctcgaactcccgacctcaggtgatccgcctgcctcggcctcccaaaatgctgggattacaggcgtgagccaccacgcctggccattcatgggaagttttcttaaaccctttatcttttcaattatgacaacctatgagaataggtactactactactattcctcctcctcctcctcttttgatgaggaaatttgcccgaggtcacatagatggtaagtgaccagggacttcaaacctagatctacctaccaaaacattataccaatccctcatgcaaaccgtatgtataagtatgggcttgtattatatatatatattttttcacttgtttatgcaactttttccatctttatagacaggtcttttacgttactattttcggtggctataatagtggaccattttatagttattgaactagctcttagatttgaacattaaggtatttcccgtcccctaattaaaaaaaaaactttatatgaccatcttcttaatacttaaccagcagtcggttctagatttgtaggggaccttgcctgcactgggatggcttggacaccttcattctaaaatgttctgaagctttagggagggaagaaaccccagaaactccttggttcctgtgttggattacccaccaaagatctgaagtcatgccagagccaaccagccttctgctgaccctcatgcccagatttccttgattttgcatcattgcaactgaaaaaagatttcagactgacaggcaaccttttagtgttggaaggtaatctgttcatcccagaccagtgatcctcatgagatagaattacttactattccccagaaagaagcagctcagttagtctaaactcttgcagttttcttttggtatttcagtgcttctaactaggttaggataccctgttctcatatatgaactctgcaagaatgagtacaattttcaggaatgagagggcaggaggggggagttatttacattagcatttgccaagttttcactgtttatcttaccggaaagtcaacagtgtgactattaacctcctgcataattaaaatttgggccttgttatggttgttcttaaacttgtggttaaatctttgtgatttttagaaggcaaagagatggagagtaaaaggaagataaaatatggctattcaggggactgaggtacatggacacctggagctgcttgttgtaaattggcaggttcattgcagccggtggaatgaatgataagggaattgtgtaggtcagagtctcccaaggtacttagccagttttgtttaataaagttaagtagatttttttgagcagatcacatttccctggtgaagctggagggctgtgagatttcttttaaagaaagtcttctgctcttaaatgaagagcattgttcttattttaaaaataagtacatgaacaccaatataattaacaaagctctatcttctagtgatcattaatttaatcttagtacaaaagagctgaacaatatgtctgaggcacgaagaatgaggaagaaacagttaaacatgagaagtggctgagggcatacattccaaagcaccactccctgccacctccctctggtaggtaatgaccccagatcatctgatgaatcaagggattgtttttgtactgaggatggatttcctatagcagagacaacattatttatacccccagattgtattccttaccttttttcctatattaatgtcagttactaatgttactgttgtttgacactgtgcagtaactatatgcatgtcaaattcgcattcagtttttataatgaactaggtgttagtttttatttttatctgttgcatcggaggctggcagagattaggtaagttatccaatgttgcacagctggtaacatttacaactaaaggacttaaaggggagaaacaccggtttgactttcaggtgaagcttattgagtcacctttcaccaccatacgcatacattctggaattaccccatctataatactgatacgaggaagtcatttgttcttttcttgtccatacccttttcagtgaccatctcctcaccctccaaagagttcccaggtcttcggacacttttcagatgacataccacatcttcctaataacctgccactgtaaaataaggagttccatttccaaatggtttctagtacattccgctacccactcccaccgaggaccaccaggatacattcagttaaacaggaattacctgtagataatcagcattactgcctgaaatctgggctggaaacataaatgatgatgatactcaaccagagtttgcctcacagcaggtgctcagtgtttgttgaagacaaacagttgttaaccaagatgaatttaaatgtgagagtagccctgaccaaattgacatttttggatcttgtgggctttattcatgctggtcataacttcatttaagaattagcctcattttattttttgtaactggagactgcccagttattcatccattttgtggcctcatggcttaacactctcagaaaacattttttattcactgcgatcatggagtatgcagggggattatccttcagtggcaacgtggaacctagcctgcctctgaaagcaagggaggtgaaggaaagcaactctcaggcaacagcagatgtttccagaagtggggttttgttttgcactgaaaatttaatccaagggcaccagatttttaaaacatgaatgaatcaaaataggagagtttggaaaaggagggcacttttgagatgtccacactttgttgctagcagctttgttacctgtggagagacggttctgggtccatgggtggctttgctcctgtaggtttttcttgtttcacagtaattggcagtaaaagacttttcatattcaagtgtgattgatctagcctggcttaaagagatgatcaaattccttggcacacagaaatgtttagcagccttcttcatatccattgccattgtggtgcctgataaatctggtgctagtgaataagtactcattactcaaagaagtgtagaacagatcctgtggaatttcttttcaggactagtaacagtataatttttgcttgtacacaaatcaggttttttccccccaccagaatgccaggttaaattatttcaagtctataaaaattgtttgttttggccaggcatggtggctcacgcctataatcccagcactttaggaggcctaggtgggtgaatcacgaggtcaggagttcgagaccagcctggcctacatgattgaaaccccgtctctactaaaaatataaaaaattagctgggtgtggtggtgggcgcctgtaatcccagctactcgggatgctgaggcaggaaaattgcttgaacctgggaggcggaggttgcagtgagccgaaattgcgccactgactccagcccgggtgacagcacgagactctcaaaaaaaaaaaaaattgtttttgtactctgacttctgaaaaacacagaaactcagtttggaggcagtgatgccttgtcaggaatgtagactctggaaacagattctttagatttgtatccctctacctataagctgtatgaccttggacaagtcactaaaactctccaagcatcaatttcttcatctgtaaaatggaaatactagtatctagctcaaaggactaaggggagattgagactttatgcttgtgaaggatactatacacgtaagcacaaaataaatacttgttctggtttctagggatacattaacataattttaaaataggatttcagtcgttgatgtttttaacattccctgtggatagatcaagggcaagtagcccacggctagccagcatagatggggaaccagaagaacgggggtggtggagttgctgagttcctagagcaggagaaggccatgggtgagagtgggagctcagttcagacacacagcttcattctggaattcctcacgtggctcacagaagagtttgcttatgtgtgtgtctagatttatgttatttgtgctatgaagtatattttggggttctgattcatcagtttcctaggtcagtggcaatctctttaaaactgataactactttgggaggccgaggcgggtggatcatgaggtcaggagatcgagaccatcctggctaacaaggtgaaaccccgtctctactaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaactgataactatgacaagttagtagtttccaccttttttcgtcaaggactggaacctttgcagatttaagaaaactgacattttcttaaaagtcaaggaaatgtgctaaactgtaaatcattgggtggattacataattctgaagtttatatcctcttgctagttttaagttagttgtaggcactttgtaatatcgttaattttaactaacttttcttgaatatgttctgtgtgccagacatatgtgctaaggataggagataacagttttgtgaaggacatagacacagaaaaagaaaatttttcgtataagcagtaggtgcagtgttcagggtacacatagcctgttttgggaggtgtaagaaaggatatctggtctttactggattttcaagagtgctccatgccttgatgaagactcttttaggcagcacctgtcccaactaagagtccctgctaagaaatggaaagttcattagatcagcttcattaattatcaaagaaatctacattaaaataatagactttaataacatttctttagatatagggtgtcactatgtttgcctaggctggccttgaactcctggcttcaggtgatcctcccacctcagcctctgtagtagctgggattacaagcatgtgccctgttctgtttttaaggatgattcccagtgttgttacattaaaatttggtacaaatgttgctactttggggattatacattcaaacagcacagttaggtgtattgagatccttaaaaatgttcatttctgaaagcttggcaaggttatctggaaggctgaggagagaggatcacatgggctcaggagttgaagttgtagtgcacattgatgatcacacctgtgaacagctgctgcactccagcctgggcaacatagtgagaccttgtctctaaaataaatcaataaataatgaatgaatgaatgtctgctatgtaacatgcgctatgctaggtactggagatacagcagtaagcacaacagacacaggccctgcactcagggaccttatagttcaataagagatcatctctctcttttttttttttttttgagatggagtttcactcttgttgcccaggctggagtgcaatggcacgatctcggctcaccgcaacctccgcctcccaggttcaagccattctcctgcctcagcctccctagtagctaggattataggcatgtgccaccacgcccagctaattttgtagttttagtggagacggggtttctccatgttggccaggctggtctcgaactcccgacctcaggtgatccgcccgcctcggcctcccaaagtgctgggactataagcgtgagccaccgcgcctggcgagatcatctctttttatggactagatagagatgtacccaagcagcaatttcaatttcattgaaaagacacctctgcctccccttgctgtcataaccatccttctcccttgctccctttcctccctcaccaaataacagatgtatgccagaagaggtgtgtgagtgacaaatgaaagttatactaaaacactgtttttgtttgtttataaattttttatttttaaaaaattaatttccacctgaatcatagattcaagttgccctgaagatatacttcctgaaacactttttttatgttagaagaaatttattttccttccttttctactctttctcctttgtggacctcctttgtggcgggcacagtagtgaatctaacagaacagtatgctgctctcatgaagcttacccaggtctctagcagagtgggactgagcagattttcttatgttgttcatagatgtaaaaccattacgttttgaaaatacagctcctgttaaacatccagacttgattgcagttgtcaaaatccaggctcgcagagaggctggcagacacttggaatattctgctaatgccagggaatagactttcctggggaaactctgggtaaccctcatcccagcagctgcaggtcataggaaggaggaggaatgaaaatgtccccatgtgatgagtaagagtaggtaatagtagtggcttaagttcccagaggaacagttttcttcccactcatgctcagggttcccttcaactctgattagaaagcagatccttttaaaatcctggattgcatcgcatgatttcttagcctcgaagaagtgggcagcaaaggaagaagacaaccatcaaagcagtgactggtcagaacagcagaaaatcattaaatggaaaagtgactctgggccagttgaatcatgaccagcttgcttttggaatttccttggcatatttattttggggtctgcttgcttttttgcagaaaacttgttgcttctgcagtttgtatcagagaaatagtggagtggggagacggtggaagttaaagtcagtctggctgagaacccgcatttgggtaatagaagtagggatgggaatgagaaagacatagagaatatgtctttacatagagaatatgtctttatcatcagtaggtggagctaatgaacatggagagaggcagtgaagtgcagaagtgaagggtctggactcatgatcttgattgattcacatcctggctctgtgagagtcgttgggctggatatttaacctcgctgtgtctcagctttctcataaggtaaaaggggctcctgctaatgtctcccatgaggatgattggtgcacagaatgtggtcagtaaacacgagctcctactgttgttactactgctatcatcactgtagttatctttgtcatctttattgttactaggacttagcaattgtttggacatgggaagtgatggaggcttctagcctgagtaaaagggataaaggaaagtattggaggtaagaagaggaattggtttatgagtgacagtaagttcacttctccatgagttgagtttgatgagtttagggtgtttacattggagtagaaatcaatgctataggtttatgagtcatcctaaatagaattagtagttgaagcaatggaaatgaccaaggtccatgatagagagaaaatagaaatagtggagagccaagccgagacttgatttctcctcatgactgcagcacgtagtacagttggttccctgtacagaacacaaaaaccgccatggtaattagtgctgggtggtggaaaacacctcctttgagctattcacccaatctttttttttttggagacagagtctcgctctgtcgcccaggctggagtgcagtggtgcgatcttggcacactgcagcctctgcctcccaggttcaagcagttctcctgcctcagcctcccaagtagctgggactacaggtgcccaccattacacctggctaatttttgtatctttagtagagacggggttctcaccatgtgggccaggctgatcttgaactcctgacctcaagtaatccacccgcttcggcctcccaaagtgctgggattacaggcatgaggcaccgcgcccggcaacaatcttttcattagcttctttcataaacatcttcatctacatttgtcttcttgggaagccagtgaatgggtttgacattctatgggaactgtattagttccctagggctgccacaacagattaccagaaactgagtggcttcaatggacagaaatctgaaatcacggtgtcagcagtgttggatcctctggaggctctgaggcattcctctgcttgtagagataccattccagtccctgcctttgtctcaagattcctaaatcaatctgcaaagaccctgtttccaaaaacagttatgtactggggttgcaggtggattttgatttggggaaatgccattcaccctatcacaggagctagtgtgcactgccctgcaccacgggagctggcgtgggctacattcttagtcctgatggcggaagagcatgtctgaataggctagtccttaaaagagtgggcctgtatggctgatttttgaagggcttaacaggcatggatcagctacttgctgaggtatgtgagtgggagttgattgctaacagaatccttgatttatttttcttgtttcaaaatttatattattcctattaaaaatggaatttttcatcatgtttggattttctgtgtcatggctgctgtttttcctggccaaattcttcatctacgaggcaagctctcctggaagactctgtccctgagtttcttatagcaagttgagtatgctaaaagccagacataaagaccacctgctttccaggggacttgtcatcaccagcagcagtgggggcatcacccaccccagggaggaaaggatggtgtatagaagggaccccaaactatgagacaagaggcatgagttctggtcttagttcagacattataagttatctgtgagaccttagatagatcttggtgcctttatgtgcttatttctctcccacccagaattaatcctcagtctggctatttcttcacctgaaggcaggatggaagtatattttttcgtcattcattttctcaagtataaagcaaatggttgatttttttttttaatcttttttttaaaaaatcttttcttttttttttgagacagagtctcgctctgtcgcccaggctggagtgcagtggtgtgatcttggctcactgcaatctgcacctcccaggttcaagcaattcttgtgcctcagcctcccaattagctgggattataggcgtgcaccaccacactcagctcagttttttatttttagtagagatggagttttcccatgttggccaagctggtctcgaactccagacctcaagtgatccacccacctccgcctcccaaagtgctgggattacaggcgtaaaccactgcatctggcccaaatggttgatttcttgatattgtcttataatatggtggtagacactggtgagcaagaataagagtgagcttgccgtccaggaggtaactgctgtgactggggaggtgcaggatgtggtggagcacagagaaagcagtcttctagactagcagtgcgagaccaggcccctccctgcccccagaagaggcatctaagcagagcacactgaggagttaagctgggtggaaggagtaagtaactgatgagtaagagttaagccaggcaagaggagggggagaagggtgcctctggcagagggagcagtgtgtgggcgagaggcaggcatagtcatgcaatggaagtgactgatcccagaccatgagggagaaccagatgagaatcagggctggagaggaggatgagggccagatcatttggggtcttataggccattacatggagtttgggcagtatccacagagcaagaggaagtcatagaagggttttaagcgggagtgacatgactgaattaagagacagggtcttactctgttgccctggctagaagtgtagtggcacagtcagagcgcactgcaacctcaaataagtcctaggttcgagtgaacctcccaccttagcctcccgagtagttggaactaaaggcatgcaccgccaggcctggctaatatatatttttttaagatacggggtctcgctatgttgcccaagcttgtctcaaatcctgggtccaagcgatcttcttcctcctgcttctgcctcccagagcactgggatcacaggtgtgagccactgcacgcagccaaactgtgtatttttaaagttgtcttgacttgagtgtggaagccgggagggcttttaggaggccttttcagtaatccagtagtgttggtgaagatcaaactggatcatgggatagattcaccaggaccttgatgaaagaatgaatgagagggaggatggggtgaccaccaggtctgtggcttgggcagctgagtggaaggtagcatcttgctgaaatctggagccaacgaggacaggtcattgagggagcatgtttagttttgagtatgtcgagcatgaagttgctatggaatatttccaaatagatgttttcaggaggcaaaaaagttcttaaaccttgtgttaccaactaaactcagagatacatggccatacttaagtccattaaagattctccttgttcttccatctctcagttgtttctaagagtcattcatgtttatctctctttcaatgtgaccgtagactgtaagcttcacctttctgcatctgtttcctcatctaaaacgaaaaggcagaagatgatcttcccaagctctgtaggcttaaaccttcatcagacgctctgcagttctttcgtttcaaagggattacagggtggagttggaagtttccagtccttgtttttcagaatccaatttgagctcttctggttgcatattctcatgctaagaaaaaaagcctattcagatgtatattgtgagccctcaacaacattatcctcagaaggtgcaaaaaagaaaagatgtagccagattggtgcaatgggaaaggatttgccctgcctctcaggagggatggattaggcccagacaaaaaagccctggcctcttgatctgccctctttctgcttactggggcctggctcactctgggtggtcaagagcctcttttgtcaagaggaatctcaccccctccctaaactccaattcatcccagtgggccttgggcagcaatctttgtcttcttttttcagccttccatcctgtaaagtttgagcaggatgggcagtgactcaggaaggtgaaacccatcagggccttgcctgctccttcagtggggagtccttgtgaagggcttgtgctgtggaaaaccagtctctctagcttttgtaattttctcaagcaacgaaaaagcaaacaaacgcaaaaagcttattctgctttaatacccatttccgtcaaaggagtgtatgtgtgtgttaggagagtgctcaggctcatactggaaagttaggtgttggtgaggactgcttcaggtgcgatcctgacctggtcagaccacgtatcttttgatgtttatggtaattccacattccttcatgatgggagaagggagacggagatgataagatgtatcaagggatttatcaagtgtaagttcacctttatctcttttaggcttctgcctcactaatacgttactactactcagcaattttgagtttaggggatttcagaccaaatcctcttttctgctgggctgggttttgtgcaaatatcaatggtgaattgtctctaagcatcagtaaagaactaatgggaagtaatgcttcaggataaaaacagagaaaagtctgggaaacataaattccagcagtcaggctgacactgaaatctgattccagcttatctctgttgcttatctctttaggatcagatatcttaaaggacatactcatttcatttttaaaagtttctaaaggaaggacctactgatcaggtaaccacctctacccaccccaccccagttagccaggaagataaggaaggaccactgacaggctgcaggccaaacacgttccccctgagggctctgccatttggaatcagttgtatgtatcagttttatggtcttctgctatcacagtgggaacagacaagcatgggccacagtgtactgaggatttaaaagactcagaatgtcttaaaatagcctggtcgctaaacaacaataatagtttggcattcctgagaatggttgtttgtttaaaattcaaggcattggttctggtagcagttagtttccactagctgggctcccacgtgagttactctggaaatcacatggtctcatcacaacaggaagcacagggatctattaagcccctcccagcccctctgagggtggtccctaagccttgggctacaggcacctacacaccctagaacacagtagatgctgtggacctgatcattttaaggactctggtgttgttgctttcaccctgactaataatgatcagtccactcttaggggcttatttctcccacctagatgcacaggcagtctgtctttctatcaccaagtcctgaggaggtagtttttactgccttgttgagaggagaagggagtcaggaaggccaaccagcaacagtatgttaaaccacattgttggggtcccatcatatctgaaaatgggtacaaactgccctctgaacgtatcatcagcagtcagctcctgactccctaccatcctgagagaagctcgtgccatgcaagctggctgtggggaagcctcacacaggttctgctactttctggtttcgccatagagcagtcccacatcacaccgagcaaagcagttttctgttgctagccccctttctgtattgaagagtttcgggggatgggaaggatgcagagacactgggcctggaatggctccttagatggtaggaaggaataaagtgactctgttgaccttgcactgtagactcagggaaagtactgaatggcagagttactaatgacttctatcaaatcaccttttgctgactcccgtgttagtcctggatagcgtccttggcacacttgatttcagattttgacaggtgataaaagcacatattgagattgctgcttcacagggcccagattccttgctattgactgatgttatttttgcctttcctgagaagctccctcatgtgtttgctgttacttttaatggattgcttcctgatacatgggaggcccaggcacttgcccttcaatctggccaactgcagcctgacctgggtggaattggagctgcctgaggaacacttagaccaggcacttggcaatatgactcacttttttcccctaaaagttagtctgtaaagagcaactggaaatgttcctgtttacatctttgtggagtgtaattttaatcaggattctcaaggtttttcacttcaattctctgaatttttaagatcttaaatgccctgtggtcacagtatttggccctgtacttctgagggctacgtggaaaatgcttgatgatcattactgacttgtcaatagtaattatgccaataaacagaaaagtcttccagttctggtctgttgaggccctgccgttaagccatggttttcccaaaggctctgcagtgggttctcatgggatgtctttcattggttctttctctcccttttcctcagagggtcgcatttcctgttttgtgcaggaaattcccactgttttgggttccccagctacagtcggaaagacatcagagtgttcaaggcggagtccaggcctgagatctcagcaggccagacaggcagcagatgcttgttgcttttcttgtgttatatttttcgttcccttacttagcatttgtgggaccaaagccaacaaacaacaggttgttaaaagaatgagagtaatttgacttccgacagtgattggggctcggggttgttgggtgttttgttttctgatttgaaactagctgtatggtaaccactaactctcgccttattcttttcttgcagatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaagtacgtacgtaggtttcatttgtctttctgcatgtgtaattcagcctttaaattttaaatttttaaaaattattaggctggacaggcagagttttcgtttgcctgttttgctcagtgtttgtttacaaggctgggtgaaataaacagcttcccagaaaacctccttctgacttaaaactcttttatgttgtacagaattccctgtcttgataaagaccacctagaagcagcccccagcgagggttcttgaaagtcatggggtcgagattgttgttggctgaacatcttttaattctgagttaccaacacgttgtgcgtgcattgatgacccggcttcctggcctgcccttggtgcctgagccccagtaatgattgccctctatgttgggagaagaagggagaaagtagtacaagtagtgaagaaaaaaatgtaggtggtgttggtggttgagagtacatggcacagaaaataaaggagccaggattacctgtgcctttggcttctccttcccctgctgctttttcttcctttttccatgtcagtgcttgggaaccctcacaactggcaggtaacggggtcgggataaaatgtaaacctgtgggtgtcttctgctgagtcattaggatctttgtagcaggctgcggataaatatgtggatgacatggggcaactaagagccccttttgcttgccacctcccacccctgctctggatggtgtctcctcttgctagactgccgggtacagatcacgtggcaattaaggcaaatgttaataaataccatgaaacagtggtttgcatagtcttctgaatagccatggctttggttagtcagcaacaaagcctttcacccttaccctggataatcaagagttgacaacagccagaaagtactgggaatagtggcttttggccatgacatctgctcattcttcattcatgtaatgggtcaaatcagaagtaattctggagatacggtatggtaagagaagggcctaaagagtctcaagagattagaaagcatatgccattgtaaggaaggatggggagagacagtgccaagattaaatggactcagccatttgacttaatgggatgcactgcccatggtggcaccctcccctgggagttcttccttgatcttgagactttcccaaactggaatccacttagctctgccacatcggtcccagatttggtgggactctcctctggtatcagttttcaacgccacttcttgtttggagtcattcccagtgcagtcatggactctatgaacaaatacggttatttaaatgtatttgtccagtatgagaatcagaatgaactagtagaggctttacagatcagctggtctgacccattttacagatgaggaaacaggcctgagaagatggagggagttacccacaatctgaaggggctctaccatgactagacccaggtcacctgcctcccaggcctggctctttccactccgaggtgctggctcaccacagacttattctttaatggaattttggaaaggcctcactccagtgactctttggatctttcttctctaagtagatgggaagcctgtaagaagagacttggaggcaaagcaaagggaatcagcacttaaccctcacccaaagggcccaagagaatctttagtaactggaggcagagcagactggagcctctacggggcatctccccatattggagaattcagtctttgttttggaaatcttataatgtctttggagaggctttaaataattttgtttttcttagcaatgttatgctctattttgagacatggattttttttttcttctagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaactcaagtagactgcagcgttttgttttcatggtgatgcaattttggagcaaaggtgttactctctgactgaggttttgggagaattgggcctgtgacaccaagtctattttacatagaaggactcagaacgagcttcctggagaggccaggtcctggagccgaggccacactgctgctgcttgtctctccctgggctcccagaagagccaccaagagctgcatgttggaagcgtctcatccaccaggagacctcacttcagcagggatgctgcgtctagctaggggagcccctgtgaaacgtgtgggtgcagtgtgcagtctgcccaccgggatccacaggaaggaagaccaggagacaaagtgtcattgaaaagaagttgagtcacatttctagctctgccccggcttcagctgtggtctggtaccccttcagatttcccagctctaaagtaaggatacttatttgccatcagatcccgttttttagaaattattggataaggtaataggactgaaagcctcagtactgacttaatgtttagagatcaaagagcgaccctgtgcagcagacatcggattgctaagaagatcattaacatttttaaaagtgatcatccagtttactttcaaggtcattggtatttgaaatgtgttaattaggagaggaaactttcatctgttgctttcaaaaagcttatacactgaagagagcacacagctgttctgtcacctcacattcacacacttccgcctcttaggtttgagctcatgttctgctttcagtcttgttgtgatgggcagagagaaagtcgttaaagtatactgtccttaccacattctcgaaacacaccatacaccctgtacttcaggcagagtcacagtgtggggccagaagcttctgtaggtaagtaggactgagagagaaagtcctggttacctaattccttttcagaggcctcatttgtccagagtaacagcagttctatcggatttctaatagggctgctgtacagcttacctggacataaaccaaaggttttaaaattataacagactgcctgaggacaaggcatgcgtgtcccttgggatggctctgtgacacactggaaaaattttaaaggttaaacccaaaataaatacagaagtggaccatgggaagagagacataggctaaccaggaagggagctcacagaggagtagatgggcctgggagtagtgggtggactacctgaactgcagggctgtccccacctcccctgtatctgagcagttgctcatcagcagggtgggacttctgaaaactagatttaaaaaaaagcaaatcgtattaagcatctgcatcactatgccctgtaggaaataactgagaaaaaagacacaaggacttctgctttggtgtcgggtatgttttgaatacatagagtgttggggggtgtctcgagggcagtgctgggtatggacctcagtgcgcacacagctccttaggagtcgcccagcagcgagacagctgtggatcccctccaggcgcatgggaggctcacaaggcaaggactctgatggttttggcttccacctcctgtacggtggccagtgctgtgagggtggttggtcccacagggaaacctgtgaacagagtcatgtctggggccccagggacatggcttcaacccctcacctggcagtcctgcctcccaaaagtaaggcaggagtccggagattcccattgcttgcttctgtgaatctcaggtcactttagcacttgacccctgaccccagactgccttgtccttgaggcctgggattcctaaggtatatactgtctgctccagagctgtggctgtggctatccggaaaacgacagctttgaaggactgcagagcttgcctttggggctgttctgcccaaggccttccattgttttcagacataaatgaaattgttaatcctctgacatttaccttttcctctcaacctgcagctctgtgaaggtcagactgtgaggagaagccaccccttgagcgctccgtctcctgatagtgccagcctggcctggtttcctgtttggtgaggctttctaggagcacctggcttagctctcacaggaggaggggcggacggggaggccaggcctcatgctcacagcgccagcctcctgtgagagtgggctgggtctcctttcctttcccaggcccttcctggaggcgatttctttctttctttctttctttccttttcttttcttttcttttcttctctctctctctctctctctctcccctctctcctctctctctctctctctctcttttctttcttttctttcttttctttcttcttttttttttctgaggcagagtctcgctctgtcgcccaggctggagtgcagtggtgtgatctcggctcactgcaagctccgcctcccgggttcatgccattctcctgcctcagcctcccaagtagctgggactacaggcgcctgtcaccacgcctggctcattttttgtatttttagtagagacggggtttcactgtgttagccaggatggtctcgatctcatgaccttatgatctgcccgccttggcctcccaaagtgctgggattacaagcgcctgggggcgatttctatgcctgcctcctgatgcagggcctgtgctctgagctgcgcctttcaggagagctctgcggggcttcatttcctttctaagctcatggcaagaaatgtagggtggaaaagacaggctctggaactccctggccacacaggagctctgccatttacacgctgtgcgacctcaattgagcaagtttcttaacctctctgggcttcaggaaaagggccaataatccttcacataaacacttaagagaatgcccggcatattagaagggcttcatgtttgctttaaaggtagcccttcccaaggatcttttaaggggcacttgaattttcagtaaggagaaggaagcccaggactaagcctaagctacccacaaggccgtgacagttaagacacaggatggccagcacatgtggatgacactaacaggggctgctagagacctcacggctggagccaaatggaagactggaaagcatgaatgaatgacgggagtaagatgaggcattgcagtgagagcaccacccacagcaccgattgacagcacctgccctgctcctggcagtgtgatcttcacagcttacgccagcactgggagagcttatccaaaagaggggcctccccaaaccaggctggacacggccaccggaacccccttctgacaggaaatacatccggggtggagggggctgggcagctgaatcccagcgacggaatggcccttgccctcacgagttactttacacaaacccgctgtccctgacctttccagctgcagccttatctcactttcctatcggagaaactggagaaagaatcacaggtcacccagcccattcctccctggactttctggcactttcttcccacagtccttctgctagtattctcctcagcctcatttccaggcaatggagttacagcttgtacttggggatattgctctcttcacagttctgccaggaaacccgagaatctgcccccggccaggcagatgctctctccctggtgaccctctccacctcttccgtcatttgcagtgagagagacatcagcattttgtccttcaccctctttagaagcagtcctccaaaaccatccgtccagggtgttagggagacgtgttcttttgtccagaactgctgctgctactgaggcccaggcctctccatgttgggcagttttaggaggaaatgccgttcagaaaccagagtcggtcccctagtgtatggctgtgtggctttggccagggtcactcaccccaaggagacttccgtagaaatcacagtattattcaggattgccagaacatctcaacgtgggcctcctcctgactgggggcaccattactctccattactccattactctccatttggtacactgttttccaggtttctaagtgtgttccatgttgtcctttgcggaaggttaaactccccagatcctacgcgccttctcccctgtccttaatagtagtaagagcccaaccctgagtcccaacaagtcgcacctggaagtgccgtctgcgctcggctcttccctgggattaacaaccgcgtggcccaactgtcacagtcgggtgctgctgagcgcctggcacctaactgggactcagttttttaaatcaaacaaacctgattttaatgacagtttctacccactctgctaaatttgggatcctaggcaagttggtttttaactgcacggagcctcagtttcctcatctataaatgggaagaatgaacatctccatgggtttattttgcagaaaacagtaagatgtttggcttaaagtcatagttatgattaaaatagttcttccaatgccttccctttgtcaggattcgatctggtgtggcccagaggctcctgagccctccctgtaagcttgagaagcacttaggacacagggactcctgaccagcaccctgataagagaaacctaagggcctgggctttttgctttggtaaagaagagaaacaccagagccagggtgagaatggtccgtggctgtggcgtataccgagaggaggccgtctggttgggtcagctgggtgtgtacccaaggtttttttcttctgtaggcataggcacccagatgccgtccggaaagtatgtgaactctaactgctttggaaacaaaaccaaggccacagagaaactttggaattataaaatgtagccttcataaaaggggagagtgaacttttctgtgaagaaaaccaattgtgacagtaggggtaaaggaaaatcaactccaaatggaatcatgttttattcaggatttgtgctgccggtggggaaggccagacccagcgacaggatgggaaagtgggacaccccaacttcaagctttgtgcgttctgccacgaagttctatgcgcttcactgagctcagctcctggggacctctaatggcccttgatagcaaacatagttaaaaattaacagactgacagaattaaatatggatgacaagcaaccactgtggacttaatctgacacagggtgttacatgcttgggtgcttttaacccaagtggcatctcaagtgaacttctgagatgtctgggcacatttcacatgcctgtttggaagcagggcttagcttgtgcttaggacagacaggaaaagagtctaagagcccaggagagaaaattctccctggaggcttttgtttcattaaacccagctttgatcaggcttaccaggatgtactcacagtcctaggaccttgtccttgtggtctagaccttgtccctgcctgggctcggacctcagtagcacctgccatcgtgactggaagatccggcaagagcacaaggccagcggggagcatggcctcctccagctaggactttcttgctcacctcttttccagctgttggggcaggtgagatggcagccttaaccaaggaccaagtcatacaaatcttgacattctgcctagatcatagcgacttaattgccctaggcaaggactattaggtgccagacaggtagtgaagaatgctgatggcgttttcatgcctgagtctgctgagaaagagtataggctgccgattctggggggcagggagaagaggagtggttcctttacaagagggcctcatttcatgcagcagcgaaattcccaaaaagtgttcttccagttttggtgagtgcttttttagaaatggaggtgagggttgctgtttaaaagaatcttgcaatcagcgctgtaaggaagacaatctttttgtattgcacatcatccctccagcctattcgatgagtttggagtttcttggaccagattatgctgggcttggcagcctctcttcagcctggcagtctctgacagagcttgctgtaatggcctaacgtgctttatttggtgatgccacccaaaagtggatcctgaggtctggagcgagtagggcagagctgatggtaggtagtcactgtgtgagtggttccctgcagttgctcagtgttgggaacgagccccacagcgaacttcagcgctccattctagggagagtcatggaaacctgcctgagaatatccatgccttcaaaacattaacccattagtttgagataacattcttgtcatttacataaaacaacttgttcaagctactgtgggttttgttttgttttgtcttttgttgaggaagtctccctctgtcaccaggctggcatgcagtggcgccatctcagctcactgcaacctccacctcccaggttcacgcaatcctcctgcctcagcctcctgagtagctgggactacaggcgcacaccaccacacccagctaattttttgtatttttagtagagatggggtttcaccataatagccaggatggtctctatctcttgacctcatgatccacccgcctcagcctcccgaagtgctgggattacaggcatgagccacggcgccctgcccaagctactgttattaactattttgttcaaagagggatagctgacttctgaatgtggtgcaggggaaacctgcattcaggtacagcatctgcactagggaaggtgagagaaaatctgtagctgctccatgtacatgagacatcagagcactagccggtttggtggtctgtcttccagctcgaagcatgcaaatggcacagcccagcctcttagatccaccaaatgctaccactggaagggaccttccagaccagcatttctcaacacccacagggattcacagctgttccataatccagagatcctgcagtcagataaacttgggcagcacaggtctagatcaagtcaaacaggtttctttattttggaacttcttggagccattactgtgcccacacatatcaagaaactgctgaagggaccaaattgtgcatttctctctaatgtccttgacattagagcatttctagaccagtgttcttccagccatacttttcgaaaccttaattaaaagcagcatctctcagacttgaccatgtgcctggtgatcacctggggggctggttacagtgtcgtttattggatgcctctcccagagttttggcatttctgacaagttcccaggtgatgccgttggtccaggaacctgagaaccactggtctaggcttaccccttcattccccagagaagaaaacagtccaaccagagagtatttgctttcagtagtgactattaattgagccagtcacctgctaagcacttttcgtgactctttctaagggcaagtatgatagtgggattcagcccctagaaaggggatagcgcaatgcaaatcattactgtagagttttaccctgtgccagtcactcaccactgcagaagggttggtacttcaggcagggcgtcctcccgagactagtcaaggtcttcctgtccttggcatcagtattaggaacataaattctgtctgtatttaatcctctgggccttcatttttcatctataaatggaagaggatggaaattatttttatgggtgggtaccgctttctctagcattccatttgatttttactctgagttgcttctttttctgggtatcttggtgctctcctgttgtccaatctgtcaccatgctgagtgctggagacttacagtgttagccatgcaggggcactgcattttcagagcattcctgaagaagagggatggtagaatcccaaacagtgtggccctgggtagtgaactgtaacatggtaataacttaccactattgttaagttctagtggagaagattcccagggtcgtccacgttgccttagatgtcacaggctgtgtgaagtgcttagcgcggtctctgacgcagactaaatgtcagggtcagtttggttaagtatattgtgttaaagtttctcacagggtcttgagaagcccctggaattgtgtgcaagactgtgagtgtgcacatttgagagagagaactatgggagaagagagagagggtgtgtgtttgtgtacacatacgttttctgcacatggcatgaagaaatgtgaggggccgctgccttgcatggaaggccagcccttgtcacattattctaatggggagccctaaactagcctgctgaactgtttggagaggaccttgacgcaggcagtctggagggaactgtaggtttccccgttaagaagaattgtaaagcagcccttatgggatgggcaggagtgacctggggccaaaagcccagcagaacaagcagcccgaatggggctaagagagaaccctctcctcattacccccacacagtgattagcgcggagcagcttgttcccccccaccgggccggctgcccgaactctgctgtgcaccatgagccctgccgctctgccggctgtggtgcgggaacctggatgagccgctcagacttggccaggggggcactgccctctgctggaagctgggcgcagcggagcctctcaggctggaagaggaggcagccgtgggtgtctgtggatgcggtgagaagagccccccacttggcaagcacatagtgtcctagcctgagacacaagagcaatgaattcaggggtctgtgtgtccgccacccgccaccacatccactctgaggagcagccacctattgcatcactggcgtcctcactcctcagctgagcacagcctcccctggaccccacagctcggaacccgccttcatgtcactctggagtgcgcctcgaccaggctgacgagagcctgaagacgggctgcacgctcgtccccaaccctgcaggcacctgtgcgagtgagaacgtgagggctgtgtgcgagagctggtcagagaggctggggcagggcttccttctcgcagtcacctgcaccgaaagcagaaccatgccatccactgtgcagctctcctccccgggcagccctccccctcctgtgtctcctgtgaaacaccgtcacgtcttggcctcgtcggggctcagcgccccaacccacacccaggccgcaccagtcacaccactgcgctccacactgacccagtgcacacagacccatcaccctctactgtgtgtttaggtgtccagccccccacctgccatgggggctctgtgtccccgccccgtcctttcccacctgtctcaggaaggcagctccaactctgctctttgcttagtgagcaagtggattcagatgcaccaggccatgagccgtgggtaggtatgagttctttcttctccccacctctgccctccctctcctcccctagactcttctgtccccttccctgcccgcccctacctcacccccatcttccccactcttgccctccttcttttgttctgaacacacttctaatttcccagaggagtgttttctagccttcctgcctgggaaaagtttctgacccttgtccctgtaattgcaatgagtgttgggagtgaccccagccctgccttaaatgagctttggtacctgctggtggccctgaggacagcaactttgcctttccctgatactggggaccctgctctagctggtcatctgatcgctggtcatatctggcatggtcgccagaagagacccaatgcacaggcagcctgacggagtcgtggtgcaggcagaagctccggtatgtcctaagcctgcgtttcctgactcaggccagcgaggaaagaaccgctcgtgaggaggcccatggggaggaggaggttcccaggccgccttgtgctcggaccagggacaaggtcggggtgctgtgtcggatttctctaggacccaatttctagacatccctgcttttagaatcaagttaggggatctcgtggggcctcatcctggattctgaccccactgggctctgtgaccaaggtcattgagaatccccagacttcagctggtgcccacacctgtaaaacaaggagatgaggcaggagctttccaccagtcccttcagagccctgcgttgtgcagtgctgcctcccagacccccctgcacctccatttcagccagaatggctcttgcttcatcactaagctttggagatctcagtaagtcctcctctgccaccctgcgggagggcatcgcctcacctggccccacaggcctcaccttctccactcccagcagcacttctgggctgctcatggtggtcatggggagaccatgccgcctccatgtgaaaggaagagcagtgggaggcgggcatctcttgcctgtgtccaaaaacatgtccagtgatggatgccgttaaagacaaacggcgcttgcccttttgggtgttttttgttttgtttcttgtttgttttgagattttcattcattgcccagaatggagtgcagtggcacaatctcagcttacagcaacctcccccctcctggttcaagcgattctcctgcctcagcctcccaagcagctgggattacaggcatgcatgcccacgcccagctaattttgtatttttagtagagatgaggtctctccatgttggtcaggctggtcttgaactcctgaccttaggtgatccgcccgccttgacctcccaaagtgctagcattacaggcgtgagccaccacacccatttttttttttcatgttttccttggcataggacctggaatatgctgccaggtgggcaaagtgttgctcaatgcacctgtgtttgcggctggccttccactttagaaagctaatggaagagacagggctgctggtcccagctgggaggctccttgctgaaggctgtaggcccatctcctcagtagggtgaacagagggcctggggtaccagacacacacagtgccaagaagctggaaccctttttttaaaagaacaggaatagaatcgcaaagtagtcctggccaggccactggtgtggatggggtcgtgaactgccccttccttaccaaagcagctatgtttccacactctgcttagaaagccattagatagcctttcaccagcctaggcctgggaaaaggaattcgctgtgccggatcttagcctcaaatggctgctaacctttaaaaggaggatgagagcagaggagttggtggaacctcgggcacttctcgaggtgggtgctttcctcagagagcttgcctgtgtgttcataatggtgtgtggaacgcctctcaggacaccgctctgatgcttttcagccccttggggaagaggccctcacaggctagtgtgagtgggtaccatcttggaacagtagggaagtggtagccaagcaggaccctccgtgagaatggggatatgctggggagccctggctcacggccttctcccatgtcttttcagatgcgctggctccctccctccgaggctacttctcagggctggaagtcccgtcagttctgctgaatactatgtaagtactcgctttcctttggaatgtgcgaagcccctagaacacatctgtacatggtgggtgcgccatgaacgcagctctcctcctttctctgcacccacaccttatgcacctcctttgtccatctttgttaaactcacttgaactacatagcagtgcatcttttccgagaggaaattttcacctaggtacgggtgctagtctatttgagtctaacttaggaaaccagtacctggcctccccacttaaaaataagcagtcagtgctaatttctgtagaacagctgtcagaacattttattacctaattgtagttcacctgctgccagcattaaatcaaaaccttaagttgcaggaatagtcatccactaatttacacagtagttgattatgggagatttattagaatgagtttccctgcatacatcatatccaaagtactaatcgttaaaaaatacctcattttcctaccaaaggtgcagtgcacagttccagcaggctttcctttaaggttttcatcatgaaggaagcactatcctaaatgggcatttttgtgccattttaggcctaacgttgcttcagagaactaccaaatgccttttctccatttctacaaaataccaaatgccttctgtaattcagaaattctgaatttctgttaagtacaaggcactgttcttctaaactctaatttagtatgtgaatttggagagtctacttagagttaagtttttagaatgttttagttccaccatcagtcttctcttggtttacacagttccttcatgaaataggaagaaaaatgagaagagggaggggcctgatcctcatgctgttagaaatgctaaagagatcatggcaaacctgtgcacctgattttacaatagtgtcatgggcctttccttggagacttctattgtaagataaaaatacttccaaactaaactagtgttcttttctttttgtaccattaatactgagtccatatgcttttgttagatcatttgaagccatttagatagactcttctggagaggcattctgtggaaagaacaggcccctggtcaacttagattccacttaatggagaaatgtttcagacctctcacaagaaaaagacactagagctgaactcgcgcaggtcagtgcctgtcagtgaagaagaaagagagcattgaataagatttttaaagagtgctagggtttattgtgcacaggtaagttgccctgttgacctgaagtctcggttggtgggtcaggtcaccttcaagatctgggaggactgctgagtgtggacttcatgtttgaagttctcatcacgcaggaggccggcccttttggatgagctcaggtccgagtcagaagaccccttctgtgttcgcaaaggagaggtctcagcagacagtagagagatgagtaatgggcatgagagtgtcggaagcccacagacgattctcagagcagccagtcatagcccagcagccacctggccattcacagctctttctctgatggcagggataggaaagttgagagagagcgctctgtgctttaggacatcagcatcaggaagctaaaattgtatctactcttcctctaacccaatgtatttcatattttaactcaaatacttcatattcgagtgtggccaaataataatagtcctcaggggcaatcgcaggtgaagtacacaaatccttccaaggtcagtgaaacaaatttctttacccaaagattctcagagcctttattaccatatgaacatcatgaatatttaagaggagggggctctggtacacggtgttcctcaagcttacttgaaaccaggtcatccttttttcacagaatcttaggagactaatgtttcatgcctgggggaaccatatcctaacctcttagccagaaacgaaaccagaggcccccatatatagagatccttggatgagtattcatgtgtgatactgctcattaatctgtgatgatatttaaaaccccagacaatgtagtagcttttcttgtactacttgtttgtcccttattctgaaattacatgtcgtgtgtgtgcgcgcctaagtatcctttttaaatggtagtgttaggaaatggtaattgtctcttaaatgtcctttattaacaattcatgatagataaaatgttcttttaaaatgtttaattattttgtgaattctaaaagtttgctttttaggagagatttttttgctccagggaataccattcttaagctataagactatatctgagatatagtctagggtctatgaagtccagaattttgtaagtccatgtttcgtcttcatatgcccataattgacttttaaatacagatcccaaagccttacttatttggttgcataggaacctccccgttaccatggtgcccagcactgccttacaactccagatggcactgagcggaccctgctgtgagcagctccctattccatgacagtgtgttgagctctccattgtcagaggctggtagggtgttcagctagaggtgccgaggatgaggtaactggaaattctgaagcgcacaagagaaggcatggcttgaaacactgacctgaccctcagcataaactgaccgttgaggaagttggtgaaactggaagagaggccccttgccaagcacatctgagagccaagagtcagcagagaaagagcagcccccagagagtggagagcgggctggagaagcagggtgcgccggccacttctgtcagtcagatgcttcaggaaagtcaagcatggtgagagaagaccttcaacttggcaatttcagttggtagagaagtgggcaaaggatgttggcctgggacctaaggaagggcttttttccccttaagaatttatgtaggccacagagaagacatccattgtgaagcagttgcgtgggttccagtgacagagatcctgggtttcatttgtatctgctcacctaatttttttccaaatcatttctcacagacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtgaaaccccgtctctactaaaaatacaaaaattacccaagcatggtggtgggcgcctgtaatcccagctactagggaggctgaggcaggagaatcgcttgaacccgggaggcagaggttgcagtgagccaagatcatgccactgtactctggcctgggcgacagagcaagactgtcgaaaaaaaaaaaaaaaaagagtatgtaatgtctcccgtggatgaatcatttgttctgagctaagcttgggccatgggccagactccttcctcggagcctgtggggagcaggtgaggaaggagtatggataatggtgcccgttactcctgcacgcgggggagtctagtctcccagcccatctaaagttagactagctcagtgcggatctattatttcagctccttctagtctcttggatcaagtcctttccaagatggcccataatccaagctgtgtaatcttaggcaaatgtaaattagaattggaaacagtggtgctgatgagctaatataaacatttttaaaccagaacaagtcaaaaaggccaaatgaaaggcgcataccattcattggcagaggcccacatggctctctccgttcggcggggagggctttcttccccatcttgctttcccagcacggaaagaacagaagacgagcaggagtgatgccgtccttccaaatcctcaaaggccagcactcccagaggtccttcaaggatttttcatttatctacttggacttcttagtgctaaagagaaatcagtgactagactagatatgtaaataagaactttattctctagacaaacatttgttgtgtctgctgtgtccaagatacaaaaatgaaaaaacaggcctgtgcccctcaggagcttaagttctaatggcagagaactgtggacacatgtacaggagagggagttactgctcatgatcctgcaagaccagcttgctgtgaggagagccaagctgagggcatgtacaggccatgtgcatgctgttcctgtggcataagcaaggccatcaggagagggggggtcagaaggggacagggtgttactggtgttttaatttgctccgcctcttgctgatggatggtgttgagtttagtgatgcagacacagcctgtggccagagttttgctgatggttcagccatgtgctagagagcccagaatacagaatcacgattgaaaattgtcagtttcccagatacactgagaacaggcgagcatgagcaacgctgctgtcactccttacatgcagtgagagtgaggcagctttctttgatggatattcaaagagttgaactgttcttgaaagggaagaaccagcgtttgggagccaagtggggtgtagggggacgtcttctttcaggactcttgaaattttcctggccatggaccgggaccagagcccagaaattataagcacatgtagttacagcctccccagattggagaaggaaatgcaagagagaacgtgacggaatttggagctatttttcccttctcttctgttttgggtggaatggccttgcctgtctttggctgtgagcttgagtcatcctcagtagagtcccaggtgctggtgcccaggtggagcttagagcttaacaaggaggaaaggcactggggctccagaggcccagacagctgcggtggctcctgctgtcacgctggcctccccttagaagaaagccacctgtccatgtcatgctatcacactgcggtgcacccaccaaccagtatgaggctgtgaggtctgcacatcacacctaaggctactaacgccgtaactgtccgtcatacctaaggctaatacggtgagcagctgcagcgtcctggggaggagatgggtaataggtaatcaaatagacataatagtttgggtggtgatagtattcagggaataaataataaggccaggtaagcagctcagtgttgtggtacggccagcacttctggtgccttctgcttcaagttagcaaagcaggcagggtccgcctgagaaggtaacatctcagcaaagacctagaacttcaccagctttatacggggtttctttttcagaacacattccactttagtgaggcttggaaaatatttaactcctgtaatcttaaagtaaatggactggaagtgcagcaggcttggctcccacgcagcactaaggaatcactgggagagtgtgcagggccctcctcagagacctttctctgttttcccagtgaggagacgcaagcctggttctgcaattctttccagctctggagtctgttatggttcccatctgagctctaaaggtaggggtgggcctgaagaccctccacactgtcagtcctgtggacgtggtgggtgcccctctagccaccactgtcctccggactgtgccacatcacaagcacttaccgagctcctctacaaaccacgtgacaaccaaatgcagtgaaaactgcagccccccaacctgctcctgcccattgtgttttctgtggatctgtctggagtccttggagactcctgagcatgtgcactggcagagctgcctgactcttccctggaagaagttcaaagagggtagccacgtgttcagaccaggccatggggtctgggggctccgcgactcctgagagcaattcctggccggactctggctcatgttactgcccccacctccccccgcccaggtaaacccgggggtgcagacaactgttgttgaggtcccaggagcgggttgtcccctatgctcctggggacatggaggagagggagggtcccaggatcccagtacttgtatgagtcgcactgattagctgaagcccagaggcttcttaatcatcctagaaatacagcctcccgggaaatgtggcctggctctgcagctctgggtggctcgtgctctccctcctgtgtggaggggtcctggagaggttgggtgagctgattgataggtttcatgtgcaaagatgattattttcctgttctcaagtaacccaacttttgctaggaaactagaatcatctaatgttgcatagtgaagttctggggaaaatgttttcttccttaaatctgaggagagagatgtcctaggaaggtagtcttcaggctcactcttgattccagagctgggtttcagcacacgcagtcccctctccctgaagagtcctggtgggaccactcggaggtgccagctgagccagtgccacctttctggggaacccggacagtccgcagcagtatgttatgcactccagttctcataagcctcgcatactggacacggcctgtctgcagggagggagatctgagaaatgttagtgggaaataggaccgctggtgtccacatgcagggagttgggcttccttccctggcactggaatccttgctgtaaccagccggctcagaggcagccgtgcctgcagggggagtattagaaactgattctttgctaggtctttgcaccttcgtatttcaaaattctcagaccctagggtacaagtagccagatatcttcacaaatgtgcatccttttagtttttgttttccaggagatgcttggagcaaagtttagtccttggtgcctgtgacagacagggatttcctatggccttgggctgaccaaagctgctcagctcctggaggtggctgtttctggatcttgctgtgtgggggcctcaggtcccatgcctttcctctgcagggcctttggacagtcctccgggtctaggccacagcccttgggatgcaaccacagggacgtgggtgtagagtcctgcttgctgggcctgcagcctcctaatgcgccctcagcgaagagttcacatgcttttcttggaatgtccttcctcgctggcccccagaagcctcctcttacttgctccgccaagtcctcagtgcgttttcctggctgagagcttttcatgtcgcatatccaaggccattctgcagcagcctctggtcctcagctcagcagcagaggcctttgatctctttcggcgttgcctctcttggctctctgccctcagaacaggccggtcttcaagaccgaggcagccccaggtggaggttactgtgcaccgttaacgggtgatctttctccatcccaggtcccaggtgtgtgatggcggctgcaatctgtcttgtgggtattaatgcaatcttcagtggtggctactgttctctagctgttctacaaaactggagcatgctggtgagtaacagtcagggctgaacaagccctcaggggcggcatggcgaacacgtgggaactgtgggcctctgggggtggggtctggcattccaggtgctcgtgcccctccaccccaggtgattctgcccggagctctttaacatctgctccaacacggcctgccagggaaggtcatcccaggacagcaactgatacatttttaaagcccatcaccccagtatttggtgctcaccatgtcctccttaggtaaggctggcaccatgaacatctggctgtccagtggcacctggagtgagggattccacctagggaaatgttactgaaacgaagcttttccctttaagcatcgccttttttggggggaaattattattttgttggaaatctgtttcagatgtaatgtgtatatccccccatcttattaatccagttatactgcatatgatcagccatttgatgacttagggacataggataattaccctggagcatgactgaatcagaattcacaattaatttctccagactgtgggcctcttagtagttcatggttttagcttagtagttcatggttttagtgatctgtcttttcagtcggtatcacctgtcactcctcagttcgttagctactagcaggaaatgtagtctaaaaaaaatcctcctgtagcattcccagaggtgaccttgctgttgggtctctggaaagcctggcttagagcggcaggaatgccaggggcgagtctatggtggtttatgtctcagcctaaataaagcggcaggctgcatccctctgaggggcctatgaaaaaagaggagtctgaaaggaacaagattcctgctacagagaaccaagcgcttctggccaaggaggtggggtcgcatttgaggggcttaagtcacttcatactccgacgatacctctcagtgccgacccaggagcaggcatcaggtgtgtgccacactgggcgacccacctcccaccaccccagagagctttcccacaggaagccggaccctgcactttgggcatttttcccagggtgcctgtttcttgcactaacccaagcttttttcacatcacatagggcagctgggtctatcccactaggcccacggccttctagcttttccttttgtcaaagctcttaatggtcatcactcactcaaacttttttaaaagacatgattttgttcttcctcctggggatatttaaaaaccagttaagccacttgcacatttttttccacttatgcaatttttgaatgctggttagacatgattttaaatgcagcaagtcaaccaaagtatcaacaatgcaaggagcaggagttttcctggtaggccacggaagggcctagtggcaggagacagaaaagaggggacaggtttgggtcacggtcctgggggcagctgaggatcaggttgcaaatgccccagatgtgcctgagagagcggcagcagccagcatggaggggagcagtggcgttctcagcaccagtgtgttaaggtggggctcacaatttcttggggccttccctgggttacagcagcgagtttggagggggcttttctcttcccaaatctgaggtcagacaacagtgcttatgtgacctacccttggagggcagagatgggccattctccatgggcccccagggctggaatggagttccaaactgcagaagaccatgcccctagaggctccagagaccgtgaactttttcaatgacacgtttgaaaatctattacaaattaatatcagtacctgattttttgaagatgaagctgacaggtattaaatgaaaacggaagcactcttaattaggaacctttgccacatgatggcccatgtttatttggagttggggggagaacattccttatctgacttggtaaccaggaagccttagaaactcttggggaaggaatcctcaggaattaggtcaaggagctgcagatggatcaagggaggctttcctctgggagaaaaatctcccaaggcatcggaccgagaccctgactgggtacgaagagaccgcagagtgaggggcaggcagcgggcatcctgaccccaggcccatctgtccccacgttctgagttccaccaaagacccaaaatgcagtgttttagaattgtgtaatattccttaagagaccaagagacatcctccagtgtcttcaaactgggactgttcccacttacctgagataaggagatttgttccctgtcttgacgtcccatcacctgtatgtcatagtcggccccttccaggaaggccccgcgaggagaacctgctcctaatcagagccttatgcgttcccaaccctgaccccgccatccatccctccgtggggctgtgttcccagatgtctttggattctgtttaaaatgtccttgttaagacattccaaggtttgaactccgctcctagctaaacctcctccttgtttacagggactgaaatagccacattttgaccttctgttcagtctgggatcatctgtggtagtgtgactacattcctttcccatgcaaggatcccatttacatggcagttatggaaggcccagaaaaccagacttgctcccgccctcctcctgcctatgttccttctcccttcagattagccctcctaggcagccattccgcctgctcaggggctggggcattgggaagctgcgtggttcattacccaggaaagctggagccaccatatccccctcatcagggctgcagctacccatggaggctcagggtgcccctgggctggtgtacagaacccaaagttggtcccctggcctgctcccaggccagacaccatcaaccccaggggcccatgtctcagtgccacatgccataaatgacccaccactcctgttttgtgtgtcctacagtctaagtgtctgaatggagggtttgcatttgggccacctgcaagtgactggggtttgaggagaaggaaaaggtctcaggaaaataatgcaggatgatccctgtcaaagctaaagtggcctggtcagtgagaacccctgtgaggagctcagaggaggaagcccttaagatctccagaggcatgagttctgaaagacagtgtggcctgtatatgctgaggggactagtaacagaagagaggaagtaagaacaggcacggcacgctctgctgaaagtagactgcggccaggcttttgaaggccttgaaggatgtgttagggatttggaagccactggaaagatgagcaggggtggagagtgatttaggaatgttgttgtcatgctgcccaaagcaaagtagatgaagattcgaggtagaagcacacttctgcacaggtggccctaagatggtgatggtggagtggaaggagcagatgagccaagaggacaggaaatgaggtcggtgtaaagggcagggacaggccaggggtgcacagggatgagtctggatttggctgccttgagggctgtctacagtaagcatacttaagcggatgtgctagaactaatgtcattatttatttgccacaacctaaagagacaggcaagtattagtcgcccgtcacagagaaggtccagggtgtccagggcccactgtggaaagctctgcctggcttgcccctgctccgccggccgttacccgctacccactcatactgtcgtccaaaaactgggcagtgaaaagtcacaggtcagatacaaattggacagatttggtgtgaacatttacaagctcatcccgtacgctatgtttcagtggtcacctaaatattctcatttcaggactttttaaaacacattttcccaaatctaacttgggacaaaatctaacttgggacatttaaataggttatcaataattatctgtttatggcctctttcggcacacaaataagcatctccctgtacaaaattctagtgtatgctgagctgattgattgccttctgcatacaccttttctacaacttctcaaacgtgtgtgacatgctggtaagatggcaggaaaaggagtgactgaataatacaatatagctgagatgtgtttcaagaaaacctctgggccagggtaggggtttgtgagcgggagccaaggacttgccccatgtttctaatcaaggtgagaccactgacacatgtggtcagcaaatatgttctatacacacatccgcacactgtcatctaacccatccgttctcccatccacagcatctccaggacaaagccatcgcaactagggaggggttgacacctgctctcctaacatgttttctttctgtttcaggcttgaaaaacccttgcccagttttgatcccttcaagactttgtcacagcctctatcacacatctgtttttctcgaagaaaaaaatataattaataaaaatgttttactcttttacactg

SEQ ID NO: 36948 - DNA, 328086 bp, Homo sapiens
ctgcctgaatctgttctgccccctccccacccatttcaccaccaccatgacaccgggcacccagtctcctttcttcctgctgctgctcctcacagtgcttacaggtgaggggcacgaggtggggagtgggctgccctgcttaggtggtcttcgtggtctttctgtgggttttgctccctggcagatggcaccatgaagttaaggtaagaattgcagacagaggctgccctgtctgtgccagaaggagggagaggctaaggacaggctgagaagagttgcccccaaccctgagagtgggtaccaggggcaagcaaatgtcctgtagagaagtctagggggaagagagtagggagagggaaggcttaagaggggaagaaatgcaggggccatgagccaaggcctatgggcagagagaaggaggctgctgcagggaaggaggcggccaacccaggggttactgaggctgcccactccccagtcctcctggtattatttctctggtggccagagcttatattttcttcttgctcttatttttccttcataaagacccaaccctatgactttaacttcttacagctaccacagcccctaaacccgcaacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgccccccaagcccacggtgtcacctcggccccggacaccaggccggccccgggctccacccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcacccccagcccacggtgtcacctcggccccggacaccaggcgggccccgggctccaccccggccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatggtgagtatcggcctttccttccccatgctcccctgaagcagccatcagaactgtccacaccctttgcatcaagcctgagtcctttccctctcaccccagtttttgcagatttataaacaagggggttttctgggcctctccaatattaagttcaggtacagttctgggtgtggacccagtgtggtggttggagggtgggtggtggtcatgaccgtagggagggactggtgcacttaaggttgggggaagagtgctgagccagagctgggacccgtggctgaagtgcccatttccctgtgaccaggccaggatctgtggtggtacaattgactctggccttccgagaaggtaccatcaatgtccacgacgtggagacacagttcaatcagtataaaacggaagcagcctctcgatataacctgacgatctcagacgtcagcggtgaggctacttccctggctgcagcccagcaccatgccggggcccctctccttccagtgtctgggtccccgctctttccttagtgctggcagcgggaggggcgcctcctctgggagactgccctgaccactgcttttccttttagtgagtgatgtgccatttcctttctctgcccagtctggggctggggtgccaggctggggcatcgcgctgctggtgctggtctgtgttctggttgcgctggccattgtctatctcattgccttggtgagtgcagtccctggccctgatcagagccccccggtagaaggcactccatggcctgccataacctcctatctccccaggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtgagattgggccccacaggccaggggaagcagagggtttggctgggcaaggattctgaagggggtacttggaaaacccaaagagcttggaagaggtgagaagtggcgtgaagtgagcaggggagggcctggcaaggatgaggggcagaggtcagaggagttttgggggacaggcctgggaggagactatggaagaaaggggccctcaagagggagtggccccactgccagaattcctaaaagatcattggccgtccacattcatgctggctggcgctggctgaactggtgccaccgtggcagttttgttttgttttgcttttttgcacccagaggcaaaatgggtggagcactatgcccaggggagcccttcccgaggagtcccaggggtgagcctctgtgcccctaatcatctcctaggaatggagggtagaccgagaaaggctggcatagggggaggtttcccaggtagaagaagaagtgtcagcagaccaggtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaacttctgatctttcatctgtgacccgtgggcagcagggcggtcagaatgtgtgtgagggggctgggggaggagacagggaggccaggaggcagtaaggagcgagtttgtttgagaagcaggagatgtgaggaggaggtgacattggggagtaggggtggcctgaggagccacctctggctaaccctggcagcacaagaggaaggaggaaacgaaacccaggcgggctttggagggctagcgtgactgggctccgtgactgagctctgtgtgccagtggctctcccctctcctcgcctggcccacgccctccttgccccctggcatggtgccccccaggtggctctattcttagctgtccgggtgtgaagtaaatccttgggcagtgataacagcccagagtcaacagggttgagataagcagaggctgggtcagatccgggcgctggcaccaggcccagccccctccctgaccccggctgccccaccagcctgctgcccctggggtgggctccacaacaccctgggaatggggaagtggttctggttccctgacccctttgggcccaggcacgttgcctgtcccttgaccgcattcccccagggcctgtgctgcaggcctggaagccctgattggggcctgccaccagcagccagagagctatgtcccctggcagctgtgatgcgctcaggccgggccaggacacgtgtggcaggaggcttagagcacctggcctggggccttcctctctcaggcaccagatccattggttgctcctgcctagaaccacagcctagcaccctgctccctcccgcctaccacacccagcacagaaactcacaggaatgattgcgctcagggaaggcagagatgtgcctggcatcacagtttattgtttataaaccatgacaataacagctgttgctcagcacaggcctagcagagcccactgcagggggacggcagcgggcaccagaggccttgcctggcccaacccaatgggaacacccagactcagctgggtccccaagggagacttggcacattggcatgggtgtgggacaggtaaagcatgcaagagggagaagagggacataaggggcatgcggctgcggggtgttgggacccaaataaataaagcaggatgacagggtccccttcccctcaccaggaatgcctggacagcgtccagccccaaagcctgcctgtcccaaggctgtagttcagcatcaacagggcagggagcttggcagggcaagggcagagctggagatcatgcccagtgttccaggtgccctccctcccaatcagcctggggggcacaggacagggatggagaaggggctctctccatggcttgggtaacatgccaaaggcaggtcatagggcagactcagtgggggtgggggcctggctaacaagcaatggagagaacgggggccatccagagaggtgggcagaagagagcccctgggtcaagagaaaactgtgggaagacagacacgggagaaggagcagggccacatggtaggagagtttgggggagaagctgccagggggtaacaaccgggtgccaagaggtttgggggccagggcccaggaggaccccaggtctgcatgaggggcctggaaggctcagtccagcttggcgaagcccccaatggtgactttcctctcaggcttagtgcccactggctcctggagctgtactgcgccacccccgatgaagcaaaaggcagggcacacaggccctgagcagtccagggggcactccaagagcccacggaaggaaacagcatccaggaaggaaacccggccccgctcatagtccaggcagatgcccaggcggggtggcaggggcactgtgcagccggctgtggggccatccctccctgtcagccctgcgtttgagcttgcccccgaccccagcaggatcttgcccatgccaatggttaggaaagcgaagggtggcgacgcctccactgtggcatcctcggcaccgctgtcgtgcccgctgtccgggtcgtacctgcagaagcgggtgttggggacgagattgttgagggatggagtgacggatgaggtaccagagggagacgctggaaggatggaatgttaaggagcaagaggttgaagggatggattttgggtgttgagaagaaaacgctgaagaggcaggggttagagtatagggtcaggggtttgggtttggtggaaagagagcactgagaggaaagcacattggcaagagaggggcaggcggacaggaaagacatggcattggtatagcccgcggaaaggcattgagaaaaatggtcttggggaaatcatgctggggagatggttctgaggattagaggacattggaagaatccgagattagtgactaagaagagaaaggatgttgggaaggtgggtgtcgggagagagatgagggtggattggtgtcacaaatgaagggtgttagaggtatgcggggttggggacaatggggtttaggaggggtttgtgttggggagaaagcattttgaagaaataaggtgttgggggatagagtgctggggagaaggcttaggatgcaaagcattagtgggagggtgttaaatagggagttggggccaggcacagtggctcacgcctgtaatcccagcactttgggaggccaaggtgggcggatcacgaggtcaggagattgagaccatcctggctaacacggtgaaagcccgtctctactaaaaatacaaaaaattagctgggcatggtggcgggtgcctgtagtcccagctactcgggaggctgaggcaggagaatggtgtgaacccgggaggtggagcttgcagtgagcggagatcgcgccgctagactccagcctgagcgacagagcgagactccatttcaaaaaaaaaaaaaaacagggagttggggagaggagggttatggaggtgggatgtttaagggaagaatttttttttttttttttttgagaaggagttttgcttttgtcgcccaggctgcagtgcaatgacacaatcttggctcaccgcaacctccacctcccgggttcaagtgattctcctgcctcagcctcacgagtagccggggttacaggcatgcgctaccacgcccagctattttttttgtatttttagtagagatggggtcactccatgttggtcaagctggtctcgaactctcgacctccagtgatttgcctgcctcagcctcccaaagtgctgggattacaggcgtgagccaccgcatccggctaagggaagaattttaagatacgggtgaaggaggtcttggagagcaaaggttttatggagaaggtatgttggaaatggagtgttaggaagaaaggacacagatgcttggagagatggtgtgttgatccagagtgacagatggttggaaggaagcagagatggctccctcttctatcatccctttccctgaccacacgacatgctctgaaaatcagtcctcaaaagcccttttgctgagcccatgcgtctcctggacacaggcctcccagcctggcttccaggctcctactacttcctcctaatcccctcccagccccaccctagcaagtctgtgctccacttgccaccccttctgtgcccctcactcccaccaggacccccacaccccatcccttccagaggggtctgacctggggctgatcacatcgggggcaccctggaaactttcttgaagcttgctctccagcccgacgcccaccttgaccaagtaggaggctgggtctacggcgcaggcccagtagctgcggccctgggtcacagccacgtcgcccaggaccacatccacactcaggtggcagccggtcagcagccggtcagcagccagcagcaggggcagccctggaacactccgtactgctcgctggtccttgctgatagccagccgctctcggcttgcgccccagcggctatcgaggaagaagtgcaggactggaaggagggagagggttgagatggagcaagaacttcagggacaaacactggcactgggggctgtgagactgcagaacagggaacgcgttgcaagggggttcagtcaccaggaacaggcagggggttcaggagaacaggacatgggaaactggaatggggggcatgaggaaaaaagaagggggcattccaaatgggcgtgggaccccagagagtttttgtgatggcagtgggcacagaagtcagtgctccggacctggctgactcatggggctccctcgaaccccttacttgtggccagccccatggacagttcccactattctgttccacctggtgacattcccatcaccatcaatctgtgccttccagcccatactctgggttcacacctggcccttatacccagcccctatttgggtggcaaggcttccctcttatgcccaccccctggagtccgaactattttctagtcactttagtaacattcttgagccctaaccatgagccggacactgtactcagactcccattgatcgtctcaaaccagttgaattcttgcaactctatgaggtaagcattatcattttttaaaaatatatatatgtttttgagacggagtctcacactgttccccaggctggagtgcagtggcgcaatcttggctcactgcaacccctgcctcccaggttcaagccattctcctgcctcagccttccaagtagctgggattacaggcgcctgcaaccacacccagctaattattttcattttcatttttagtagagacggggtttcactatgttggccaggctggtcttgaacgcctgacctcgtgatccatccacctcggcctcccaaagtgctgggattacaggcgtgagccactgtgcccagccaaaaataatttattttttacgtattttatttacttatttattgagacagagtttcactcttgttgctcaggctgaagtgcaatggcgcgatctcggctcaccgcaacctccgcctcctgggttcaagcaattctcctgcctcagcctcccaagtagctgggattacaggcatgcgccaccacacccagctaatgttgtatttttagtagagatggggtttctccatgttggtcaggctggtctcaaactcccaacctcaggggatccacccaccttggcctcccaaagtgctgggattacaggtgtgagccaccttgcctggcctttatttatttatttatttatttatttttccgagacgtcggagtcttgctctgttgtccaggctggagtccagtggcgcgatctcagctcactgcaacctccgcctcccaggttcaagcgattctcctacctcagcctcccgagtagctggaattgtaggcacgcaccaccacgcctggctaagttttgtattcctagtagagacggggtttcaccatgttggccaggctggtctcaaactcttgaccttgtgatccgcccgcctcggcctcccaaagtgctgggattacaggcatgagctacctcgcctggcctatttatttttttagagatcgggtctcgctgtgttggccaggttggtcttgaactcctggcctcaagcaatcctccctccttggcctcccaaagtgctaggattacaggcatgagccgctgcacctggccagtattatcgttatccctacagaaaaggactctgaagttcagagagggtaaaaacttgccagaagccacccacacagttggcaagaggcagagctgggatttgaacccaagcagtctagctccagagctagtgtgtgtgagacctactatgttatatggcctctctagcggccaccggaaccaaccgtcagggcctaggccctggcataccccatgccctttgcacgaccacctgtgcctgcccactcaccaggtgccgggggcgtgtgcaggtgcacatcttcactgtattcgccgtagccggccttgttgcagccgcggacacgcagcacatacacagagcccgtgtcggggttctcaagcagggcactggtgcccctcacctcctcccgccgctgccagcgggtggggcctggctgagcaggcacatccgtgcgccggaactcaacggtatagtgccaggcaggtggtgaatgggggggcagccgccagcacaggaagatctgatcataggcaaaggtgcgctgggtgtcaatgacgggggcctcaggcactgttggaagagacagcgggtgtcagtcagggcctggccactggcctggcatggagggcaggggcaggcaggaaaagggaaagcagcgggagccgggggggtgagtgtgggtgagagggagctggggaagggctcatctgggaactgggcacaggaggggtagggcagggcccaagagagaacgaggcaggaaagcgctgggctgggggtcaggacacctgtgtgctagttctgggctgctgctacctcactctggcctggaataagtcacttcccctttctgggcctcagtttcctcccctgtcaaatgagggtatcagatcaggtaagttctgggggcccttgcagctcagttattctatgaattaagaggagccccagggaggggcaggcaaaggccactggagcccacaggcaagagggcgctgagcaggaaggaaggggaccaggctcagaagagagatttaggaggcagcgaggtggaaagtggggacaacagagggacagcaaaagctgagggcaggggttggaggtcaagggaaaggaagtgcaaggccagagggcaagggtcacaaggacaaaaggtcagaagggccaggattacgcaagcgcctgaagaaggcagaagggagacagggcattggtccagtgggaggaccacgaggtcggggcaaggcaggaaagagaaggaagcaatgagtggttggctgagatgcgtgggagcagcggggtgggaagggggcccggcggcgggcagggcccccggggcagggccgctgacttgcctggggtgctccggagcagagtccgcggtggccacagcctacaaacaaagagagggagaagcagcgctgagcgcggtaggacggtgtggcagggtgggctgggtgggaggaatggctggccaggccgggcaggaggccggggaggtccccggtaggcactgccccccgggcccgctgctggggaggaagggaagaaggctctggttgggcatggggcctggccatctccttacctcgcaggaagttaagctctgtcagcagcttcatctcacgtcccacgtcgagctggcaatggcggaaggaggagctggcagctggccggaatgtctggagggcttcagtggctcgggcaatcctgggatgggggcaagaaagggtcaggcactgccatgtgggcagtctcccttcccctcaattctgtcttgcttgcccctagagccttgggaactgctttgggagctggtatcagtttggcctcatgagaatccttagaatgccagttctccacctggcagtactgtagacattgtcctagatgttggtcacatccatgatgtccctgcccccctaggagcccatgcccctgagtacctgttgtgcagctgcttggcggcttgcacaaagcaaggctggtctgtttccttaagtacttcctgggcatagcccaccagacctgagccatccagcaggctccggtgctcctggatctgggcgctgagacgggccagccgctcctgctggcattcttcaatggcctgaagcagtgatgcccgcttctcctccagcacagcccccagcccccgcaccagctgcgacacctcctccttggcctgctgaccactcacctgcccagggagcaacacccaaaggatgcgtgacttactatcttctttttggaggcagcacttgtgctggcctccttggatgccacagcatggctaaggtcacaagggatctggggaaatcctactcacccattcctacagggcctgggctcatggctgcaaaggcacctctagatggactcaactcctggtcatttgtgccaaccttcccggaaccccacatcataatctctgccccttagtgactcatccaaatgaacgaggccatggctaccctaatgtccacttggactgcactaattaatgtccactggcatctatgccatccttagttgtccatccccatgtcagccagctcaagcaacctggcagaaggtatcagtcatcacctcactctagcactgggaatgcgtgacatcctcggtaggcacctgagcctgagagcatctgagctacgcgtggggttttttgagctatgcatggggtttttcgagcactctcctgagctatagccaccctgccccctcctgcagcccaggtacagcctggcctggggcactggtgttcctgcaaacctggtttaaccagaacctggacacctcacgggcttcctgagctagcaacaaggtgattgggtcatgatcacccacacccccttcctgcccctactcccaggcagggcccagggcctacctctgtgccctccctcacctcggtgtgcctcacggcctcctccagctcacagatctgggtctgtaccgtgtcctggtttcccaggatgtatgtcaggctctttgtcagcttgtcctgagggggaagaaagaggtgggcatcaagcccagctctgcagaagccagcagttgggaggaggtgcaagagggtaagagtgtgagttagcactagggttggataaggggggtccttaccttgagggcctggtaggcactgagcactggtgtgatcttgtgcccgctgtgggtgcgccgcacccggcagagttgacataccaggcgttggcatgtcttgcagtagtgggtcacctcttccttgtggtctgggcacataaggccctagggacacaaagaacaatgtgatggtcagacaatggtgtgggtaagggtgctatgctaccactacagcagtttggtgccctcctccactggcaagatgggagtggagacatccgctggtggtgctccacagtgccacctggtggtacatactggcatcaaagagcctttcctgcagtctccgggcggtgcccatttcaccagcattgcacctcccttcatctctctcattgggatatatggtaataacagtaataatgatgccaattaatctttgcctggtagttaataattaaccttgtccatcttgtttactgctgtatctccaacacctagaatagcaccatgcacataggtgctcaataaatatttgttcagtgagtgaatgcacacagaccttttcagtgtgcaggtaacactttttagtgaacaaacattatctcacaccatcctctcagcaaccctttaggtatggacattgcagggcagatactaccatccccctacagggatgtaaatgagatggaggcccaaagttgttgaatgatttgtccagtgactttgtgacagattacagagataggtgcttagcattggaaaacccttcccacttccttttggaaacccacaatgccaggcacccccacccacctgcagcagcatgtccctccctccccaggccttggaagggctggctcaccttgggtcggaaggagagggtaggcagggtgggctcatgctgggccttctgggtgccccaggggtggaagagcttgaagcactcattgcagaaggtggcgcggcactctgtgcagcccttggtggcctctagtggtgggggcttgcacaactggcacaggatggcacctcccacactcacactctggcggtaccgctccaccacacgctccagggtcaggttccggaaaagccctgccagaccccgctccccaagctccacatcaccttggcaggctgggcacgggaacatgatcacttgggggtgcaaagcacctcgcttcctcccagggtatgtcccaaagcctgtgggtgaaccagggaggtagaggacatgagagttacagctggctgggtgtggggaagcctgtttaattaaattagattttcattgtgccagagctcagctctcattagagcctgcgtaagcagtatctccaccccccagaaagacagacagatgcctctgaccagtgatggacttcttccatcttcctgatgaatagctcagcgttcccatccccaccctacaggccccagtcccacctgacttaagcagccggtccaggcggtctggcttggggagagttctgcgggagaggcgggggctgcgggtggaaggggtggaggcaggagaggtgggctcggagctggggtccccaccatgtcctatgtagccctgctggcccaagacctctcgggcacaggcctggcacacgttgtgggtacagggcagcaccagtggctgcttgtacatctcttgacacactgggcacagcagttccttctccatgttcttcatgctggtctgtggagggaccaggaggctaggtcagcgcttggacacttaggcatacctcagcagccccttggctgcccttggataccctaggggtctgaggaaggagcaagacaagctacctgcagcttttccagagcacctgccttgggctggttcacagaccttcccagacctctgtcccttgcttctctttccccgctgcagagctaaaggcccagaggagggacggttggagcttgtgcctgctccagcctcaagcccaatccccatttctccagctgcagtagccccagctggcagccccctcacctgcctccatcccccatctctgggcagcttgcccctggcatttttctcaaggacaccgcccattctgcagctccatgcagacccccactcccttctctagcagcacccccatgccgtgattcctcccgatagccaggcgaggttggcactccatcctgctcgctccatacgtcctcctgccgcagctccggcctgcggccactccagcctccattccccatccttcacttccccatcggtcttaccaacccattccccttcgcccccatcaggccctcccgccctctcccgcagcgcaacccggtcagcggcacccccttctccgaactagcgggggaatcaagagccccgcctactcgccccctccccaccggaagtcccctccccctcttggtggcgagagtgggggtcctcaggctatgccccacccccacacctcaccttggtccctctcttcgcagccatcccggtcaggggcgcagctgacacaaaggagggaggaacaaggagggggggaggaagtggtgggggggaacacggttggcaccgcccctgggagagccaggcacgggttgccatgacaaccgcaggctcggaagcagccctgagtgggggtgcgtggggtggggtcttggggaggggtccaaattgggaactgcactgtggggcggctcctacatcatcccccacctgtcctcagttttcttggaaaatatccaagctcacacgtccctcttctcataacagggcctttcccctgaagccccagccccggtgcactgctggaggccaccccagcccacccgctgcgtctgggctgctcctagctcctcctcacgctccagcacaccgacgccttcacggcactcacctccgggctgctcccgggattaccctctcatacctgcatcccgaccctcccagccgtttctgccatcgctagccccctgtctacatcccagcatcttcctggatccccacctgttccaggtcccagcttgccccagaaccctatacgccccctccccttccctcgaccccaccttaactcacactgatgcggaccagtgcgtccatgatggaagtgaaggtctgcatatcctcaccctctgccatggccctaccgtgcccgcccgcccctgggtgcccgatcccggctgcggctgcgaaccccgggcttaatgcaggagcccagtgggggtgtgaggagggctgggggttgaggtgtcactgcgcatgctcccgggaccagcctcgaacagcgcccgtcggggtagggggtgggaaatagttctccccacgtggttctcgaaagccggtcggggggttggggaatatggaaaggtatttgacgggggagccatttcttacattctcatttttcattggctcctaattttactcatataaagcgggggattagtttcggaggaaaatgagttcctggttgggagcactaaattttaggttgggagatgttgaggcatggggcagggaggtttgaggaacgtgcactagagatgaaagaaatggcaaagaagacagagatgggatagatgccacaggcatgggcccaatgacttaaagagataagtgcaccttgtacagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcggtaagcgctgacgcatgcgcatagctaaccgcacccggttcagctcgcctttcttggccagaggcgccggttggactcacgggcggggcatgatgggtaacaggaccggtggggtccccaggaagtcctagagggggtcggggtttgggtggacaagctttcctcgtcctctcccgacagagctgacgtgtcctgggttccaccgggagcgggcatttccaccggacgggagggttcggggtgtccggggctggggaatacgtaggggttgccgcgcggtgtggggagttggggcgtgtggctgcagtcccgggagttcttggagggggtcggcccaccgagcttccggaccggctgatctgcccgtagcttgccggagggagggcggagcctgactctccgtcccttctcccatcccctccagtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgtatcctccctgcagttggagggggcgggccacgtaggcatgtgcccttccccttccccacacagctctgtccccgttgcacaccctactccttaactccctcaaccaggccttcaataatctggagaatcttgtctttggcaaaggattccaagcaaagatcttccctgagagtaagtgaatattggagcttgagtatttgaactttctcctctttaacctcctgaaacatgatattgaatttccagatgcttaggtgaaaggttgttaaggagaaatatatttactgaagctgtctgaagacagatgacgcttttcgattctgcaccttgtatagctcctggagttggagctggaagagaaggcctttgaaagcaagaaactttggtaccttctggccagctcccagggaaggtttgaggggaacaggcaaatttgggctgatgttttgcatctattcgctgggaggcggtccttgttcccaccagaagaagcagcaggaccaagttcactatggagttctgatgtgaagttaactcaatattagagaattctacttatttgagggaattgtgaagagcctaaatactagaggcaccaaatatctatggcagcaggaatcctgaccaaatcagaataactgttagattatttcctgtttggaataattcttgttcaattgctcatgtaatcaagaattgatgattcagttatttatggagaattaagtttataaagcaaattaagtgtcaaggccagattacttaaggaatgccacgtgctcagaaattcacagcagatgcaatctcatgtaaaaccctcatgtggtaaaacaaagatctatcatggttgcccttaatcttttctcttttttttttttttttttttttgagacaaggctttactctgtcgcctaggctggagtgcagggatgtgatcactgaagccttgacctggtctcaagcaatcttccctcctcagtcttaccagtagctgggactaccagtgagtgccaccacacccagctactgttttaagtttttgtagagatggggtttcaccacattgcccaggctggtctcgaactcctgggctcaagtgatcctcctatttcagcctcccagagtgctggaattacaggtgtgagccactgtgcctggctgccctcatttctttgcccccctctaggacttgctttctccgcatagcccttttgcaggcttcagagttctttccatccagtagccccgggacttctctctgttaggttttgtttccatatgtattaccttcacttgcttctttttttttttttttttgagatggagtctcgctctgtcacccatgctggagtacagtggtgtgaacccagctcactggagcctctgcctcccaggttcaagcgattctcctgcctcagcctcccgagtagctgggattacatgcgtgcgccaccataactggctaatttttgtatttttggtagagataggatttcaccatgttggttaggctggtcttgaactcctgaccttaagtgatccacccgtcttggcctcccagagtgctgggattacaggggtgagccactgtgcctggcttttcagttgcttctgaaagaaaccattggctgggtgggatggcacacgcctgtaatcctagcactttgggaggtgtaggctggcagatagcttgggcccaggaattcaagaccagcttgggcaacatagagagaccctgtctctccaaaaaaatacaaaaattagccgggcatggtggtacgcacctatagtcccaggtactcgggaagctgaggtgggatgatcgcttgagcccaggagatcaaggctgcagtgagctgaaactgcaccactgcactccagcctgggcgacagagtgagattctgcctcaaaaataaaaaaaaataataaaaaaagaaaagatgccattgtggtggggcaaagttcttggcccactttgccttctctgccctctccacctgggcaggtggggccctgtttgtctttgcttttgtcctctcaccttctctcccatcatattccaggtaacctaaaatcctttcctgcccccatgaagaagtagatccaagcactctgccctccaacctgtgtccagggagcaaggccttcaacttccaccactggtcacccagcttaatgaattgactctcattgtctggcttcttttggaaagggtttaactgggttccccaaatgggaacacaccttgcccttcagactctgttgtccatcacctttcctttttccttttatgggaggaaagccagggtagggaagttatgtgagatatggggcagagctggtaaaaaaaagcatacatctacatccatgttctttttttttttttttttttttggagacggggtctcactctgttgcccaggctggagtgcagtggtgcgatcacagttcactgcaactttgaacttcctggctcaagggttcctccaacttcagcctcctgaatagctgggactacaggcatgtgtaccactgtactacctggctaaattttttttaattcaattttttttttttttaagagatgggtctcactttgttgttcaggctggtctcaaactcctgggctcaagtgatctgcccacctcagcctcccgaagtgctgggattccaggtgcaagccaccacactcaacctcctacctccatgttctgggtatcattaaggtaatcagaatcctcctgctgtagtcacgcttacccttctaagcaggttccccaggattcagagagccccggatttctcctggactccatgtgcagatgcctagtatttccattctgaccgttgccctccttgttcttcttgcctccctagttctcctgtgcctcctgttggctctctttgcatctggcctcatccaccgagtctgtgtcaccacctggtatgttcttgacagctgggtaaggggtgtagcattccgttttttggcattggatcttactgtgatggtgccagagtttttccttccacacctacctctctctctgttctccctccccgttttcctaaacttgaacttggattctttccttgatgctagtgtcttccctaggaggcaccaggctggcagatgcccactggtgccatgacctttctgtcttcaccatatagcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtagctctgtgagttgtgatatgttgtgggtgtcatctaccagtatccagcttagatgtacagaatgttaagacatttgggcaccttctgttttcagaccttgggaatagtgaggctttccttcctcccacattaatttttaccagttatctgttgaatactgtcagtgccactggagtggcatatacttgtgtgagtctcatcatggaagaaaagtacatgaatgttctgcagtcgtgttctttggggaaaggggtaaaggctgcaatgcaggaagtcctgtccgtcagtaccagaagggatcttggagcaaaagagtaaaggaaggaaaggtcccgtatacctacactgtttcacggggttccacgtggtatctttgccactccagctccctgccttaagcaaatcagccccctgctgcaagtgcataggtgggacttctctcctgatgctgtccctgggacctatctgttctacttcagcatgaacatatggctgtgtttagaaagactccccaggtgatcaactgctcctagcctgtttgttctggtgctttcattttttccccatcttgtagccaagacaatgggaacttcctaaattgtagcgaagtatataaaacaataggagcaaggacaccaacctctgagcccaccttgatggaaatgcaggtggctacttgcaccctgccctgtctgtgctctgtcatgaggaacaactctatgcagagtgcccgtcctaggtgccgtccctcgtgctgaatggcgtgtgttttagggtatacacctcatcttggtcagctttgttttttccagagcctgataatggacaataaagactggtgggttgggccagccatggtggctcaagccagtaatcccagcactttgggaggctgaggtgggtggatcacttgaggtcaggagtttgagactagcctggccaacatggggaaccccatctctatgaaaaatgcaaaaattagccaggtgtggtggtgtgtgcctgtagtcccagctacttgggaggctgaggcacgataatcgcttgaacccaggaggtggaggttgcagtgggtggagattgcgccactgcactccaacctgaacgacagtgaaactctgtctcaaaaaaaaaaaaggtgggttagttgaatgaaataacctgccctgacaaacaaaatcctgtccataggtgcctgagttagggaataagactcagtgaagatgaagaagtgagtagaggagttttggtcagggattagaggccaccccactccactcccatctttggctagaacacttgcccttccgtaacctgcccaaggaggatgtgctaggcagtttatccaaaacgcctgcagggggcgctatggactcacgtctgcctcctggaagccagcggcaccctcctaggcaagctatccctgagggccgggagtggcgttagttgctgctgggtccgtcagtgtggaagccagccttcttagaagactcggaagactggtccatttggaaggactgaatcctgaattaagcctcttctccccctaggctgggagtggaggcggaaagttcagtggagaccagagagagcctccctgagaagatctggctctgactcacccgtactgatggttggggagggcggtgggttgtgatatatgagaccctctgggagaggacgaggttgtccaagttggtctctgggcctaaagggaggctggattggctctaagtctcactgtcaaacctcgactttgtcctaacccgtgggagcactgggcagagggtcaggtcccagtccaggtgagcacagacacagcctagggcggggaggggggaagggagtggcgggggacgggatggggggagactggggatccggccaccagagggcatcatgccttccacaacgagagctggctttggtggggaccagcagcgagcatcatctctatggctaggggagggtggggaggagccggagagcaggtgccagggcagtgccaagggatctgagcacctactgccacccactgcgtaggcaccatgggcagcatgtggcccaggaataatgacgccttcctcagggaatgagtacatttacaaggcaggttggcgccaacgtcgcagctctgcaccctgcctggttgcaggctgcctgcacctgacctgccaattaaccctggcaggggtatcacagccacctaatcaccatcattaagtaagggggcgtgaggactccatggctgccagagccctgagggtgagaagggcaaaggtgctaacctcttggcccctggacttctggggctcagttccaccccggaggaggcggtaggcctgagggagagagaggcggtaggcctgagggaaagagaggcgtccccgcccctgggggacagagggaagccagatgtttcctcctgctccctcacacgtggccctaacacccgccggcgcccgcagccagctccggaaacaggagtaaataatgcaggggatggggctgcggggagtgcgggagggcgctcgctctgcgggttcctgggggcagaagggatgcctccagagaaaagggagagcagtaggaatgtgagaccaagggcaaggaggctgactccctgaggactggcacttaggccgtgctggcgggtcagggcgggagggtgggggcgcccagggcaggcagggagggggagtctgcgccaggccttggctccagccctttccggcccttattgtccttggtgagaacaggacgctgtcccgttcccactgccgggctcccccagctctgctccccaggggctggggaaggatgttgggaaacaagagagagccagagacccgtagagacagagatgctgagagacacagagacagatacaaaggggaaggttcagtcaaaagcgggcattgaagcttattatgagcccagtggggcctgagcgctgtgggaactgcgaaagaatgggaagcctggaggccctgccctcagggacctccgggctggcctgccctgtgcgcactcctccttgacttaggcttactaggatctgcctcccaagcaaacaatggtgggactctcacataggcacagttggggcacttaatagctctgctttaggtacctttctttgcttttctcccagcagcctggaagtttctcagggggcagtgccgagatcgggatcaggttcccaaagccactcccgcacctcccacccccagggctgaaagccagctggccacatagaggttgctctgtaaatgctatttggttgagttcctgcagaggcagagagagaagccccccagctggccttatggttaggcatcccatcacctcgggtgaagggtcaggtggaggaggcctgaccactggcaggaggcagagttcagagctttgggcagggtttgaagagccagctgttcccaccccagcctctgcagggggccaggggcagggtgggaaacgacccacagatctcagcaactgctcccttggagacacgacttctgaaagatggagagaagtctaggtccctactgtctgtggaggtttcagatacacttggaaatgagaaaaacaggcacgtttacgtttgataaattaacacattttttttttggaagagcgtttttcccaggctggtctcaaactcctggccccaagtaatcttcctgtctaggcctcccaaagtgctgggattataggcgggagccactgcacccagccagattaacactttttcacacaaaattacaatacaattatgctatccacaagatttatttttgtttttattttttttgagacggagttttgcttttgttgcccaggctggagtgcaatggcactatctcggctcaccgcaaccttcatctgcctcctgggttcaagtgattctcctgcctaagtctcccaagtagctgggattataggcatgcgccaccacgcctggctaattttgttgcatttttagtagagatggagtttcaccatgttggccaggctggtctcgaactcctgacctcaggtgatcagcccatctcggcctcccaaagtgctgggattacaggtgtgagccactgcacctggctatccacaagatcattacagaatttatagaaaattttcctttacagggtactgcaggtcctattttataaagtcttgtgacaggaacttaaacaaatttacaagaaaaaaacaaacaaccctattaaaaaatgggcaaaggggctgggcttggtgtctcacgcctgcaatcccagcacttggggaggctgaggcaggcggatcacgaggtcaggagttcgagaccagcctgaccaacatggtgaaaccctatctctactgaaaatacaaaaattagccaggcgtggtggtgcgtgcctgtaatcccagctactcaggaggccgaggcaggagaatcgcttgaactcgggaggtggaggttgcagtgagtcgagattgagccaccgcactccagcctggatgacagagccagactctgtctcaaaaaaaaaaaaaaaagcctccaaaagtgggcaaaagacatgaacagacacttctcaaaagaagacatacatgtgaccaaaaaacatatgaaaaaaagcttaacatcactgatcattagaaaaatgcaaatcaaaaccacaatgacaccatctcttgccactcagaatggctattaaaaagtcaaaaaacgtccgggcatagtgggtcacgcctgtaatcccagcactttgggaggccaaggcgggtggatgtcttgaggtcaggagttccagattagcttgaccaacatggtgaaaccctgtctctactaaaaataaaaaattagccaggcatggtggtgtgcgcctgtaatcccagctactcgggaggctgaggcaggagaatcgcttgaactcaggaggcagaggttgcagtgagctgaggtcgtgccactgcactccagcctgggtgacagagcgagactctgtctaaaaaaaaaaaaaaaaaaaaaaaaaaaaagtcaaaaaacaacagatgcaggcaaggttgcggagaaaaaggaacgtttttactctgttggtgggagtgaaaattggttcaaccattgtggaagacagtgtggttattcttcaaagacccagaggcagaaatactatttgactcagcaatcccattactgggtatatatacccaaacgaatagaagtcattctgttataaagatacatgcacgtgtatattcattgcagcactattcacaataacaatgacatggaatcaacctacatgcccatcaatgatagactggataaagaaaatatacaccatggaggtacatatacaccatggaatactatgtttatatacgccatggaatactatatacaccatggtacatatacaccatggaatactatgcagccataaaaaggaatgagatcatgtcctttgcagggacatggatggagttggaagtcattatcctcagcaaactaacacagggacagaaaaccaaacaccacatgctctcacttataagtgggagctgaacgatgagaacacacggacacatggtgggaaccacaccactggggtctttcagagggataggggtaggggagggagagcatcaggaagaatagctgatggatactgggcttagtacctgggtgatgggatgatctgtgtagcaaaccaccacggcacacatttacttatgtaacaaacctgcacatcctgcacatgtaccccaaacttaaaataaaagttgaaaaaaaagaaatgtcttctgataataggcataccagattcattgtactattctttctacttgtgtgtgtgtgtgtgtgtgtgtgtgtgtgtatagctattctcctgcctcagcttcccaaagtgctgggattacaggcatgagccaccgaacttggccctccttttgtatatatttgaaaattccataataaaagttaaatcaattttatggtaagtccttacattctgttctatcagagtaacagcgtgactgtaaccacacttggagataacatcagaagtctgaatttgaggccttatgtgtcaataaggcctgagccaaatggccctcatggtctgtgaggagcccttctctgagaactcctctttttttttcttgagacggagtctccctctgtcgcccaggctggagtgcagtggtgcaatctcggctcgccacaacctccacctcccgagttcaagcaattctcctgcctcaacctcctgagtagctggaattacaggcgtgcaccaccacacccggctaatttttgtatttttagtagagatggggttttaccatgttggccaggctgatctcgaactcctgacctcaggtgatccatgtgccttggcctcccaaagtgctaggattacaggcgtaagccaccgcgcccagctgagaactcttatatcaggtaagttgggagagaagagctggcaaaggttaccctatccattttaggaagaggctgcactgtcagaaggagctggagggcaggattcctgtccatagaggcccagatcctacagaaataaacccttccacattccccttttctgggttaagagttactatgggggccaggtgtggtggcttatacctgtaatcccagtactctgggcggcctaggcgggcggatcacctgaggtcaggagtttgagacaagcctggctaacatggtgaaaccccatctctacctaaaatacaaaaattagctgggtgtggtgatacatgcctgtaatcccagctattcgggagattgagggaggcgaatagcttgaacccagaaagtggaggttgcagcaagcggagattgtgccactgcactccagcctgggctacagaggaagactctgtctggaaaaaaaaaaaaaaaaaagagttaccatggggcctcaggatttttcaaggaaattgctgaaaccgaggtatgtgtatgtctgtgtgtgagggtactaggagtgacgccccagggagacccctcctttctgttttcagcctccggccccagggggaaagagcccacttcttgaaatcagacagacttaatttctagttttggccctgacacttaccaggtgagggtccttgggcaaggtgagtgatccctctgcacattaagttccttaactgtaaaatggggataataatacctacctcagtgtgtggtaacgtggattttaattaaataacagtgcagaagagcctagcattgcacttgacatactaggcatttgacaaacattatttcttccctttgtgatgacaacaactacctttaattgaacatttaccacttgccagtcactgtactcatgctttatagatatcctcaattttaacccttccaccaacctcataagagcaatattcttacttcatgtgatggttaattttatgtgtcaagttggctgtcacagtgcagtgacagaatgtggtcattcttttggatatttcagtgacagtgttttgggatgagattagtatttaaggctgagtgaggtggctcatgcctataatcccagcactttgggaggtgtgggcgggtggatcaccagaattcgggagtttgagaccagcctggccaacatggtgaaaccctgtctctactaaaaatacaaaaattagccaggcatgggccgggcgtggtggctcatgcccgtaatcccagcactttgagaggccgaggcgggagtatcacgaggtcaggagatcgagaccatcctggctaacatggtgaaaccccgtctctactaaaaatacaaaaaattagctgggcatggtggtacgtgcctgtagttccagctactcgggaggctgaggcaggagaatggcatgaacctgggaggcggagcttgcaatgagccaagaccgcaccactgcactccagcctgggtgacagagcaagactccgtctcaaaaaaaaaaaaaaaaaaattagccaggcatggtgtcgcaggcctgtaatcctagccacttgggaggctgaggcaggagaatcacttgaactggggaggcggaggttgcagcgagctgagattgtgtcactgcactccagcctgggcatcagagcaagactctgtctcaaaaaaaaaaaaaagagagagagagagtgaaagattagtatttaaatatttaaattggtagggtttaggtaaagcagattgccctccatccatgatgtgattgggtctcatccagtcagttgaaggttcaaacagaacaaacgactgaccttccctgagcaagagggagtttagaagcacgtagcattgagacttgaactgaaccttgactcttctctgggtcttcagtctgcccacaaccctgcagatcttggatttaccagcctccataatggtgtgaaacaattccttttttttttttggcagagatggggtctcactctcacttaggtttgaatgcagtggcactgttataggtcatgcagcctcacacttctgagctcaagtgatcttctcatctcagcctcccgactagctgagactacaggcaagcaccaccaggcccagctaattttttattttttatttttttgtagagacggagtcttgctatgttacccaggctggtctcaaactcctgggctcaagtgatcctcccacctcggcctcccaaagtgctgagattacaggagtgagccactgtgcctctccctctctttctcttgccatatacatacacatggaaagagagagagttcctgaggggcagcaccaggatcacacacacacacacacacacacacacacacaccctattggttctgatcatctggagaacccttgactaatacaccctgtttcagtaaaatgaaatggggttaaatgaaagaaaggctaatctgctcaagattatacacaaccgataaatgaaggcggaattggagttcacattcagatccatctgtgcccaccatgttgcttaaccagcatgactacagtgcatggttacaacacaccatctggctcctgccacctctctgatgtcgcctccttgctctcttccccacactcactccatcctgcccccagaccctgcatgtcccctgtgccaggcacgtttccacctcgcggcctttgcacttgctgttcctgtgcctgaaacgctttctcagcagatatctacacttctctcttctgtatgtcattcaggtctctgtgcaaatgtctccttctcagacaggcctttctgatcgtgctatatgacacagtacagcctgtcaccttctagccccttaccttgctatacttttcttcatagtacttttcactacttggtgaatatatgttatttttatttttagtagagatgaggtctatgttgcccaggctgaccttgaactccggcctcaagtgatcctcctgccttgggctcccaaagtgctgggattacaggtatgagccactgggcaggtttagttggtatattaaatgtttatttttgtcttgtctgtctcccatcactagagtataaggttcattgaaggcagagaatttgtctattttgtccactagaatgctgtttggcatagagtaggtgttcaacaaatgtttattaaaagaagaaccaagggccaggtgccgtggctcacgtctgtaatcccagcactttgggaggctgaggcgggcagatcagctgaggttgggagatcaagaccagactgaccaacacggagaaaccccatctctactaaaaatacaaaattagctgggtgtgttggcacttgcctataatcccagctactcggggggctgaggcaggagaatcacttgaacctgggaggtggagtttgtggtgagccgagatcgcgccattgtactacagcctgggcaacaagagcaaaactctgtctcaaaaaaaaaaaaaaaagaagaagaaccaagaaccccattggcaacacaccactcttgtactttgagccctttgttgaaactcaacttctaccctgcatcaactccaaattgctgaatcctcagaatgatccagatgtttttctcagctgctcagacctgttcctgagtctgtccaccttcaggctatcatattttcccatcttcgtctcttgtagcttaccttctctaggaaaccctgactcacccagccccttctccactactccccttttaaaagtttgtctgtgtttttgttaattgcatgtgcttttgtcctgttgccctatggaactgtgggtgccctgagggcagggatgaagtcaacacaacctgactacctgaaaccttccccaaggacctagtaattaccttgacacctgtggacatccagaaatccctactgcctgacaggcatacaaggggggctgcccacccctctaaggggtggggccactactcagggaccaacttggttcacaccgttctcctgcctcagcctcccaagtagatgggactacaggtgcctgccaccacgccccgctaattttttgtatttttagtagagacggggtttcaccatgttagccaggatggtatcaatctcctgacctcgtgatccacctgcctcggcctcccaaagtgctgggattacaggtgtgagccaccgcacctggcggttttatttgttcttattggatagatggtccccaacttatgatggttcaataaatgattttttgattttacaatggtgtgaaagcgatactcatttgatagaaaccccaacttgtgtacccatacggccattctgttctcactttcagcatagtattcaataaattttatgagatattcaacaatttattataaaataggctttgtgttagatgattttgcccaactgtaggctaatgtaagtgggttttgttttgttttgtttttttgagatggagtctcactctgtcgcccaggctggagtgcagtggcacgatctcggctcactgtgagctccgcctcccaggttcacgccgttctcctgcctcagcctcccaagttgctgggactacaggcgcccaccaccacgcccagctaattttttgtatttttagtagagacagggtttcaccatgttaaccaggatggtctcgatctcctgacctcgtgatctgcccgccttggcctcccaaagtgctgggattacaggcatgagccaccatgcctggccagggtaatgtaagtgttttgagcatgtttgaggttggctagtccaagctatatgtttggtggtttaggtgcactaaactcacttcgacttacaatatttccaacttacgatggacttatgggggtgtagccccatcagaagtcagtcgagaagcatttgtataataaagtgtcaacagttggaagattagcatcactcagtgagtcaatattaatatcttcaaatattacaaaattatgcaagagtaaaggatctatgcaaagtgcaagagaaaccaatgaatcataatgtaacagagtatgaaaagtccactgatacagttttatttatttatttatttatttatacttgtttaaaattgtggccaggtgcggtggctcatgcctgtaatcccagcactttgggaggccgagacaggcagatcatttgaggtcaggagttcaaaaccagcctggccaatatggtgaaaccccatctctactaaaaatacaaaaattagccagacatggtggtgggcacctgtaatcccagctacttgggaggctgaggtaggagaattgcttgagcctaggaggcggaatttgtagtgagccgagatggtgccactgcactccagcctgggcgacagagcgagactgtcaaaaaaaaaaattgttttatttttaatttttgtgggtacatagtgggtgtatatatttatgaggtacgtgagatattttggtgtaggcatgcaaggcgtaataatcacatcatggaaaattaggtatccattccctcaaacatttgtcctttgtgttacaaacaatccaattatcttcttttagttattttaaaaagtacaattaaattattattaactataatccccctgttgtgctattaactacaaggtcttactcattctagctattttttgtacccattaaccatccctacatccccctactatccttcccagcctctgataaccatccttctattctccatctccatgagttcaattgtttttatttttatttttgtttttttacttatttttattttattttattttatttttattattattttttgagatggagtctcgctgtgttgccctggctggagtgcagtggtgcaatcttggctcactgcaacctccgcctcccaggttcaagcgattctcctgcttcagcctcccaagtagctgggactacaggtgcgtgccaccatgcccggctaattttttgtatttttagtagagatggggtttcaccatgttagccaggatggtctcgatctcttgacctcgtgatcttcccacctcggcctcccaaagtgctgggattacaggcgtgagccatcgtgcccggcctgtttttaattttttatgtattttttgagacagagttttgctcttgtcgcccaggctggaatggcgtgatcttgggtcactgcaacctccggctcctgggttcaagtgattctcctgcctcagcctcctgagtagctgggattacaggtgccagccaccatgcccagctaatgtttacatttttagtagagatggggtttcaccacgttggccaggctggtcttgaactcctgacctcaggtgatccacccacctcagcctcccaaagtgctgggattacgggcatgagacaccacccctggtctgttttgatttttaggacccataaataagtgagaacatgtgatgtttgtctttctgttcctggcttatttcacttaacataatgacctccagttccatccatattgttgcaaatgacagaatttaattccttttttatggctgaatagtactccattgtgtatatgtgccacattttccttatccattcatctgctgatggacacttaacgtgcttccaaatcttgactattgtgaacagtgctgcaacaaacatgggagtgcagatatctctttgatatactgatttcctttctcttttggtatacacccagcagtgggattgctgaatcacatggtagctctatatttagtttttttgaggcatctgtaaactctgcttgcactaatttacattcccaccaacagtgtaggagggttcccttttctccacatccttgccagcatttattattacttgtcttttggatataagccattttaactggggcaagatgatatcccattgtagttttgatgtgcagttctctgatgatcaatgacgttgagcacctttccatatgtctgtttgccatttgtatgttttcttttgagaaatgtctactcaaatcttatgcccattttaaaatcagattattagatttttttcctaaagagttgtttaagctccttatatattctggttattaatcccttatcagattgcaaatattttcttccattctgtgggttgtctcttcactttgttgttatttcctttgttatgctttttaacttgatgtgatctcatttgtccatttttgctttagttgcctgttcttatggtatattactcaagaaatttttgcccagaccaatgtcctggagtttcctcaatgttttcttgtagcagtttcatagtttgaggtcttagatttaagactttaatccattttgattagatttttgtatatggcgagagacaggggtcaagtttcatccatttttttttcctgtgcaatctgcctcccttgtttcattcttctgcatatgaatatctagttatcccagcaccatttattaaagagaatgtttttttccccagtgtatgttcttggcacctttgtcaaaaatgagtttaccataggtgtataaatttgtttctgggttctctattctgccattggtctatgtgttcgtttttatgccagttccatgctgttttgcatactatagctctgtagtgtaatttgaagtcaggtaatgtgattcctccagttttgttctttttgctcaagatagctttggctatcctggatcttttgtgattccatacaacttttaggattgttttgtctattttcgtgaagaatgtcattggtagtttgatagggatttctttgaatctgtagattgctttgggtagtatagacattttaacaatattgatacttccaatccaggaacatggaatatctttctatatttttgtgtcttcttcgatttctttcatcagtgttttattctttttctttcttatttatttatttatttatttatttttgagatggagtctcacactgttgcccaggctggagtacagtggcgtgatctcctctcactgcaacctctgcctcctaggttcaagtgattctcctgcctcagcctcctgagtagctgggactacaggtgcacaccaccacccccggctcatttttgcatttttattagagacaggatctcagcatatttgcccggctggtcttgaactcctggcctcaggtgatccacctgcctcggcctcccaaagtgctgggattataggcatgagccaccgtgcccagcctttctttcttatttatttttgtagagatgggatctcactatgttgcccaggctagtctcaaactcctaagctcaagcaatcctcccactttggcctcccagagtgctggcattacaggcatgagttacagctcccggcctcatcagtgttttgtagttttcattgtagagatctttcacttctttggctaagttaattctgaggtatttaactttattcatggctattgtaaatgggattactttcttgatttctctttcagattgttaacgattgacatagagaaatgctactgatttttgtatgttgactttgtatcctgcaactttactgaatttgtttatcagttctaatgtttttttcgtgaagtctaggtttttccaaatataagatcatatcacctgcaaacaaggataatttgacttcttcctttccagtttggatgctctttatttcttttttcttttttttttttttgagacagagtttcgctcttgttacccaggctggagtgcaacggcgtgatctcagctcactgcaacctctgcctcctgggttcaagcgattctcctgcctcagcttcccaagtggctgggattacaggcatgtgccaccacgcccagctagttttttatttttagtagagacggggtttctccatgtttggtcaggctggtctcgaactcctgacctcaggtgatccgccagcctcggcctcccaaagtgctgggattacaggcatgagccaccacgcccagtcctctttatttttttctcttgtctgattgctctagctaaaactttcagtactatactaaataacaacggtcaaagtgggcatccttgtcatgttctagatctaagaggaaaggctttcagtttctctgcagtcagtattttactagctatgggtctgtcatatatggcatttaatatgttgacgtatgttccttctatattcattttttgagggtttttatcatgaagtgatgttgaactttatcaaacattttcttagcatcaatcgaaatgattatatggtttttgtccttcattctgttgatatgatgcatcacattgattgatttgcataagttgaaccatccttgcatccccgggataaatcccacctggtcatgatgaatgatctttttaatgaattattgaattttgtttgctagtattttgctaagaatttttgcgtcaatatttatgagagatattggtctgtagttttcttttcttcatgtgtctttgtctggttttggtatcagtaacaccagccttgtataatgaatttggaagtattccctcctcctctatattttggaacagtttgagtaggactggtattagttattctttaaaattttttttcttttttgagacagagtcttaggccgggcatggtggctcacgcctataatctcagcactttggaaggaatcccagcctgggcaacagagtgagactgtcttggtttttttgttttttgtcttttatttggagatggagtttcgctcttgttgcccccaggctggagtgcaatggcccaatctctgctcacttgcaacctctgcctcctgggttcaagcaattctcccgcctcagcctcccgagtagctgggattacaggtatgcaccaccatgcctggctaattttgtatttttagtagagacagggtttctccatgttggtcaggctggtctcaaactcccaacctcgggtgatctgcccacctcggcctcccaaagtgctgggattacaggcgtgagccaccgtgccaggcctaatttttgtgtttttagtagagatggggtttcagcatgttggccaggctggtctcgaactcctgacctcacgtgatccacctgccttggcctcccaaagtgctgagattacaggcgtgacccatcatgcctggcctctttctttctttcttttttttttttttgtttgagacagactcttgctctgtcgcttaggctggagagaagtggcatgatctctactcactgcaacctctgcctctcgggttcaagctattctcctgcctcagcctccggagtagctgggattacaggcatgcaccaccacgcctggctaatttttgtaattttagtagagacagggtttcgccatgttggccaggctgctctggaactcctgacctcaagtgatccaccaccttggcttgccagagtgttgggattacaggcgtgagcccctgcgcctggatttttttttttttttttttttttttaataaagacagggtctctctatgttgtctaggttggtctccaactcctgggctctagcaatcctcccacattggtctcctaaagtgctgcgattacaggcatgagccaccatgcccagcctactgggagactgtattacagctctgatctcgtgacttgttattgctctatttgggttttggatgtcttcatggttcaatcctggtaggttagatgtatctaggaatttatccatttcttctggattttgcaatttattggcatatagttgctcatagtagccactagtgagcccttgaatttctgcggtattagatgcactgtctcctttttaatctctgattttatttatttgggtcttttctttttcttttcttagtctggctaaacgtttgccaattttgtttatctttttaaaaaaacaactttttgttcgttgatcttttttatttcatttatttatttattttttgagatggagtctcactctgttgcccaggttggagcgcagtggcgcgatcttggctcactgcaagctccacctcccaggttcaagtgattttcctgactcaacctcccgagtagctgggattacaggcacccgccaccatgcccggctatttttttgtattttttgtagagatggggcttcgtcatcttggccaggctggtcttgaactcctgacctcatgtgatctgcccgcctggacctcccaaagtgctgggattacaggtgtgagccactgcgcctggcctgatcttttttattttatatttttatttttattatttctttttgagatggagtctcactctgttgcccaggatggggtgcagtggcacgatcttggatcactgcaaaccctgcctcccaggttcaagtgattctcttgcctcagcctctggagtagctgggattacaggtgcatgccactactaccagctattttttgtatttttagtagagatggggttttcttcatttcaaattcatttattcatttctttctttctttctttccttttttttgggggggtgggggagagaggggacagagtcttactctgttgcctgggctggagtgaagttgtgtgatctcagctcactgcaatctccgcctcccgggttcaagcaattctcctgcctcagcctgagtagctgggactgcaggtgcatgctgccacagccagctacttttttgtattttagtagagacagggcttcactgtgttgcccaggctggtcccaaactcctgagctcaggcaatctgccccgcttggcctcccaaagtgctaggattacaggcgtgagccaatgcgcccggcccaaattcatttatttctgatctgaaccttattatttattttcttctcctaattttgggttcagtttgctctgcctcttcaagttctttaacatgcatcattaggttatttggttgtttttcttcttcctctttttttttttttttgagaggagggtcttgctctgttgcccaggctggagtgcagtgtcgagaatcatggccaacagcagcctagaccacccaggctcaagtgatcctcccacctcagcctcccaagtagctgggactataggcacacaccaccccgtctggctaatttttgtatttttgtagaggcaaagttttgccatgttgccaaggctgtttttcctcttttttgatgtaggcacttatagctataaatttccctcttagtactgctttcactgtattccataggtgtgttagtacgttgtgtttctattatcatttgtttcaagaaatttttcaatttccttcttaatttcttcattgacccactggtcattcaggagcatattgtttaatttccatgtatttgaatagtttccaaaattccttttgttattgatttctagttttattccactgtggtcagagatgtttgatattatttcaatttttttgaattgaatgttttaagacttgttttgggagtaacatatggtctatccttgagaatgatccctatgctgaggagaagaatgtgtgttctgtagccattggatgaaatgttctataagtatctgttaggtcaatttgttctgtagtgcagattaaatccgatgtttctttgttgattttctatctgggagttctgtccaatgctgaaagttgggtgttgaagcctccagctgtttattctttttttttcccccaagcctaactgtatccagttttattaaagatactttgcataaacaatcatggtatttcaggcaggacatgggcagacaatcattaacagtatacaacaactttcaaactcccttcttcaatggactaccagaaatcagaaagccactataaaacccaatgaagtcttcatctgatgatctgaacagggaaagtttagagtgagagttgacatttcacatttagcatgttgtttaacaacttttcacaagtcaaccctgactttcaggaagtgaaattaaaatggcagaatttatctgaagatctacaatctagaaacagaaccactacttttttttttttttttttttttttttttttttttttgagaggcagtctcgctctgtcgtgcccaggctggagtacggtcgtgtgatctcggctcactgcaaccttcgcctcccaggttcaagtgattctcttgcctcagcctcccaagtagctgggattacaggcatccgccaccacacacggctaattttttgtatttttagtagagaagggggtttcaccatattagccaggctggtctcaaactctcgacctcaggtgatccgcctgcctcggcctcccacagtgctgggattacaggcgtgagccaccacaccccgcaccattgctcttttgacaggtgccatctcagtgacatcactggaaagtccagattgcctgacacactagtaaccaatgattggaggtcaggttccaatagatgtctgggcttaagggagttaagtctatgctgaaagatggaaagggagaagaggacataaaaacaaatttgcttttccctttcacaaggcttttgtgccaaggtggccatgtgtgtcaaagtcagggaatccctcctcctgggagccaagaggaagtctctcggaactagaaggaaaagacgatttccccatatcaatccagcttcagagacattctattagtgacatttgctccttctcctaaaagcaacaatgaagtgttctgtgtgctaacaacatagcttaaaaaaaaaaaaaaaatctgggccgggcgcggtggctcacgcctgtaatcccagcactctgggaggccgaggtgggcggatcatgaggtcaggagattgagaccatcctggctaacacggtgaaacctcgtctctactaaaaatacaaaaaattagctgggcgtgctggcaggcgcctgtagtcccagttactcgggaggctgaggcaggagaatggcgtgaacttgggaggcggagctcgcagtgagccgagatcacgccactgcactccagcctaggagacagagcgagactccgtctcaaaaaataaaaataaaaaataaaaaataaatttaaaaaatctgcatttttataaaacttgatacaaaatagtatttcaaactgtacactcaccagaagtacacagttatcaaaaatgcacacacttcctctggcatctccagcaccttcagctttctgttcctggtctgttttggcatctccattttctgcagggttattcccctcctttccagcatcagcttttcccttcttctctttgagtaccttctctcccttctttgcaggggcctttttaggcttgggctctggctttggagaagaaggtttagcagacaacctcgcggatctcctttgtggttcgtccttcaccttggctttatctcctttaggatccccttcagcctttcccttgggcatggtggtggcaacagcgacgggatgtaggcgctgggcacgcgggtcggtctgggggtcattcttgtatcttcttcttcttctattctttagctctaataatatttgctttatatatatggatgctccactgttggctgcatatatatttataatgatcataacctcttgctgaattgacccctttatcattacataatgagcttctttgtctcttcttacagttttatcttgaaatttattttgtctaatataagtatagctactcctgctctgttttggtttccattggcatggaatatcttttccctttattttcagtcctatatgtatctttacaggtgaagcgtccaacagaaatacttttattttatttttttgagacagagtcttgctctgtcacccaggctggaatgcaatggtgcaaccttggctgactgcaacctccacctcctgggttcaagcaattctcctgcctcagtctcccaagtggctaggattacaggtgcatgccactgtgcccggctaatttttgtatttttagtagagacagggtttcaccatgttggccaggctggtctcgaactcctgaactcaagtgatctgcccgcctcgaccaaccaaagtgctggggttacaggcatgagccacctcgcccagcccacacatacttttaaggggtctttaatcacttgaccctggccagcttttccaacctcatccttgccactgcccccatgaaacattctttgtctcagacacagccacaaaagattgcccaccatgaactttcaggcctctcattcaagctgttcccttggccttacatgccccctcccctcacctaaacaactcttactcatctttccagtatcaactcaggcttctgggcctctatgaagccttccctccagatagtcccttccttctctgtgttctgtttaactttgcatatccttttatcttcagtacagaggctcttagatttggaatttgtcttccaaattgtttgactgggctcaagcaatcctcctgcctcaggcgctggagtagctagcactataggcatgctctaccatgccagctaaaatttacatatatataatatatgtatctatttaatagatacataaatatgtatctatttaatagatacatatttaaatatgtatctatttaatagatacatatttaaatatgtatatattttatagatacatatttaaataaaatatatattaaaaaaattttttttgagacagagtcttgctctatcgcccagactggagtgcagtagcatgatcttggctcactgcaacctctgcctcctgggttcaagcaattctcctgcctcagcctcctcagtagctgggattacaggcgtgcaccaccacacccagctaaattttgcatttttagtagagatggggtttcaccatgttggccaagctggtctcgaactcctgacctggtgatctgcccacctcagccccccaaagtgctgggattataggtgtaagccaccatgcccgtccatttttaatatttttttttatagagacaaggtctcactatgttgcccagtctggtctcaaactcctggcctgacacgattctcttgccttgtcctcccaagatgctgggattacaggtatgagccaccatgcccagcaaaagccccaattaaaaaaaaaattattattatttttttaaccatgacacagcctcaggaggtcctgatgacatgttccccaaaagccccaatttttaactcccaagctgctctgcctctcatatcctattgtaatcacatgtacttcatcctgaggtggtagtggaagggtaatgatctgcagaaagactgaagagaaaggagttggactgtaagaatattctgtctcttgtccagtgctatccaaggccaaacaccctgtgtctggcagactggggtctctggagtagttgtatttcctgggaccaggaaagctagctcagtttttctggagaccatctaatgccaaactgtccttctctctctcgctcactcatcatacatttatagaaacccggctacatttcccacactgtgcttgatcttgggaatacaatggtcctgggggcaggacaggcagagaaagaaaacccctacagctcaacatggttattgccatgaaagtcaataaaagaaagtcagtgagagcaggaggagggagatgggggccaaccctgcaggacagaatcaaggcgcaggaaggctgcctgggagacatgatacttgagctgagcattagagaaacatgcaccacatttgcttgcagcatatttagagtttcactttttacattaaaattgttttgggcggggcccggtggctcacacctgtaatcctagcactttgggaggccaaggtgggccatcacaaggtcaggagatcgagaccatcctggccaacatggtgaaaccctgtctctattaaaaatacaaaaatcagctgggcatggtggcgtgtgcctgtaatctcagctactcaggaggctgaggcaggagaatcgcttgaaccagggagtcggaggttgcagtgagctgagatcatgccactgcactccagcctggcgacagagtgagactccgtctcaaaaaaagaaaaagaaaaagaaaaaattgtttttattgctctgggtctttgttttggtataagatgtgaggttcaaatctaccttaattttttttcaaatggtaagctagttgcaaatgcttttcaaacaatccatctttcctcactcactcaagatggtgcctctatcatatgctacattggtatatatgcctgatctattttctctttttattatgttccatcaatctagggaaggaggcgctagactgcagtggtaaagtatgcaggctctggaggaagatcggctgggttgtgcctcagtgtcctcatttgtgaaacggagatagtagtacttatttcttttttctttttctttccttttttctttttctttttttttttttttgagatggaatctcactctgttgcccaggctggagtccagtggcatgatctcggctcactgcaacctccacctcccgggttcaagcaattctcctgcctcagcctcccgagtagctgggattataggcatctgccaccacccctggctaattttgtattttcagtggagacctggttttaccatgttggccaggctggtctccaactcctgacctcaagtgatccacacacctcggcctcccaaagtgctggcattacaggcgtgagccaccgcgcccggccagtagtacttatttcgcatggttgctgtgaagattgactgagataatgcacataaagcactcatcacagtgcctgacacataggaatcatagtgacatagagctgacacatagtgaatgtcagctgttgtgatgaaccctaactgcccattcctgtagcagcaacacagtagaatgaaagtgctaagaatatagttttgggtccaatgaaacagctttgctgtttactatctgcacaaccttgagctagttacttaccttttgccctctctgtgtcatggtttcctcattcatacatgggaatagaaaagtacctacttcattcggctgggtgcggtggctcacgcctgtaatcccagcactttgggaggccgaggcgggcgaattgcctgaggtcaggagtttgagaccagcctggccagagtggtgaaaccccatctctattaaaaatacaaaaattagctgagcatggtggcaggtgcctataatcccagctactcgggaaactgaggcaggagaatcgcttgaacccgggaggcagaggttgcagcgagctgagattgtaccactgcactccagcctgggcgacagagcaaggctctgtctcaaaaaaaaaaacaaaacccaaaaaacagaaatactttataatttattatctatccttatatgtggtggtgtaagcccctaaaatgttctggggagtttcagggccaagtctactgtgtatgaataaaatggactttctggatctgcatctgcaatgctcgtgtccagcccctgtaagtataccaatatttgaaagtcattgtgaccagtgagtccttgattgagaaaccagaaagatttggtgtggaaatggaaatgtggctagggctttgaaggtcgtatagcaggtttaaaaacatttttttttttttgagacagagtctcgctctgtcacccaggctggagtgcagtggcacagtctcggctcactgcaacctccgcctcccgggttcatgccattctcctgcctcagcctcccaagtagctgggactacaggcacccgccaccacgcccggctaattttttttttttttttgtatttttagtggagacggggtttcaccgtgttagccaggatgatctcgatctcctgacctcgtgatccacccgtctccacctcccaaagtgctgggattacaggcgtgagccaccgcacccagcctaaaaaatgtttttcgctaggagcggtggctcacgcctgtaatcccagcactttgggaggccgagggggcgaatcacctgaggtctggagtttgagaccagcccggccaacaaggtgaaaccccaactctactaaaaatacaaaaattagccaggcatggtggcaggtgcctgtaatcccagctactcgggaggctgaggcaggagaattgcttgaacccgggaggcggaggttgcagtgagccaagaccgtgtcatttcaccccaacctcggcgacaagagcaaaactccggctcaaaaaaaaaaaaaaaaaaagtttgggctgagcgcggtggctcacgcctgtaatcccagcactttgggagtccgaggtgggaggatcacaagctcaggagttcgagaccagcctgaccaacatggtgaaaccctgtctttaataaaaatacaaagatttgctgggtgtggtggtgcgtgcctgtagtcccagctacttgggatgttgaggcaggctaatcgcttgaacatgggaggcagaggttgcagtgagctgagatcatgccactgtactctagcctgggccacagaacgagactctgtctcaaaaaaaaaaagaaaagtttttatttgttttaatttttactttaacaaaggaatttgtatagttttaaaagccaactagttcaacaaatatttttcggggtggcggggcattttcaagtgaaaaccgggaaacctgctcaacaaattctgaaagctgtaacttcggtgggcgccgtggcttacgactgcaatagcagcactttgtgggggctgagatgaattgcttgagcccaggattttgagaccagcctgggcaacatagggagaccccgtctacacacacacacacacacacacacacacacacacacacacacacactagatgggcgtggtggtggtggcccacttctgtagtccctgctactccagagtctgaggtgggaggatagcttgagtccaggaggtcgaggctgcagtaagccatgtttgcaccgctgctctccaccctgggcaacagagcaagaccttgtctgaaaaaaagaaaaagaatagaaaaaaaaagagctgtaactctacaaggcttttaatgaaaaataaccatcccctgctcctcttctttaacccttacatatacaacctacatatacaactacgctccagtttctaggctgcttcttctggtacttatctgtacatttcttcaagcaacactcccacctaggcctcccaaagttctgggatcacagctccactgtccccagctccaatttttagttaaatcaatacttagtgtttacatcgttacggctgtgaaaattttcttcacagctgagccatttgtgtttgtgctaagactgtgaatctgtaaaaactgcttttgttaattaacatccaggacatacggctgagaaacttcattttctaaaatcatagtcacaaactttgctatttgaaatcagtcagtgcgaatggaacatcctactcttgccagaagttctgagccacgtggattactttggcctcccaaagtgttgggattacaggcacgagccactgtgcccagcctagatagtgggtttttggacactatattctatatttatcttgactttgtaatttccaagtggtccctcagcttggacttcttgatcccttcacttaaagttatgcttacctcgaaccgatcaaaacactgtttcatttaaattttagctagcctatagtatcagccacttgggaggctgaggcaggaggatcacttgagcccagaagtttgagcttcgcctgggcaacataccgagacttcaactctaaataaataagtaaataaattttaaaatataaattttaaagtcaagcctttcccatatcctgttgtattagttcattttcacattactgataaagacatacccgaaactgcaaacaaaaagaggtttaattggacttacagttccacattgctggggaggcctcagaatcatggcgggagacaaaggcacttcttacatggcggtggcaagagaaaaatgaggaagaagcaaaagcagaaacccctgatgaactcatcagatcttgtgagacttattcactatcatgaaaatagcacgggaaagtctggcccccgtgattcaattacctccccttaggtccctcgcacgtgggaattctgggagatacacatcaacttgaaatttgggtggggacacagccaaaccatatcatctgaatgaccatatttcttcctttttaatgagttgccccacagttcttctagtgtgtgatctctctgttgtggcaagttaataaacctaactgtcaaactacagatgtggtctttataagacaggcttatcaattgtctttcctttcttatataactctttgtttcctctgaagttgataattgcctaaccttttctcttactttgttctctctctctctttctctctatacataataaattcatccccaaaactgttctaaagaattatactctttctttcaatgccttcaccacttcaggtaattcttctggtctttcttttcttttctttttttttgaaacccagactcctggagcccttcttcctctggctccaagttatattggttgttgtccttgtaaaaatatgactacctctgttctaacaataatctcaagccttcatggttagttgtcaatgcaactgcttcactgactcctgctttccccctccacctgaaaggggtcgagtctcttgacatctctgtatctccaaagtctatcatggtaatcaagaaatgttctggccgggcgctgtggctcatgcctgtaatcctagcactttggaaggctgaggtgggccagtcacttgaggtcaggagtttgagaccagcctggccaacatagtgaaatccccgttctctgctaaaaataaaaaaattagcccggcgtggtggcgcgcgcctgtaatcccagctgctcgggagacagaggttgcagtgagctgagatcgagccactgtactccagcatgggcaacagagcgagactttgtctcaaaaaaaaaaaaaaaaaaaaaaaaaaaaaaaaggagttctgtcccgcctaggcactatagagagaccctgtcaagaatggaaagaaagaaatcttcgaatgaatgaactagtgaatgaaggaatggatttcagcgctggagaattgagtttaaggggaatggtattatattcccatcttgttgcaacatttaaggatgtcctcaagccccacgccagcctggagcgtagcccaaggtgggaaagcagcgccgaggcctctccagacccggcctgctccccgtttgcggagcacagcccactgtacccccgcctagattgaggcgctggccaggagtacaccaggcgccgccatgtgaactacaactcccagaaggccgcgcggaagcggaacgtgaaccagggaggacttccggacgccaacatccgggccgcgcggggaaggggagacgtggggtagaggtaagtgtaggttgaaggctgaatggggagggcgagagatggggagtgggtctcaaatatagagggggtagcaaggtggaaggggcccttccaccttttgtgggcactcaagttcggacctctgggatcggcgattcccctctggccagggctggttttaatgctctccgtgggcgggcttcggttgagtttggtccgcttttcctttctgctcctcaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaacttcgtttagtttgagtatggaaaacgggtattggggattctatgtactaacggtcgagaagtgaatgtgaaagaaccaccttcttgaggccatctcagcctttatctttgcatcttgctggtgttcccatttttgctcccaaggaggcaaagaccccttctcaatatttctcaggatggaaatgacatttcactttcctggtcctttcaaccctgtaggaagtacttctttttttttttttttgagacggagccttgctctgtcgtccaggctggagtgcagtggcgtgatctcggctcactgcaagctccgcctcccgggttcacgccattctcctgcctcagcctcctgagtagctgggactacaggcgcctgccaccacgcctggctaattttttgtatttttagtagagtcggggtttcaccgtgttggccaggatggtctgatctcctgacctcgtaatccgcccgcctcggcctcccaaagtgctgggattacaggtgtgagtcaccgcgcccggcgtactacttctttttttttttttttttgagacagggtctcactctgttgcccaggctggagtgcagtggtgcaatcatggctcactgcagcctcaccctcccaggctcaaacagttctcccacctcagcctccagagtagctgggactacaggcatatgccaccacgccaccaggctaatgtttaattttttgtagtgacagggtctcgctgtgttgctcaggctgttctcaaactcctgggctcaagtgatcctcctgcctgggcctcccaaagtgctgtgattacagacataagccaccttacccggccagaagtactttcttgaagcctaagttccattcttcataacatccaagttttgttatttttaaggccttcctgggtctttccaaccttttggttctttgagataccttttctgagcctaccctaccaacctgagaataactgtggatctatccttcaccaaaccaggcaggtttagaattatgagtagagaatgaaccatcgtgggcaggggtggggaacactttattttaaggcatattcatatcagcatataaggcatattcatatcacaatggcacgatctcagctcactgcaacctccacctcctgggttcaagcaattctcctgcctcagcctcccaagtatctgggattacaggcatgtgccatcatgcctggctaattttgtatttttagtagagatggggtttcaccatgttagtcaggttggtcttgaactcctgacctcaggcgatccgcccaccttggcctcccaaagtgctgggattacaggcgtgagccaccgcgcccggccttttaaggcatattctaaagattgcaccccaacctccaaaattaaaaaaaaaaatctctaaaaaataaaaagtgatttcatctcctaggccccaatcaatcatctaagtaaagctttttctttggtccttttatcctcaaagtcatctcttgttcccacaacccactgcacctgggaagctggacagcaggcccagctgaaacaaggaggtctctttggttcaggttggcactaaggtgcccagtggtcagatgagcagcctcaggtttgcaggagccagtagttcctgtcttgctcctgggggtacttccagaaaagccagaagcggataaagctggtgacgattcctggaaagttggacacctgaaatcacaagaactgctatgaggagaggagccagttttccatcttgcacccctgtcaccccatcccagttgtgcttaccatgatatagggatctctgagtcgaaacccatagaggcaccaggaggcagaggtgagaagggtagcaatggtgagtgggtaggagagacattgggttgatttagtttgaatcaccttagcctgtgggaaagaatggaagactctcttggcccaagcacatcgtaaagcttcacttgcctaagaatttcctcaagaaaaaggtcagacaccctccctgatctgtcacccaacctttcctgcctcccactcgcccacttctactgccttgtcttcttccagggtttggatctccccttcctcgggactgtaagccatagtatttggctatgagagcctgactcttatctctcctacctccttggacacccccactcaccaagtcagccagtggtgagaggtacatgctgatggtgaagacactgcagaagaggcccaactgctgaagccgggcctcagggttgggtaccaggagccaaaagtagccataacccaggagaaggacccctagcagggttgcagtctgtaggagcacaacacgctgcaggggagagagtacccttacttccagatgtgcactctgacttccctgctagagttaattcatcctgccttctccagtgctccaatggggaagccaagctgtctaggcctccagcactgcactgtcacagcttctttcccaccaccaacttgataggaaagtcttatccacccacaacactggagacttctgggggagataaatatgtgtttttttctgtgtgcttggcacacacagtaggagcttcataaatgcttgtgtgatttagcagggacgcagagctaatcatctcattctcacccacaggccctggctctgaaagaaatatcagagacaaaagccctttccccttagcttgttggctgaagcccagggcaggcagcataggcatctcaggctaggcagagctaccagccttgcctaaatgggggcaatgtgttcatctcagaaggctggcttcatagaggaaggggacctgcaaggctggagaggccttcctggaaaaggtggcagtgccagctgttacagtcttctaggaaatagtgtttgccctgccagcaaggcagggcgtgcagcagataggtgggtccaagggagggcctctaccttccgagggcagtaatgcagatatgccaagatatacagggtctgaagcgcagcacccactgtgttgacgacgatgaggatcccgtctcccttcaaagccccataactcagccagcccaggttgctgcagggtggaggggatggacatggctcaaagggttcagtgtgagaggaggacccaaagggtctttcactctttttttttttttgagacgtagtctcgctctgtcgcccaggctggagtgcggtggcacgatctcggctcactgcaagctccgcctcctgggttcacgccattctcctgcctcagcctcccgagtagctgggactacaggcgcccggcaccacgcccggctaattttttgtatttttagtagagacggggtttcaccgtgttagccaggatggtctggatctcctgacctcgtgatccgcccgtctcggcctcccaaagtgcagggattacaggcgtgagccaccgcgcccggccaaacctctttcactcttgctcctcctgccccgcccccacctccctctggtagcctttcccactaccgcagccgtcggcccctcacttgacttccgtggtgagaaagggcaggaactggacgttgtccacactccgggtcattcgcatgtgcctgaggtccgagctgtaatggggccccgaagggaggggtgggggtgggaagggagaagcagagtgctagagggggatgcccaatgcctgtcatcctttccggaccaccgcagaccccgccccctctcccccccgccagctatcctgccttctccttcaggcctagtgaccagcctcgcccttgtaccccggtcccctcgacccgatcccactttgatcccggttccggacgagccaggtgctgtggccacgtctctgtcccctctctctcctttcctgactgcctagtcctccccaacccagcccggccgcactctcacaggccggcggagaacatgccaagggtgaagaccacgcatgctccgtaaatgagcgagtccagaaagccgcccgcctccattacgactagagtcggatcccgcgcccagcgcccgccgcgagcctgcggttgccgggacctactgcagcccagacctgcggctctggagccccgccccgcgcactcggctccgcccccgcacgctcgggccgtccctccggaaactgcgccgaagccccaccctccctccgacgccgaaccggaactcgcgcccctctcctccgagcgccttcccagtaccctggtccagacctcttccatgtcccggtcagtccccttcctagggctccgcgggtgtgtccccgatacctgccgctgctcacactctgcctaccccttggatcatctagacgcccccagtctcaacgctcgtgttcccacaggcctgtgcgccttcggcggtggacctccaaacaaaagcttgctagtttaacaagacttcagcacgctttccatccagagctccacatcagaacctcagttgcccagggtttgggaagtttttttctggagtgtgctgccgaagctttttctcaaaataacacattaccaggaatcaccaagccttcctcttttgccctccctctcgggtcaactttacatgacgtggccaatccactgacgcctctatcactgacccccggtccaacccacttgttactgggaactttccctcccagcctcccacacgtctctgctagtgtggctgtggggcggggccgcatgcctcagctggcgttcccagcttccctgactcaccgaaacagcgtgagtacctgaatggtagtatgccaaagccctgcggtgacggagtgggagtggggtagaggtcggataggaagaacttccagagtggagtgcagctcagaacccgagagacagctgtcaggagcactccggtcctggacagccctcagaggaggaaacatcccacccttttggcctcgtgaggggcacacattctttggagagaaagaaattcaaacccagttgctactgttgtagcacagagagcctcgcacttagcagggactcaatggtcatatgttttaatatggagtggcagaaaagcatgtccgaaaaaacacattgctttattttgagacaaagaacattgtataaaaaaactccagttgtagaaatcaggacagacacacagcaacttatatacagatactatacacgtgggccctgccctttaggctacactctaggcagaatgtacacatgggcactgcccttacagctacactctaagaacaggttggcacagcccccctgctggcacagctctggggagtgctgccccaggatgggagagaatgcagtacctggctacaaacttctctgtggcagctccacagatgaggtcttgctgggagatgctgggtcagcccaagcatgctgcctctcctgtacctggcttccaagcaagaaactgtttcttgcttttccttcagtcagttcatctgggcatcctggctctctcctggagggggcatctttgacaagctttgcccatccacgtggccccttccagctcagctcccactgtgccttaagggaccatgcctgcacagcttgtttctttggcttaaaggcaggaatggtgggaaaggactgtctccacttctttctccatccctccgaggtgaaggtggggatggcactgtcgggctggttggcctccttccggttgaaaaccttaatactgacccgttttgaggctgctaggtgatagcttatgcctgtggtgggagtggttcccagggctgggggctctgaaagtggccccaagacaggtttggagtgcctgtccctctcttcagcctgtccctctttaaggccaggtgtggcatacaccttcacggggtttgcagcagcagaagtggaaggagcagcacagtccaggcaagtgggaagaggcgtggggcagcactgtgaccgatgctatgtagaacccgcacctctgggtcatctgcaaggtgagagggcaaaggccaccagtgtgagtggctccactatttgtactggctctcagcccaacaggattccctcagcctcagcctggtaaaggagccacctcctgtacccaacctcttcaagcagaccccttcctgtgccccaggcccagtttgctccagctacccacctgctgcaagtctcttctcctgtggattgtcatgggcctgaggactgtgagctgaaagacaagagtggtagtagatcaggtactgtatcaaagaggcagagggctgtaagtatgagtgggctgggctgcaagacttctataccatcctagatcactagaccgcacccagcatagagatggaggaaggaggcccacagggctctgacactcactgattttgccactgacagtcaccttcaacctcaagcagcggtcttcatgctggtggatgggtttggctgcaagataagcccacaggggttaaataagaaacctttgctggaagaaaatgtaagtccaaatgcccctcgccctgctttctcagctccctactcaatttcattcttctcttccctctaaccttgattcctaccctccttagtttttgctaacttcctgcccaatgttcagcccagcctctcattctttggaaataaccctcagcatagacactgcccctccccacatttcatccttcattcctccgagtctgaatatgttcctcttgcctgggccacttaatactactcctaggccaggcgcggtggctcacacatgtaatcccagcactttgagaggccgaggtgggcggatcacgaggtcaggagttcgagaccagcctggccaatatggtgaaaccccgtctctactaaaaatacaaaaattagccgggcatggtggcacatgcctgtagtcccagctactcgggaggctgaggcagaagaatcaattgaacccgggaggtggaggttgcagcaagtcgagatcgtgccactgcactccagtctgggcgacagagcgagactctgtctcagaaaaaaaacaaaaaaacaaaaactactcctgcctagcccccaccgacagagtcctagatccatcttatacaaagctgatctcataactttctttttgaaacggagtctccctctgtcacccaggctggagtacaatggtgtgatctcggctcactgtaacctcacacctcctgggttcaagcgatcctcctgcctcagcctattgagtagctgggactacagaagtgcgccaccacactcggctaatttttgtatttttttagtagagttggggtttcaccatgttggccaggctggtcttgaactcctgaccctaggtgatccacccacctcggcctcccaaagtgctggatgatctcataacttttaaaatccatcaggccatgcgcggtggttcatgcctataatcccagcactttgggaggctgaggcgggcagatcacttgaggtcaggagttcgagaccagtctgaccaacatggtgaaaccccatctctactaaaaatacaaaattagctgggcgtggtggcaggtgcctgtaatcccagctatttgggaggttgaggcaggagaattgcttgaatccgagaggtagaggttgcagtgagcagagatcacaccactgcactccagcctgggcgacaagagtgaaactccatctcaagagtaataataataataaaataaaataaaataaaacccatcagtggcgagagccctcaggataaagtccaaactccttatcaccttttagttcccccatggtctgttctgtccacctctccaggctcacatctcctcacttcctgtgtccctccaactccagccaggctgagccacaggaagttccctgaagatgtcatgctccctttgtacgtgtgccttcatgcctggccagctcctctgcttgtcctgagctctgggaccatcttccccactgagccttctctgagccccatagcctggcaggtgcccaggtcattttcccaaggcccctgtgttcatgtctactgtagcacactgttctaagggtctcttaacctatgtgtgtttcttcccagcttccttgaggacaggggctctgtagtgttttatttatctttgtgctcatagcgctaaacagagtgcccagcacatagtagaagctcactcacattgggatgtagatgaatgaaaatagaattcaagatcggaaggggccctctgctgctggactctacaccaagcatgtacccaagcatgtatgtaatggcaaaaaagaaacacagacactgtcccctcacaggcactcacagatgtagtagtagctgtgtccttctttgaactccttgcccagggtgaaaggtgtgaagcgctggaacttctcagacagcttctccgggccatgcttggcactgggccggttgcactgccagcggacttggtccttggactggggctggcacagctggtactcctcatgctccaccaggtacagtatgtactgctccatggcagcgtctgccacagagtgatcttcatagtgcggacagatgatgtccacgtagtcattcagctgcacatgtatggtgtagtcctcattccggaacctggggacacacacagggggaagaagcaggtggtcattcagaagccaggccagatccttgggcctctgaatgtttacatgacctctcacatttcacactggaccccaagagatttttccgaagtttcaactcccaatatgtactgatcttgatgtcttacatttctctctgccatctctaaacattcccctgcaccatcactgtctcctgttggtccttcaaatagcattcactcagtatctttcgggtaccaaagcattttccataacccccctgatacttacctgatatttagatgggcttctacctatttctgtagctcacttatcattctcttctacccataaatatttccccaaatctgttctaccagttgctccttttaaatgctgttaggcctcaatctgagacccccacaggtccattctgtaatcagaatccaggaaaccctttctctttaccatgctagcctggagcctccaacacatctgtgtcttcactttccttactcctctcacatttccccggacccactgagtagatctcacatttcccagcttcacttttcctcaaaagtgaagctagtatacccgggcccacagataatgccccagtcctttaagttaaatcactctcatcaattcattcagccccctcaaatcttcccgttctagctactcaaagttatacactggtctccttttccccttctcagagcaccccaaaacaaccctgtccttttatctctaaaagccacacttccacctccccctagatgaaatgctggagctctgagcttgagcttgagacagcctctcccctctcccctctctcccctctctcctcctctccccctctcccctcctctcccctcctcccaaggtggagccagcacccctcccctagttcattccccctggccccaccggctccagcctgactgcccaccagcccctccccaccagctccagacacctggctccagcctgggtggggtcccagtagggggaaaagtgcttcccccgaccccgcaagctggtcagtttctctaattcccccaggcactgccagctagagacccagcagaattagcgctaagttgcttcgaactgaaagccctggccacggctgggagggcgaggaaggagtcaggcagagaggactcggaggtgggcacccactgcccaatcagcatgacccctgagaggccaggctttgcagcagcgtgccagcgcccaaactgggcttaccaggcccctcccccaccctggggaaaagagaggagcagagagaggcttttaaaattcctctctggagagataaacatagaagccatttcagaacaggtatttcagctctgggcctggcgtctttccctcattcccgtgacgggcactgactcattcctcatccacctctgctacccgccccagcactcatgagaacttgtgaaaacttaccttgtcaaatgtgcacagcccccaggaccccaggagggcacagcgcccactcacccccaacagtgtcctccaaacaaagggagctggcaggtcagaatgaggggcctgccctccagcatgagggaggctggcgcccttctcagcatgctgcccccgcctgaggcctggagatcccagggctgctgcccactggcctgagtcacccatgccagcctcacctaccccgttcattgtagcctcatatttgcccccacgctgggcccagcttggctgcctacggactctactctggactggcgtctctttagtcctgggtatgatagggtgtgcgtgtgtgtgtgtgtgtgtgtgtgtgtgtgtgtgtggccagagggtcacccatcagccccctctcctgggggtacagtctgctgtacttagccttcatttgactcttgctccccatctgggaaaggggggcagcggcgtcagggaaggcggggaggtgggtaaggaagaggctccttcctgaaagagaggaaacctgggagcttgggaacggaaaaggccagggtccccccctccctactcatggcttcctgtcccctcctcctcctccagtcaacacctggcatgggcataaacagggactttgctctctcccatactagggcgagatgcatcaggtcaaggaggcaaagcacagggagcgggtggcggagggctggctgagcctccccagcgtccatgggcaggagggcattgccctctggggttggcagctggctgttctctcccccaccctaacaagccacagacaacagactgcctcaccagacgatgacacggggtcagaggaagctggcacaacatatttctcaaggggagtggggggcaagcttgctagggccgagagtggctaagccggtgagatggctttcgtgataccaagctgcccacttctctccctgctcctccctaccaccctctcctgtattccctcaaatattgttcccataacttcagaaaactcaagggcaagaacaaaggggccgacagagtcttcctcccagtaccatttgcctcacagccctaaacctgcccaggagaaattaactccttcctgcccagaaccttctgtaacccctttaacctcttctgttcattctgaagctttcccatgatctccctctcccagctcttcgcttttactacttgagagccccataaacaggtgattccctcagcctacccatgcacagcatgtgcctcactcatgccaccccaaaagacccctagtgagggactttccaggtttgctttaaatacagggtgaatgcataatgaatgcctacagcccagctctctcctgagaggtccttccagggttaccttgagcattctgtgcactcttgatgtcacaccaggtatctgtcagtgtggtcagatacccaaaggacacacaaggagaggcgtggaggctttcacagtgggggggtggggggcctggaacaagggccctggctgccaggggcgaagtctatgctgaaggcaggaactgcccagcatgagtccctcactttagagtaataggggtgccagagagaaggaagggaagggcagatataagcccatgcaagtagacacaagcatgccccggggtggggtgctcccagatatgacggagaagtgaggggaggaaaatctacagccgccctcctacctcggtcatctactctaggctcagctcagggtttggccgggacagttatcccggtggggtagtgccagccgggagcccaggctgccagcgggagtctcgaggcttacttgggatttgaactgttccagaagacggtgtggcgatcagcagcggccagactgcagcacagacccaagagaggggcccagaggaactccatagcgcggggcctggccaggccgagcggggacgcgggtctcctatgggtctgggttcccactggctttctccgcggcgcagtcagcgctgggctcacagatctggccccttcgcctagcgactccgccttttgggccggcgccgcccgacaccccgccccgccctcgccccgcccggcgcgcggctgcctgggggcttgggggctggggaggtggaggaggggcggggtggggaggcgaggaggctgggggtgcaggaaagagcgaagcgcgctcctctgcccccgcagatctgctcagagatgtgtgttcgctcacttgtgggtctgcgtggagctttgtgagcctgtcccggtggtgggcttgcgtccctgggcgcagtcgcgtgcgggagaagggaagaactcgcaagtgcgagtctgcgaacgcgggggtgcgggacacggctttgctgctccgcgcgcggaccttgcagggtgcgaggttgttgacatgccccgcacctttctgagcctcgcatgcccaggctcgggcgcccgcgttcccacactctcctcctcccccatccccttcccggactctgcgcttgactgcccctccccacacacacgcggctgtttgtttttgttgggtttgtcaatgttgtctttgttctggagattgtgtcatcgcctagatgccgggaataaagtgcaacgctttgtgtgatcgagtgtgtaacgtgtgcggccggggctaaggacgcctctgtccatcacatcagtgcctgcccgcaggagcgacacgcgggaccctgggctcgagagggggccgttcttattttagataagtcaaagagcgctaataacctgagtatatgtaacaacacacgcgtacaccgtgcgaacaggctcttgaatatggactgtgagaatctgggcatgaagggtgacaaactgtaaccacacatgaaatacgtgtgatggcgcgctagcatgaaagcatttgtgagtagtatcacagccgcgtgtgtggaagcgtgtgaaactctttgacagacgtatgctaatgtttgtgaacagcgtgtgaagaggaggggagacgcgtaccggcgtgcagcgggggtggggtggaacggaggggcgtttgtgcgcagtcctcaggctgcacagctggagctggcccagtctgagctggggctcccagtcagtcgggccccagtacccggctcaggccccctcccccgcgctgtgtaaacaaacccactggaatttgcctctcggggctcttctccccgcctggatctgctgccgtctggagagggcttggcgggcgggtgtcagctcctggggtggagagggcgggcaggtgtttgattaggctcacgagtgagcctggagtgggagagccgaatgctgtgtgtctgcgtgcgtttggtggtttacgtgtgtggttgtgtggctgtgtgcgcgccaggttggtgttgtgagtgtgtgtgcgcatcctcagccggcccttccctgcggctgcgcatcgcgggaagccacggacccggggcccctggccagctccggcccagcttctccagttcccaggccgtttcatcctcctattttacggccaggcctggctacagcccctgtaattacgcggggcccggacgccgcagcaagtctggcgctgaccccgccggggaggagcctggagctggggagggcccagccggctccccactgcaccaccacgtgcgctgaggccgctggaggccgtattcgctgcgtttacaataaacatagagtaccaacggcctctaaccccgtggccgggtcagggccgggttttgcgcacggccagcgccacccccctctccctcgggcacctgccccaggcgacgtgcccagccaagcgtttgtccgaggtgcggcccgctcctctcgcccaggacgaagtccacccgccgactgctcccagggcggcacctcacgcgccttttgctcacctaggaggacacctgggtgtcgacctcccacgtggccccggcgagagtactgcctcccagttcgggcattccatagagtcaaagctccaggaggacatgggtttttgttttgttcattatcttactgccagcacctggcacagcatctagcacatacagtagatggtcagtaaatatctgtggagtgagtgaaatcactcactgttcagtgaaggaacttaacttctgctggacataactgttctgaaaaggagccagcaggggggttgaagaggggagggatgctggtagctctttagagcaggtggcccgggttgcctcctggaggagacagctttgggccggattccctggtttctctgaccactgggactgggcggggacgtgtgaagtcccacgctgcagctgcttgggccaggcaggttcgggctcgctgggcccagtctggcggggccacgtcagctcttgcctgcgtctaggtctggagcaagctgggtgcagaagcgtgcatggaaattctgcgcaccgacaggacccggagccctctttccctgctttggtgctgtccccagtattctcatctcacttagggcattgatcccatcactctctatccactcccctatccatatgggggtcgatcatccaccctactggagcagccctagacactgagtgttgtgatgagctgggtgttgcgatgggcaccgagagtgtaaggatgggtttaagataaaatcactaccttggggagcccccaggccggtaggggatattgacaagccaccaggacagcaaacttgctaagtgctcaagcccagactgcggccctaccactcacagtcacactaccctgacccttcctggagcccctgcaatgcctgctgtgctgagaggagagttgcagggcactgtgccattcagacagagataatagtagggacttctgttcctggagactcgatctgctgaccaactctggggccccctcccagtcccttcctcatgccagcccccagcctgcccgggtgggtctgctctccattcttgcttcgtgctgcctctcgccgcaaaattgtgtgcttgtgttggctcccagcacgtcacccgcaggcaaacatctgcgcttagtgacgagagctgcctgaggtgtctgtctgtctgcctgtctgcatgtctaggaaattcctccatgagtcctttctggaaattcctgggagggcaggaatttcctcagaggaaattcctctgaggtcttggggtaggccctggctgcctggaggcagcatttccagttgggaacaggtgcaggtactggattgcgactcctttgctgggtgccctgcagtttggggaggggaaggccagagctgcagggccctggggcaagtgaaacctggctcagccccaggggtcatctctgggcaatggggtgaggcagcagggggaggagcagaacctgggctgagagcaatctctgtcgtactccctcaaggtcattttgaaacataaagtatacccttccccactttattagtaatgtgcacacatttttcagaagttggaaaataggccgggcacggtggctcacgcctgtaattccagcactttgggaggctgaggcgggtgaatcacttgaggtcaggagtttgagaccagcctggccaacatggtgaaaccccatctctcctaaaaatacaaaaattagctgggtgtagtcgtgggtgcctgtaatcccagctacttgggaggctgaggcaggagaatcacttgaatctgggaggtggaagttgcagtgagctgagatcgcaccactgtactctagcgtgggtaacagagtgacactccatctcaaaaaaaaaaaaagttggaaaatagagaacaggaggataaggggaggggaggaccaccggctgctgttaacattggcctccctgccctgccagctttttgctggggaagagattttgcttgcttttagacaatgtgataaacatgactcatttcaattgtgtgcttctttttttccctttacaacagaagacattttccatgttataaaccctttgtaaacaatgttttaaagggagtgtaatgcttcattacgtgagtatttcagagtttgccattgcaatgaaagcaggacagaaataaacatatccatgcacattcagacatccctcagttgctgagcagttgggtggattggctcttagaatttaggactattggccgggcatggtggctcacacctctaatcccagccctttgggaggctgaggcggacagatcacgaggtcaggagtttgagaccagcttgaccaacatggtgaaactccgtctctactaaaaatacaaaaattatccaggcatggtggcacacacctgtaatcccagctacccaggaggctgaggcaggagaatcacttgaacccgggaggcagaggttgcagtgacccgagatcgtgccactgcactgcactccagcctgggcgacagaacaagactctcaaaaaaaaaaaaaaaaaaaaagaaaaagaaaaagaacttaggactattgggaggctgacctgggaggatcgtgtaagaccaggagttagaaattagcctgggtgacattttgagaacccgtctgtacacaaaataataataataataataataagttagctggggtacatagtgcatgctactctggaggctgaggcaggaggatcacttgagtccaggagttgaggttacagtgagctgtgactatgcctctacactgcagcctgggtgacagagctagacagtctctaaaaaagaacttagaaataaccttgcaattgccaggtgcagtggctcacgcctgtaatcccagaactttgggaggctgaggcgggtggatcacctgaggtcaggagttcgagatcagcctggacaacaaggtgaaaccccgtctctacaaaaaatacaaaattagccgggcagggtggcacatgcttgtaatctcagctactcaggaggctgaggcatgagaatcgcttgaacctgggaagcagaggatatggtgagccgagatagtgccattgcactccagcctgggcaacaagagcaaatctccgtctcacgaaaaaaaaaaaaaaaaagaaccctgcaattgacttaacaacaaacacttatggagcacctactatggaccggcttacatttgggcttacagatgtgtgaaaaagcttttgatattgccaaaccaaagccagatcttttgatactagtccagttatcttcttgagaatcgaggtgactataactaaaagatctgtttctacttaattatctatgggctacagagtaatttcaaaatccttcagcgtggcatttaaggcctttggcaacatggcccccacaccacctctgtctcatctcctgccactcccctggacatattctataaaatttcctccccacatcccactcagaagggggccagactctgtgagggaaggtggaattctccccagaagtccactgcagggaagaggaaattggataggatgggagagtgggagggagatgagagaggcagaagctcagaaggatgggactcaggttcctgcacagaaagcagcagaaggtggtttatttttatttatttattcatttttttgagaaggagtctcactctgtcgcccaggctgagtgcagtggtgcaatctaggctcactgcaacctctgcctcctgggttcaagtgattattttgtcccagcctcctgagtagctgggattacaggcgcacgccaccatgcccagctaatttttgtatttttagtagagacagggttttgccatgttggccagctggtcttgaactcccaacctcaggtgatcaacccgcctcggcctcccaaagtgctgggattacaggcatgagccattgtgcccggccagaagatgctttatattggggccttttccaccagaaatttactaatcatttaagccaaacactacactgggaggcactagggactctgaaatacatccttgtcctaaagaatgtataattctggggctggacgcggtgcctcatgcctgtaatcccagcactttgggaggccgaggtggatcacgaggtcaggagttcaagaccagcctggccaacatggtgaaacccccatctctactaaaaatacaaaaattagccgggcatggcggtgcgcacctgttgtcccagctactcaggaggctgaggcagagaattgcttgaacctgggaggcagaggttgcagtgagccaagatcgtgccactgcactccagcctgggtgacagagcgagactccatctcaaaaacaaaaaaaaaagaaggtataattctggcaaatgtataattagaatacatgataagaagtataatagaggtataagtagtataacaagctgtagactcacagaggaaggaatgtttatctggggtggggagtgcttcatagaagagagtctatttgaaatgggctttggagaataagtaggcattcccattcagggaggagggaacaaagaacgcaggtagagaggtgagagcttgttcagtgaatactctggctcagctctctgtcctctgctcccctgactgttgctactggaggagatggggggagcagaggagtggcagaggaggtggggagcagaggacagagataggtgagagctgagccatgagcatgagtctgggagaagtccggggtggcttggtgggcaggagtgctccttatcgataggaaacgcacgggaggaacaggcctaggaaggacgaatggagagttcagtttgggacattatataaatttctggctgcaaataacagaataccagctactcgaagtttaagtaaagggcttactttccccccataacaagcagtctggaagtgagacaggaactcaacagtgtcaccgaagttccagtgcttccccacgccctgctgtcctcaggaccatggtcacaagatggctgcttcagccagagagctccattcaagctacaggagccccaagaagaaggagtgggagcaaagcggtcctatcctcccatggtgctctccctctctcttttttttttttgagtcggagtcttgccctgttgccgaggctggagtgcagtggcgtgatctcggctcactgcaacctccaactcctgggttcaagcaattctcccgcctcagcctcctgagtagctgggattacaggcgcacgctaccaagcccaggtaatttttttgtgtttttaatagagactgggtttcactgtgttggtcaggctggtctcgaactcctgatctcgtgatccgcccaccttggcctcccaaagtactgggattacaggcgtgagccacggcgcccggaacccctctccctttttaaagcctagtcaaatgcagctgtgagaagggagaaaagagtagagcagggagttcaatctgtaactgactgtgaacaattgagataactcactaccttctgaccagcccaaggctctctttttatctgggaccagcccaaggctctctttttatctgggaagaaaatcttttctagcaacttcccagacaaggaacagaaccagttcgtgtgtccacatgtccgttgctacacccatatctacaaaggagaagggagtgctctgactggggctggggcagggacctatccacccctgaatctgttctgcttcccaaagacactggagttctatcagcctagaagcagggattacatggcttttgggtaagcagtgaatagtatctgctgcagacatgttgcatttgagaaaccagtggaacttctagaatgaggagtcccaggggcggttggaggtgagggtctggagctcaggaaggtgagaagctcagaacaattgttgcttgtgaactctgaggctcatgggaagggtttctcctagactgcaatgcttcaggcaggggagaagagcaaagagacatagggccaggaatcccttccttgtgattttggctggggagaaatctgtcctttccagctcctcaactttggcatccagggtgggaaagctgggtgagggactggcaggaggacattcactcttggtacagccgataaacctcttttccacccctggctaaaatttttcactataacacagtatataagaccaggagttagatacttttatttcagaagcattacttttatataatttttttctctttttcttttttttgagacagagtctcactctgtcgcccaggcttgagtgcagtggcgtgatctcggctcactgcaagctctgcctcccatgtacacaccattctcctgcctcagcctcctgagtagctgggactacaggtgcccaccaccatgcccagttaatttttttttgtatttttagtagagttggggtttcaccatgttagccaggatggtctcgatctcctgaccttgtgatccaccccccctcggccacccaaagtgctgatattacaggtgtgagccaccactcccggcctctctttttctttctttttttttttttttctgagacaaggtctttctctgtcactcaggctggagtgcagtagccagatcttggctcattgcagcctcaacctcctgggctcaagcaatcctcccatctcagcctccagaatagcagggattacaggcgtgcaccaccacaccctgctaatttttggatttttagtagagatgtggtcttaccatgttggccaggctggtctcaaactgctgtcttaagtgatctgcccaccttggcctcctaaagtgctgggattacaggcatgaaccactgtgctctgcctttttttttctaattccagaaggaatacatgattagtgcagaaaacgtagagaaacacaaatgcagagagaaaaaaatcacccatagaagttaaggctcaggaacatgcacatttctttattcttttcccatggctctgtaagttttatggtcaatatctttgagaagttatagtttaatgcctatgttacaaccaacttggaatcccttacatttgtgtaacattttattacagtccagtgttttcagttgtacattttatcacatactatttcctttttatagactcctacacattgcgaggtgggcaaaggcaggaattatgtccccactgaccaggtgaaaaaactaaggctccgaaaggtgatggtattcagaactcagatggggagccaggcgcagtggctcatgcctgcaatcccggcacgttgggaggctgacgtgggcaaacttgagttcaggaattcgagaccagcctgggtaatgtggtgaaaccccatctctctctctctctctcttttttttttttttcttggagactgagtctcactctcactctcagtgtgcatttcccctcgcatggttcccgcacaggccaacaggggcaagcccaggaagtagaggctacagtgaaccgagatggcatcactgtgctccagcctgggcaacagagcgagaccctctctcaaaactcaaaaaaaaaaaaaaaaaaaaaaaggccaggtgaggtggttcactcctgtaatcctagcactttaggaggccgggtgggcagatcacctgaggtcaggagtttcagaccaacctggccaacatagtgaaaccccagctctactaaaaatacaaaaattagttgggcgtggtggcgcgtgtctgtggtcccagctactactcaggaggctgagtcaggagaatatggcttgaacccgggaggtggaggttgcagtgagccaagattgcaccactgcactccaacctgggcgacagagcaagactcagtctcaaaaaaaaaaaagaactcaggtggggtacatttgatggggcttggatctacaccatgctattccttctacgccccacttgcctggctctcctggggataaaggagatatggcaccaagtgctatatctgtatctgctgggagcaaatggggggagtcagtagagaaggtaaaggaaagagctagagagggggctgggtgtgggacagtctcagagggaacctgaggcggtttgtgggacaggctctgagatgcagtcccccagggcttaagctcaccctggcccgtccctgcaggcaggtgggagatggccagataatggacagctcatttgtttgtataacaggtgctctgcctaagtgccgcaagccacatccaataaaggcagctggtgaacagggagacagtgcagagaggggtggggtcgggggcccagctgtggaaacttgggaaagttacctaacctctctgagcctcaccttttcttcatcataaaatggggtcaagactactttctctatgcaattattattattattattattattattattattattattattaatttatttactttgagatggagttttactcttattgcccaggctggagtgcaatggcgcgatctcagctcaccgcaacctccgcctcccgggttcaagtgattctcctgcctcagcctccggagtagctgggattacagatgcctgccaccacgccccattaattttttttttttttttttttgagacagagtctgactgtcacccaggctggagtgcagtggtgtgatctcggctcactgtaagctctgcctccagggttcatgccattctcttgcctctgcctcccaagcagctgggactacaggtgcccgccacaatgcccagctaattttttttttttttttgtatttttagtagagatggggtttcactgtgttagccaggatggtctcgatctcctgacctcgtgacccgcccgactcagcctcccaaagtgctgggattacaggcgtgagccattgcgcctggcctccatgcaattattgcagggatcgaatgaaataatagatgtgcgggcctggcacttagcctggggagtgggttgtgcataagcacggggtgaatttcccctcgcatggttcccgcacaggcagaagggggcaaacgtgctgatagtgagggtaaggatacagggaagtggggaggagtcccaggatcacgaatgggatgggtatgtggtaaatgccctaggatgaggtggccaagagtgctgaggttctgtgagggcagagtgatgagtgggggaagtgacttttgagggttctcgggtgaggttggtgggcaagggcattccatgcccaaaggaatcctatgggccacactgccctgcccctgcatgggcgaggggaaggtgacagggaagatctgtcccccagagctccttcttccctccttcctggtcctttttcctcccctggctccactgtagtctcccccaccctcccctgctctccttcttcctcttggctctggcatcatcaagtcctccaaccttggccgggcactgtttggtctgagtttcgtcttaaacaggagtaggacttgattaagtaatggtggggggagggtacaaaaagcactgaagagacagagtttgggcagggggaatagggaggaggccaggaaccacccagagaggtagggcaggagaaaacagatagctggaatgccaggtggaaagcagtaaattccttgggggtggcacaccgcactgtggcactcaaaaaagagctcctctcctggcacaaatccccatgtctggggaggtgttgggcgtcctaggggaggtcctttggagactgggcttatcaggaaattggttttaaatgggctgagggcataccagattgggctggagaagggctcttgggcaaacccaggttggcttcagaagcaagctgagggggttgtatttaattgggaagttgccctgggaatagtcacagcatcagctcatgtttatagaacatgttccttattccaggctcatttgaagcactttgtgtacattaatgcacttaatcttcacagtcaccataagaggtaggtagaattattatctttattttattttattttattttatttttttgagataggatctcactttgtcgcccaggctggagtgcagtggcaccatcatagctcactacagcctcgacctcctggttcaagtgagcctttccctcagcctcttgagtagctttgactgcaggtgcacgccaccaccacccacctaattttcgtatttttagtagagacgggttttcctcatgttggccaggctggtctcgaactcctgaccttaagtgatccacctgtctcagcctcccagtgtactgggattacaggtgtgagccaccatacccggcctatagagctgttctctttcttctgggatgactgaggtgatgagatggcagtcgaagactatattttgcctccctgacaaatacacttggcctccctgcaggcattgcatttgcaagccagttcttcatcctcacacatgacaattccagggccttaaatcccaatcccatgttctctctccacttctctatctcaaagcactattcccaggctctaatttacaacttctcaatccatttttcaccatgttggccagggtggtctcgaacccctgaccttaagtgatctgcccacctcggcctcccaaagtgctgggattacaggtgtgagcactttaaatttaacttgctgaaatagagctccttgtcatttcttcaaaacacaggtctgctcctgatttccttggcttgtttatggtttgagtgggatcaccccatctcccaggtgccgtagcgggcaatatcctgagactggccagtcccagcacagcagccccaggccacagggattggtttgggaaagggaatgtagtctaagacaggataaacgggaatctccaaaaaaattgaggggaatggaagctgggcaagcaaacaggcagatttaactagaagagcctggtagcttgaggttgcagaaaggagggaaggatgtttttaagggatggggaaacccaggcccagttgttgataaagaggaaagaattcatgagagtctatgcccagattaactgccacttccccaggcctcacctaggtgaaaagcttagtactcaggaggctgaggcgggagggtccactagagaccaggggtctgagtgcactccagcctgggcaacagagtgagggccctgtctttatttatttatttttttttttgagacagagtcttgctcttgttgctcaggctggagtgccgtggcgggatctcggctcactgcaacctctacttcccgggttcaagtgattctcctacctcagcctcccaagtaggtgggtttacaggcgtctgccaccacgcccatataatttttgtattcttagtagagatggggtttcaccttgctggccatgctggtctcgaacacctgatttcaagtgatccacccgcctcagcctcccaaaatgctgggattacagatgtgagccactgcacctggcctcaagagcctgtctttaaaaagaaaaaaaaaaaaagtttgggctttggagagagattgcaaagatttgaatcccagctccatcacttatttggatatgaccctgggccaatcacatctgtgcctgtttcctaatttatgaaataaggatgataataatagtgcccaccctttggatcatgatgaggatgaaatgagataatgtatgtaaagtacttagaacggctggcctgtttggcatatagaaaaacctcaggattaatattaatattgttattatttttttcttttttgaaatggagtcttgctctgtcacccaggctggagtgcaatactgcaatcttggctcactgcaacctccacctcctgggttcaagtgtttctcctgcctcagtctcctgagtagctgggattacaggcatgcaccaccacgcctggctaatttttgtatttttagtagagacggggtttcaccatgttggtcaggttggtcttgaattcctgaccttgtgatccacccatctcggcctcccaaagtgctgaaattacaggtgtgagccaccatgcccagccaggattagtattatgacagcaattattaggatttttattgtagaaggctcacagtgacagtaacaagttttaagccaactggctcctgcttctgcttgctgacataggacctccagccccttgcaaagtccctctgaaatatcactgatggtccccctagggcatttcacatgggctcagaaacatgtttgggctggctgagtgctgcagctgttctggagggctcagtgttttcctgctggtgggggttggggcactggaaatctctcctctcccttgtcacctctgttgggggttcccaagaaaggcggcttgtgctttcatgtgttacagattggcatgtctgttcttcgattttttttttctttttaagacggactctcactgtcacccaggctggagtgcagtggtgaaatcttggcttgctgcatagtctgcctcccgggttcaagtgattctcttgcctcagcctcctgagtatatgggattacaggcgcatgctaccatgcctggctaatttttgtgttttttttgttgttgtttttgtttgtttgcttgttttttgttgttgttgtttgttttttgtgatggaatcttgctctgttgccaggatggagtgcagtggcgtgatctcggctcactgcaacctccgcctcctgggttcaagcaattctcctgcctcagcctcctgagtagctaggacgacaggcgcacaccaccacacccagcaaattttttgtgcttttagtagagacgggatttcaccatgttagccaggatggtcttgatctcctgacctcgtgatctgcctgcctcagcctcccaaagtgttgggattacaggtgtgagccactgcacacggccaattttttgtattttagtagtgccagggtttcaccatcttggccaggatggtctcgaactcctgacctcaagtgatccacccaccttggcctcccaaagtgctggaattacaggcatgagccacttcacctggcccaatttttttttaatcatctgatttttagattcatctttaattttcattcacagtcacctctatccacagggccctgacaggcttccctggggctggactgaggatggatctgcacacttgctgccatgctatgctgcagcgggatttcttttttttttcttttttcttttttttttgagacagagtctccctctgttgcccaggcttgagtgcagtggtgccatctcagctcactgcaagctccgcctccaagattcaggccattctcctgcctcagccgcccgagtagctgggattacaggcgccccccaccacgcccggctaattttttgtatttttagtagagacggggtttcaccatgttagccaggatggtctcgatcccctgacctcgtgatccacccgccttggcctcccaaagtgctgggattacaggcatgagccaccccgcccggcctgcagcgggatttctagtcctctgaggatgagggctttgccacagagccatttgggagcttcctcagcccctcccgcaggcagccacgctcctgtgaggtgttcctcctggctgtggcaatttccgactccagtgtgcacacagccatcacactccccatagatggcctgccatggcccctcctgggacagcagcccaggcgagtccttctgcagaaagcttgggccaagcaaaggaccacctgcctagggtgagggcagtcaaggataagggggcgggagctgaggacacagccgtcaatttaccacactaggtggggctgggccccttgcacaggttaggggcgagtcctgtctccaactctgggctgtacttagtcactaaatgtgcagagccaggccccccaggccccacggccctcatcaaatccattcatctggctcctccccacacccttccacaggtcaagaacacacccaagatcttccttccctctgcctcatcaccatttttctcctgacaaacctttaaaaaaagaaaagaaaaaaaaaggccaggcgcggtggctcatgcctgtaatcccagcactttgggaggctgaggtgggcgggtcacctgaactcaggagtttgagactagcctggccaaaatggtgaaaccccgtctctactaaaaatacagaaaattagctgggtgtggtggcgggcgcctgtaatcccagttactgggaagctgaggcacaagaattgctcgaaccccagaggcagaggttgcagtgagctgtgattgcaccactgcactccagcctgggtgacagagaggaaaaaaaaaaaagaagagaaaaatacaacaaacaaacatcaacagcggaagttaactggagacccccgtttgtgaaccagtgaaagggacaatggatgaggaggctggtgtggtatcctgagggcatcctgtggataaggcaccaggccaggggctggggccctgaggtttcactcctcccaggtctagaggggtccatcctacccctgctgccagaagaggggcctttcctctgccccacagcacctgggtctaggaactgtctgattcaccgccaggaaaccctctccttgagatgtttcttcataggtcatcccagagcctgctaaatgcttttgccctaggctggctgtgtggctggtggtctgtggaatgaggaaagtgtctcctctccactggctactgggagagcatataaaataaacatgatttaaaaagccagtgcccacagaagacacagacgaaatattaaaaaataaaaaaataagaaaaataaaataaaaataaacaaccccccagaaaccccaggttcccaagctgggtgggatgtggagtaagccagtttgcggtgacatttatataaggggcttggttcctccctcaggcaagtcaagcaagttgtaaaatttgagggcacattttaaaattgtttaaaatcctccaaatgtgtttcctgtctggcacggtggatggcgcgttggtaatacatgtgcatgtgtggcctggaggacgtgttaacgaccaggtttagaggcagagatgcagaagagcctgcaagaaccaggagcgagaaaaggggtctgttgttgtcatggtgtgtgttccccgtgttggaatgtgtgtaaggggcctctggtcctgtgagggtggtttagtctgggaaattagcatcttttttaaagctactctattataaatcattagttaaaggccttcagggctaataatacaggtatgtggtttttacttctgaagcaagcaggtgtgataatatttgacaacacatcataattagaatagagcgacatgcagtttggtaaattagatggtgacgattagacccccgcacatcgtggcctctacctttgcctaagcttttccctctgcctgggacgcctttaccagctgtcaaatcctactcatccttcccagcctggctccgtaccatctccccacagagcgaattaatcactctctcttctgggcccctgtgacattttgtcttttacaatgtttactttgttctttctcttctgaaatttagccgaatatgtgtcccttccccatcacaagtcctttgaggaccagaactgtgtcttggctgttgtcttccctgcagttctgtgcccagtgtgggatcttggttaatgtttattgaattaaacttcttcttctttttttaagggaattactttgcagaaaatttaaaaacccatattgacatggacccaacttggtaaaagccattacacttaaggttttttttttttgagacagagtcttgctctgtcacccaggctggagtgcagtggcacgatctcggctcactgcaatctctgcctcctgcgttcaagcaattctcctgcctcagcctcctgagtagctgggacaacaggtgcgcaccaccacacctggctaattttttatttttagtagagatggggtttcacaatgttggccaggctggtctcgaactactgacctcaggtgatccacccgcctcggcctcccaaagtgctgtgattacaggcgtgagccaccgtgcctggcctacacttaaatattttaaaatatttcatgctctgaactttgcatcatttggagtatagatgtaggctggtgcagtggctccagcctgtaatctcagcactttgagagaatcttttgaacccagaggtttaaaaccagcctgggcaacatagtgataccaccatctctacagaaaatttaaaaaatagccgggtgtggtggtgcgggcctgtagtcccagctgcttgggaggctgaggtagggggatcacttgagccctggaggttgaggctgcagtgagccaaggtcatgccacggcactccagcctcagttacagagcgagaccctgtctaaaaacagacagacaaacaaacaatcaccaaaatagagtacagaattaattgtgttgaatttagaactgatggaattcaaaatataatttgaagaaaatatgggtttattttgttgttatgatacataatgtctatcttgcaagaaaatcttttgtttggcgatagcatttataaggggtaagaaaacctgtggcaaatttgtctttactatgaaatttgctggcacttgattgatgaggatggtgccactccagccactgggcattattctctgcagtggcttctgggctgggtatcatggaacacaagactgagcatggaaggaacacgattcgtatgaataattcaaaggcacccaaaatgctgcttcgttaagtgggaatgttaaagggggtggcaatctgtaagtttagctgttgtgttcagcttttgaaaatgagaaagaaagaagaaaaaaagaaaagaaaagagagaggccgggtgcggtggctcatgcctgtaatcccagcactttgggaggccgaggcaggttgatcacctaaggtcaggagttcgagaccagcctgaccaacatggtgaaaccctgtctctactaaaaatacaaaattagttgggtgtggttgtaggtgcctgtaatcccagctacttgggaggctgagtcaagagaattgcttgaacctgggaggtagaggttgcagtgagccaaggttgcaccattgcattccagcctgggtgacagagcaagactccatcagaaaaaaagaagaaagagagaagggaggaagggagggagggaggaaggaagggagggagggaggaaggaagggagggagggagggagggaggaaggaaggcaagaaggaaggaaggggagagaaagaaagagaccttgtagaaccttagtgttaaatagtgagcctgtattggaacaacactgaggcaggtgcctgctgagctctaacatgaaggtgggcattcatgcccttttgctttgcttccctgttgcccccaggatgtggtacatgggaagaaacaggtgcttagggaccaggcagacctagggtttaaatagtaaccagcaatggtcttgagtctcagttccctcgtctgtaaagtgaaaagaataataaatacctcacagggatttgtgacacttgtaaactgcccggtacagcacctggcagatgtaagtgcacaggcatgttagctctcccactcagcctggcagactcccctccaacctctccccgcagcccatctacgccaccctttctttagatttaggctggcttcgcaaatgaaaatatgggatacccagttaaatttgaattgccgataaacaacgaatagttttttagtattaagtatgtccaatacaatatttgggagatgtgctaagaaaaaattcattgtttacctgaaattcaaattcaactgggagttctgtagtttatctggcaacactatgctaagttccacgtcctccaggaaggacagcttggtgatggctccaccctctgaactcctgtagcctttcgtgactttgacactttgctgacacccaggaagcaacacatttttacttattagtaataacaactacgactacttgtccagcatctacaatataccagacacgtgggagctttatacaacctgtcacattaaccctccaaggctggaaggagcatcaccttgggagcactggagggtcagtgccgcccagctggcacacagtggcattgcgcttcaggctcaagccttcaggactggactccaaaacccacactgcagctcctgatgggcagtgagtgagactcacccaaaggcctctgccagtgcctggcacacagtggcatctgcttgggtttatggctgtagagagtgatgttccaaagcagcaacaccagcatcagaattgatttggggaatctcgggattgtgatctgtcctaaaccgcattatggcaaatacatgggttttcagacaagaataggaatgtttctaaacttccagaaatttctagagggctcactgtttgcttttgtgtgtggataactccagcattgctgcctgaagtattgtgacaccagcccctgagcaaagttctccttgatatggcttgtgacatggtgtgatgtgtgatgtggcatgcacgtgatgtttgacacagggcaggggctggttgggactgaagacatccatattcctgtaagattttttggttcaagtttgggaatcagctgcgtgcagctgtagtcctctttggaggggatgttcagcgtaattaagcagccctttctgatacctgatccccgtggatgtgcttcacctggacacagaggacctgggcatgaagatcccccactcctggggttgggggcaggataggtttatggccaccgaatggaaatgcagctccttctgttgttcagacctcacttgtcatattaatgttacttccttgcttggcttcaaagttagacaaatgcaggatggtcaagcccattcagttcccgggagagaaagaagtggctgtgacaagcaggcctgggtgcagctagtgatgcacctggggtgggcgtggccttcctccccgttaggctggctgtctcttcctctcagccttcttttgtctctttttattcccattctaatttctttttatttttactttaaaaaattgtttttagaggcaaggtctcattctgttgcccaggctggagtgcaatggcgtgatctcggctcactgcaacctccgcctcccaggttcaagcaattctccttcttcaccctcccgagtagctaggattacaggcgcatgccaccatgcccgcctaatttttgttttgttttgttttgttttgctttttgacacaaagtttcactcttgttgcccaggctggagtgcaatggcacaatctcagctcactgcaacctctgctttccaggttcatacaattctccttcctcagcctcccaagtagctggaattacaggtgcacaccaccacgcccagctaatttttttgtatttttagtagatacagggtttcaccatgttggccagggtggtcttgaactcctgacctcaggtgatccacccgccttggcctcccaaagtgctgggattacaggtgtgagccaccacacccggcctaatttttgtatttttagtagagacggggtttcaccacattggccaggctggtcacaaactcctgacctcaagtgatccccctgccttggcctcccaaagtgctgggattacaggcatgcctggcctagtcctattcttcacacacagttgagagatcctttaatttaatttaatttaaagagacagggtcttgctgtgttgatgctacagtgcagtggcataatcacagctcactgtaacctggaactcttgggctccagtgatgctcccacctcagcctccctagaagctaggactacaggtacgtaccaccacaccaggctaatttttttttttttttgtagagaaaagctctcactatgttaccagactggtctcaaactcctggcctcaagcagtcctcctagcagaattacaaagtgttgagccatcacacctggcctcaagagatcctttaaagtgtgactcttatctgtgctcccctggccaaaccctccagtggctcccagtcatgtttacagtgaaattcagatgcacactgtgttctcccaatcccctggcgcccgcctccaccatttctcaatccatttccctccttacacaccattctccagccacactgggcttcttcatgctcctcgacctccctggccatgctccagcctcagggaatttgtactttgaaacagaggaagcaaaactctcctccaatgtataatttggctcaatcaaatgttccctccagtgagagtctttcctgatggctacagcatgcacaatggagcgcgctcacacacacacacgcagacaaacagacatacacgcctcttactctatcctctttttttttcttggctcactgcaacctctgcctcccagattcaagcgattctcctgcctcagcctcctgagtagctgggactacaggcatgtgccaccaagcccggctaatgtttgcatttttagtagagacgggggtttcaccatattcaccaggctggtcttgaactcctgacctcaagtgatccacctgccttggtctcccaaaatgctgggattacaggtgtgagccgccatgcccggccctatcctatctatctatctatctatctatctatctatctatctatctatctatcatctatctatctatctaatcttttctattttgtttctccccagctgactataagcttcataaggcagggactttgttccatactgtagagaacatatccagaaaaaggttctgagcacaaagtaggatcttaaaaaacaggaagggcattgctgattctcaggaacaccaaacagagtggctttgaggagcagatacataaaaatggcagcctgtatgctgctcccttccccctaactgtttcctgagagccaggtttacacttccaggaataagattagaggactcttctggaaaacttccagagaatggtcccaggccaaagatctacatttagaacaaatgagaagccactagatgtccttttattcttgccttccacacttactcccttctgcacctactattgaacacctgctatgcgctagaaaacattctaggtgctgggactctatctgtaaacaaaactgctgtagatcctcaccttgaggagcttacattccgaagagtgtgccttcgaaacccaggtgtacacagtcacccaacagcactctgtcctgcttcatgcagaaatgtgaatggagagccaccaaggggaaaaacagaccaaagcacagagaaaaagaaatcaaagggaactaggaatcattcagggagtagaagaaaacctttaaaatggcaattagtatttttagagaggtaagagattattcataaaatgagaaccaggttatattaaaaaataaaataaggccaggctcagtggctcatgcctgtaatcccagcactttgggaggcagagatgggtggattacttgaggcctggagatcaagaccagcctggccaacatagtgtactgccttctctactaaaaatacaaaaattagctgggcatggtggcgcacgcctgtaatcccagccgctcaggaagctgagggaggagaattaacttgagcctgggaggtggaggttgcagtgaaccaagattgtgccactgcactccagcctgggccacagagtgagaccctgtctcgaaaaaactaaactactcggaaattaaatataggtaagtaaaaacaattaaccaaaggaatggcaagtctgaggaaatctctgagaaagcagaataattagacaaagagttggggaacaaaggagaaaaatagaaaaattagagaatcagcccaggagactgaacattcaactataaaagagaggagacgggaggaaattatccaagaaataatacaaaacgctttcttcctccatttcctcctttcttttcctcccttcctccctcctccctccctccctttctctctctctctctcctctctctctctctctctttcttttcttaataaggagtcttgctctgttgcccaggcgggagtgcagtggcatgatctcagctcactgcaacctctgcctcctgcgttcaagcaattctcctgctttagcctcccaagtagttgggactacaggcgcctgccatcacacctggctaatttttgtattttcagtagagatgaggttttgccatattggccaggctggtcttgaactcctgacctcaggtgacccacctgccttggcctcccaaagtgctgccattacaggcgtgagccactgcgcctggccaagaaactttctaagaactgaaaatttagaatgagtgataaagattagtattcatacacaggatcgggaatctgttttgacttggatttctcaatagcagcgctagaaactgggatagctgaatcagtgaccttgaacttctgagggaaaatgttttccaacttagaattctacccccagctaatctaacaatcaagaatgaggttagtgccgggcgcggtggctcatgcctgtaatcctagcacttttggaggctaaggtgagtggatcgccttaagacaggagttccgagaacagcctggccaacatggtgaaaacccacctctactaaaaatacaaaaattagccgagcgtggtggcgcacgcctgtagtcccagctactctagaggctgaggaaggagaatcgcttgaacacgggaggtggaggttgcagtgagccaagatcgcaccactgcattccagcctgggccacagagcgagactccatctcaagaaaaaaacaaaaagccgggtgcggtggctcacgcctgtaatcccagcactttgggaggccgaggcaggggatcacaaggtcaggagatcgagaccatcctggctaacacggtgaaaccccatctctactaaaaatacaaaaaattagcctggcgtggtggcaggcgcctgtagtcccagctactcgggaggctgaggcaggagaatggcgtgaacttgggaggcggagctcacagtgagccgagatcgtgccactgcactccagcctggacgacagagcaagactccgtatcaaaaacaaaacaaaacaaaaaacaaacaaaaaatacatacatacaatacatcccggagatctttcttggagaaattccttactcctttgtctagtggcttattccattgcgtggatgtacagtagtgtatttagccagtcctccataggacacttgggttgtttccaatactttactattgtcagtgaatgccacaatgaataactatatacctacttcgtttcaaatgtgcatagacatagctgccggacaaattcccagaaggaggattgctaggttaaagggtaaatgcatttgtcattttgcttggtatctccaaatccccttccatgtgagtgatagagctttgccctcccactggcaatgtatgaaaatgcctgttccctaaagccacgtcaacagactgtgttgtaaacctttggatttttgccaagctgataaatgagaagtgctatcttggtgtggttttaattttcatttctcttatgtgtgagaatgaacatccttttaaacatttaaaagccacttgcatttcctttcagtaaactgttcattttctttggtcatttctcttttttttttgaaacagtctcactctgttacccaggctggagtgcagtggcgcaatctcggctcactgcaacctctgcctcccaggttcaagcaattctcctgcctcggcctcccgaatagctgggattacaggcgtgccccaccatgcctggagaacttttttgtatttttagtagatacggggtttcatcatattggccaggctggtctcaaactcctgaccttgtgatccgcccacctcggcctcccaaattggtaggattacaggcgtgagccactgctcccggcctctttggccatttctctattgggttattggtctttccagttagttattaattccaaggaaaagaaaaagtttttaaagaactagaatgaatcatagtatattatgtgagtcaattgtgaacaattgtcacagtttaataaccatctaaatgctaaatattgatttaaccaaaaattttggatttgactctattgggagggcagtgtatgtgtttctgtgcattgagaggcaggacacagagaactgaatcctcatgtttcatgagaggaagtcgatagagcaggtctaacattgaataaagaaaaagaaaaaagagaaaaacagcagtgcaagcatcttatttagaaatataaaggtaaggccgggcacggtggctcacacctgtaatctcagcactttgggaggccgaggtgggcggatcatgaggtcaggagattgagaccaccctggctaacacggtgaaaccctgtctctactaaaaaatacaaaaaaattagtcgggcgtggctgggcgctgtggctcacgcctgtaatcccagcactttgggagactgaggcgggcggatcacgagatcaggagattgagaccatggtgaaaccctgtctctactaaaaatacaaacaattagccggccttgtggcgggcacctgtagtcccactgtagtcctactggggaggctgaggcaggagaatggcgtgaacccaggaggcggagcttgcagtgagccgagatcgcaccactgcactccaacctgggtgacagagcgagactccgtctcaaaaaaaaaaaaaaaaaaaaaaatatatatatatatatatatatatatatatatatatatataggtaaactgggtgtggcggtgcacacctgcagtctcaactacttgggaggctgggggaggattgtttgagcccaggaatttaagggtacagtgagctatgattgtgccactgcactccagcctgggcaatagagtgaggccctgtctctaaaaataaaaaaaaataaaaagaaatatgggccgggtgtggtggctcacgcctgtaatcccagcactttgggaggccaaagcgggcaaatcacctgaggtcaagagtttgagatgagcctggccaacatggagaaaccatatctctactaaaaatacaaaattagccaggcatagtggcacacaactgtagtcccggctactcactgggactacaaatatcagaagaaactagaagattggagagtggttgcctatgtgatgtgagattgggagctggagaagggtgtggcaggatgtgccatttttctttctttctttttttttttctttagatggaatcttgctctgtcgcccaggctggagtgcagtgccaccatctctgctcactgctgcaacctccacctcctgggttcaagcaattctcctgcctcagcctcctgagtagctgggattacaggcacgtgccaccatgcccagctaatttttgtatttttagcagaggcagggtttcaccatgttagccaggctggtctcaaactcctgacctcaagtgatccacaagcctcagcttcccaaagtgctgggattacaagtgtgagctgccacgcctggcctctgtcatttttcatcaaagctgtttggtccatttgactttttttttttttgaaatagagtttcgctcttgttgcccaggctgaagtgcaatggcacgatctcggctcactgcaacctctgcctcctgggttcaagcgattctcctgcctcagcctcccgagtagctgggattacaggtatgcaccaccatgcccagctaattttttttttttttttgagacgcagtttcgctttgttgcccaggctggagtgcagtggtgtgatcttggctcactgtgagctccgcctcccaagttcatgccattctcctgcctcagcctcccgagtagctgggactacaggtgcctgccaccatgcccggctaatttttcgtattttttttagtataggcggggttttactgtgttagccaggatggtctcgatctcctgacctcatgatcagcccacctcagcctcccaaagtgctgggattagaggtgtgagccaccgcgcccggcctaatttcgtatttttagtagagacagggtttctccatgttggttaggctggttttgaactcccaacctcaggtgatctgcctccctcagcctcccaaagtgctgagattacaggtgtgagccactgcgcctggccccatttgacttttttttttagagacagagttgggctctgtcactcaggctggagtgcagtgacacgatcacagctcattgcaacctcaacctcgtgggctcgagcaatcctcccactcagcctcctgagcagctgggactacaggcgtgtgccaccacacccactaattaaaaagttgtttttgtagagacagggtctggctatgttgcctagactggtctgaaactcttggcctcaagcaatcctcctgcctcagccttccaaagtgctggggttacaggtgtgagccactgcacttgaccctatttgactttttaaactacgtcatgatgtaatgtgttactatgataaaataaaattaattatatgcaattaaaagggatgatgtagtctgggtgtggtggttcatgcccgtaatcccaggactttgggaggctgaagccggaggatggcttgagctcaggagtttgagaatagcctggcaacatggagaaacctggtctctataaaaaatatgagttagctggacatgggggcgtatgcctatggtcacagctacttgggaggctgaggtgggtggactgcttgagcctgggaggtcgaggctacagtgagccatgatcatgccatggccctccagtctgggaacagagcaagaccctgtcataaaaaaaaaaaaaaaaaaaaaaaaaaaaaggatggtgtatacattacaatataaagcccctcccctgccctgtgatatacaggagtgttaatgctagttttgaggcttttgtttttgtcgttttgagacagagtctttctctatcatccagtctggagtgcagtggcacgatctctgctcactgcaacctccacctcctgggttcaagtgattctcctgcctcagcctcccaagtagctgggattacaggcatgcaccaccacacctggctagtttttgcatttttagtagaaaccaggtttcgccatgttggccaggctggtctcaaactcctggcctcaggtgatccacctgccttggcctcccaaaatgctgagattacaggcgtgagccactgtgcccaaccacaacaaggtcttttttatttatttatttattttgggagatggaatgttgctctgtcgccaggctggagtgcagtggcacaatcttggttcactgcatcctctgcctcccgggttcaagcaattctcctgcctcagcctcttgagtagctgggagtagatggctgcattttacagggcagagtactggagaggaaagagctgcacagcgatctgcagggtctccctcaagtcttcagctgcgtgctgagcagtatatgcatatgaggaaaggacaggattagggaaagaaccacaagaaagatgcaggaaggccgggtgtggtggctcacgcctgtaatcccagcactttgagaggctgaggtgggcagatcacctgaggttaggagttcaagaccagcctggccaacatggtgaaaccctgtctctactaaaaatataaaaattagccaggcatggtagtgcgagcctgtaatcccagctactcaggaggcaggagaattgcttgaacccgggaggcggaggttgcagtgagcggagatcgtgtcactgcactccagcccgggcaggaagagcaaaactccatctcaaaaaaaaaaaaaaaaaaaagcaaaaaatctgaagtgctcatacagtgccaggaatactttgtgttcccacaaaccagagtggaaagacctcctcatagttatcggtttgtgccagttattaatgtattgcctctcagctctaaattgatttttcattgcctgctctgtgaaaatgtagctgggccctttaattacttttcttttgccagcccagcatgatgttaagctttgtcaatgcaaagtgctagagagacaccgtgggagaaaggagcttttcttcctgattctggtgtgctccatgggtccatagcacatgcagcttctcagatgcagagaggggagctgggaaacaaggaccatcttctcacttgcttttttttttttgagactgagtcttgctctgtcgcccaggctggagtgccgtggcaaaatctcagctcactgcaacctcttcctcccaggcagctgtgattccaggcacatgccaccgtgcccggctaatttttgtattttttaaatttttatttatttatttatttattcattttttgagatggagtctcactctatcgccgaggctggagtgcagtggcacgatcttggctcactgcaaactccacctcccaggttcacgccattttcctgcctcagcctcccgagtagctgggactacaggcgcctgccaccgcgcctggctaattttttgtatttttaatagagacagggtttcactgtgttagccaggatggtctcgatctcctgacctcgtgatccgcccgcctcggcctcccaaagcactggaattacaggcgtgagccaccgcgcccggccaatttttgtatttttagtagagagagggtttcaccatgttggccaggctggtctcaaactcctgacctcaagtgatccacccacctcagcctcccaaagtgctgggattacaggcatgagccaccgcacccggccccacctgctttaaacaactaaaacacctgacagactatatgaaacagtgattccagacataggacaacaggcagaatggggagggctgttcttgggtgttccaccttagacccaggaagagtagtcgcttcttgtatctgctattcctgatttttttttttttttttgagacagagtctcgctctgtcacccaggctggagtgcaatggcaggatctcggctcaatgcaacctctgccctccccagttcaagcaattctcctgtctcagcctcctgagtagctgggattacaggcacccgccatcatgcccagctaatttttgtatttttgtagagacagggtttcaccatgttgcccaggctggtcttgaactcctgacctcaggtgatccacctgcctcagcctcctaaagtgctgggattacaggcatgagccactgcatctggccccctattcctgtattcatttagagttctgtttatttcttactagccaatcccttctaacctcaattccttgttaagttaatacctttttacattagactgcatgtggtgggtcacacctgtgattccagcactttgggaagctgaggtgggaggattgcttaagtccaggagttccagaccagcctaggcaacatagggtgaccctctgtctctacaaaagaaatgtaaaaattagccaggtgtggtagcacacgcttgtgatcccagctactcaggaagctaaggctggagaaccacttcagcccaggaggtggaagctatggtgagccatgattgcaccactgcataccggcatgggtaacaaagcaagaccttgtctcaaaaaaaaattttttttctttttacattaaactttccctgttcaaattgctgtgtggtttctgcctcttgactagatactgactgatacatgggacatcaagtagagtcatcagatgatactgcctcagtggtgagagcaaattagccttagaccaaaggctattctcctcttgccaaatggtacctaaaagcacaccttaaaaggatcaatctgtttccaaggaacttaactaagtccctgaacgaggctcaaatatattcaaaggaatacaaaaaaatctagcaccaaacaacataaaatatacaatgtctggcatccaatcaataattaccaggcatgcaaagacacaggcaaataatgacacaaagctgacccagaaatgtcacagaattagtagacaaggactttagctccaatagctattattaaataccatccatatattcaaacagatatggaaaaacataaacacgatgtaaagaggtgtgaagatataaaataagacctcaattgaacttctaaagatgaaatgtataatatctgagatgaaaagtatactggatggaaataaaagcagattagaccctgtagaaaacaggtttttgaagacttagcaatagaaactatccaagatgaaacacagagaggaaaaaaagacttaaaaacaaaaaacaaaaaacaaaaacaaaacctccaaaaccaaaatccagaaaatcagtgagctgtggaataacaagtagcctgtatacctgtttggagaccagaaacgtgggtctaacagattcacaggagagatgacagaaaaaatatctgaaggaacaataattttcaaatttgatggaaactataaatccctatgtcgaagaagctcaataaaccctaagcagaagaaatatgaagacaactacaccaagggtacatcataatctgccttaatcactgctgaacaccagtgataaagacacaaatcttaagagctgccagaggaaaaaaacacattgtgtaaaaaggaaaaatagaagtgatttctcgtcagaaacaatgcaaccctgaagacagtggagtaatgtctttaaagtacgaaaagataaaaactgtcaacctagaattcagtggagatatctttcaaataggaagatggaataaagatgcattcagacattccaaaattgaaagaattcatcatcagtagacctgcactagaagaacggctttaaaaagtccttcaagcagaagaaaaatgataccagatggaaatctccgtctacacaaaggaatgaagagagctggaaatggtaaatatgtgggtagatagaaaagatatttttctgattttaaaattctctttaaaagatacttgagggtttagagcaaatctaataatgtattgtggggcttatagcatgtgtagaaataaatccatggtgacaatagcacaaaggcggagaggtggggaatgggaggaaggtgtttgcgctgagtggtgtgatattacttgatggagatagactataagttaaagaagcattgtgtaatcctaaaagaaccacaaaaaaatgtaagtgtagtattatgaaccaataaaggagataaaatgaagatcacaaggggtgtgctggccacccccttggcacacagaacagttgggtggagttccccagcccagcagggtcccatagagcctctgtaggtgtttgggatagaatgagtaccgtcagaaagaaacttcctctcctgccaccttctggcagtaaatccagcctatttttaactcaggcctctgcttaagtgcttttggctaaaagagaattgctgcttctaagaatctcaggcagccacagtctcctcggcttctctgctcgctccagccctagaaggctcagggactgctcagatgtccccggcttcccaaccacttgtcccaggagaggaggctccctcaactctgggtgctcactgtgggcacccacagacaggcagcccttcagcagggtgcaggtgtgagaggatctctaagggatgtcatctcatggagactgcggggatggtgccacggagtggtgtgagggcagcctggagcgaacaaactgcagagtgttgctccaggagggtgcacatgtgtacaaaggcgccctgtgtgaaaagggcgtgctctgttgtgagtgtgaatgtttttgtgactgcttatgctgtgaaacataaacacagcagcctccgtccttttgatcatgctgccccctctgctggcctgtctcccctcgtagtccctcccagccaacacccacaccctagctggcaaactgccaatcatccctcaagcctctcatctctcccaaagtcttccctgacaactctggccagaggcccagccaaatggccgccagactcggggttgtatacccaggggttagcatgatgcctgctgtgtgcttagcctgcaaggagggaggaaggctcttaaggcctcttttgggggccgtattaggagggcactgagaatatttgctttttccactgtcagaccaggtcctgccaggccctgaagggcacccaagtgacaagcctggggtcacagagggatgcgagggtcaccctccatgcccagtgtgcttaatggtgcagagaggccaggcctggggtctgtgcccagagtgggcagtgctggtgtccaggtggtcagatatgggcatggccccacgtggagttggacagcctctgttgatttctcctcagggctctccctggaggctcaaggtctggcatctgtgtatgtgtgtgtgtgtgtgtgtgtgtgtgtgtgtgtgtgtgtgtgtgtgcaggcatgtctgtggtgtgggaagagggctttctcctgtctcaagcttagctcttactcttcccagccccctctgctccccaccattgtcttctccttcaccagcacaaggcaggagtgggtaggaggttcccaaggtccctgggaagaatgtggtgggcactgcgtgtgatgttgggtgtgggcacgtatctgtgggtgcacatatggatgtgattgagaagcccctgcctctccttgtgtttgtgtatgtgtctgggtatatccttggggtcctagaggttgtttttgtgtctcctgtggctgttgaaatgacctatcggtttccagagggtgtgaatgtggctctgatctaccccctcccacctcctccctcttctgattttcttgactctagggtttgcccagttggcttggctgggattgtcattgggtccgtgttagagaattgtatcatctgttgaatgccagccctcaagtgtgtcaccgtatgtgaccctggatgcaagcgcggctcagggtacctgggagccccttgccctgtgtggggtctggtgcctgcgtgagtgtgttatagacagtggggcgttagtatgtgcctaatacccatgaatggcttgagtgtgacggccgcaaaacgggtcgaatgtgcacacatggatgtgtgtgcaagtgatggatgagtgtgtgtgcgtgttccctcctgtgggtgcctggactggtccctcagtcccgtggggggcctctcccacttcagtggtgtgaacaaagcccctgctttcctccctgctttgccccccagccccctctccctcagcaccgagtttgattgactgtgtgtggttgcaaggttatgagattatatgattggtgtatggcatatgaagtgtatgccattgaatgtgaaactctagtatcccctggccaatgccagcctctcagaggcaggctggtggacctccggtcagttgaacctagctctcccaggttcctaggctggcccatccatccttttatagccaggcttggcccctgtaattacctggggccagatgctgtggcgaaggccaagagtttggtgctaacactctggggaggagtcatatctgcccctcccccaggccacaccggaggagactggaggaggccagacctctttggagtcagatcacaggccacatcactaggttcagcctgaagctgctctgctgctctgggcccagtgtgtctctggctgacctggccccagcacatctgggctatcccatccgcgtcacacttccccagactgtcgtccacaggctgcagacaccgagcctgtgttcccatcacctcccacctggacccctcttgccagtccatgcccccaacccagctcatgcccctcgttccccccctccatatcctcccgcccccctcatcctagtccttgtctcctggtcccagcttgtgtccttcattccaatccatggccccccagccccgtcaccaccacctccagtccacgcctctgtccctgccacgtacctccagcccagtctgtatccctggtttgccagctggacggaacatggaggttgagagagaatggcgagatttgcgtgccgagtaggtctgggctggacggctgtggactgagcccaagtccactcccaaccccatggcatctacaactaggggaggaaaagaagagagtggggataagagaaatggacggagagtgggctgggccttagcccaccctgccccaggcctgagaacagagggtcctacggcgcagctgcttgagtcccctcaaggaccaacacccgctccaccgaccgcaaacccatcccaagctcccctcacagctccggcgagtcccagcccaggtgctgcgccacctggtggatatcggcagacttgcaggccccgagtggcaaacccacgtggcagcgaggcttagaccccagccgggattgtaaatagctccttccctgctacccacagcgctgctggagtgacctctcaccccgaagggaggggcggggcagctctgaactttactctccaagccaaaatctctgttcagttgtttgatgttgctgttgtttttcaccctggggaggacgggaagaggagggatgtgtgcgatctctacctgtgttgggggcattaacctgtgacagcctctgggaatgccagcgtgtcaggtgggagccctctttgtgcctgtgctggagggggccaacatgagacaacacaagggtgaagaagaccctgcccagggtgaggctgctctgccctcaggccataccactgtgcctggtgacatcttaccactgccttggccaggacgccctgggctctgcagaccttggtgtcacaaagtagggccctgtaccagacaggctcagggtcattggtgtctggccatctaagtgcagacctctctccccagtcttccttacatgctctgggattgaaagcctcgctggacgggaaaatcctcagcagggctccgcagcttttaaaactgatttcatttatttattatttatttagatatttatttttgagagacagagtctcgttctgtcgcccaggatggagtgcagtggctcgatctcgacccactggaacctccgcctaccaggttcaagcgattctcctgcctcagcctcctgagtagttgggattacagacatgcaccacatgcctggctaatttttgtatttttagtagatactgggtttcgccatgttgtccaggatggtctcaaactcctgacctcaaatgatctgcctgccttggcctctcaagtgctgggattacaagtgtgagccacagtgcctgccaatttacttatttatttattttaaagacagggtcagccgggcgcggtggctcatgcctgtaatcccagcactttgggaggctgaggtgggcggatcacctgaggttgggagttcgagaccagcttgaccaacatggagaaaccctgtctctactaaaaatacaaaattagccaggtgtggtggcacatgcctgtaatcccagctactcgggaggctgaggcaggagaatcacttgaactcaggaggtggaggttgcggtgagatgagatcacaccattgcactccagtctgggcaacaagagcaaaactccacctcaaaaaaaagagtcagggtcttgctcttgctctgtcgcccaggctggagtacagtggtgtgatcatagcacattgcagccttgctctcctgggctcaagcaattctcccgtctcagcctcctgagtagctaaaactacaggtgcatgccaccacgcctagctttttttttttttttttttttttgtagaaatagggtctcactattttgccctggctggtcttgaactcctgggctcaagcgatcctctcacctcagtcttcccagtagctgggactaaaggtttgtcaccacacctggatattttttttattttttgtagagatggagtcttcctatgttgcccaggccggtctcaaactcctgggctcaagtgatcctcctacctcagcctcccaaaatgctgggattagaggcctgagctactgtgcctggccatttgttttgtttttgtttttgtttttttaaagatggggtcggctgggcacactggctcacgcctgtaatcccagcactttgggaggctgaggcgggcagatcacctgaggtcgggagttcaagaacagcctggccaacatggcaaaaccccatctctactgaaaatacaaaaattagacaggcgtggtggcatgcacctgtaatcccagctactcaggaggctgaggcaggagaatcacttgaacccaggaggcgggggttgcagtgagctgagatggtgccactgcaccccagcctgggcgactgagtgagattctgtctcaaaaaaaataaaaataaaaataaaagatggggtcttgctatattacctgggctggcattaaactccagaggtcaagcggtcctcccacctcagcctcctgttagacccactttgaatgccagccctatcattagccaggctgtgtggccctaagtcttagatcctcatctgtgttattggaatagtgaggcttacaaaggcgcagcactcggcacataggaggtgctcagtgaatggaagctggcttattctagttactgcccaaagtgcttggccctttcagtcttactattccagaatttttgaatctgcaaggccctcccccatcccatctggccagcccctatcctgcctggcccggggaattgaagcaagcctgcagcccaggcccactactatgggtcctcgagattctccccaacagtacccgaccccgctctgtgtatctcctcctgtctgaagcctctttcctctgtccctaggcaagtgtgtgctttttcttggcattcccacagctcccaggcatttacccacgaaagagctggttatgttgtcagttatgtatgtgtgtgttaccaatttctgctcatacatcaacacatactaaagtatgagcttattttggggtagagactatatcttgtgtctccaatacccaggatagagcctggcactcggcaggtgctcgataaatgtggattgaatgcatggacgattggatggataggcccaccttttctgtcttatcagtctgtagggagtctcagactggtctagtggctgcccccagttctttccccacctgctctcccaccccacactcttccctgttccgctattgggaaacccacccactctgcagagtctagctcagattccattttccatgttttatgggtagagaggagcagaaaacacagtccttaccaccaagggctcattctcacaaagcagccggcaagagccacaggggcacacaggatctggcctgctcacacagtgccaattagagagcctgggtgggatggagtcccatgggtgcacagcttggcaataaggtgtcccctccctgggccaggcacttggctcagcaagtgaagttgcaggtacatttcagcccctatccgcactcccttatgctgtgctggtctgtaaaccctgaccttctctggggcccctgggaagcggccattatcctgtcttttgcccttctgtcctctctgccctcccgagcgatgcagggtggtgtagttatgagcagccccagccccagcaaactcccagcaccttgggcataatgtttgaaatgagtaaaattacaaagggttataaagaaagctaattatattgaaagagttatcaaaacatttacatttcttgatatagtaatatatatgctttcttattaacacattaaaaatgaggaaggcctaacaactatgatcatttcaaagtactgatgagtgtaaattgtattttgagatatcttcaacaactataatgcagcctgaaaacgtgtgatttctggttacaaagtcacaggtactattaatactattatggcttgctgcccaagcacacaagagaatgttaaattttagttataggcaagtgaaaataaagatagttttttttctgtctaggttctcaaatcccctgaaatccatagactccagtcaagaacctcaattacagcatggaaggggaagaaaaggtggaaaccataattgatggagcctttaactccctgcgtcatttaatccctacaccaaccctaagagagagataccacaaccagtttttctggtgggatacctgagaatcagagaggttgagtgatttgcccaaagtcaaccaggccctgcctggaggcccctcttgctctttccaagcagcgctgcctttgtaatgaagatgagccccagaacaagatttgaacacctcgttgtgactctttggccccagaattccctctcctactcaggccctgtgccctgtgaggtttaaccagtgtaacagaagggtgatggccccttgaaatcacacacactcagttatttttatctccagtttattttttttagactaagagcagagtatgaaagtcacagccaaagcacttgaaaaaggcccaggaggataggtgggaccacatagggtgagcagggcaaggtcctgggagatggttcccggctcagggctggaagggagggggcgttgttgttttacggtctccaaaagtgtctgtgcgttgcataggtcctgtcttcacagaagacaaaagaggggccagggggtcccccaggtgtggggggcctagcctggtggggaaggggtctgaagctgaaggggaagtcaagaaaggtcagggggttaaagagggaagggactctgtctgtctgtacattatatatagagatatagagtctgtacatgcctgcctggcaccccaatgcccaccccttgccatccttgtccactgcccgcccccccaggggtgtctacttgtaaacttggtttcaatccaaaccacaatcctggaagtgggagtgggggaggaggacgtgcttattgctgtaaacaggggaaggaagcagcaggcagtgctgccccttgcccatctagtcccctccccatgttctgcccctggaggagagcaatgggggtgcctcccacgcttcgatttgctctctctgggggcatatgtctctctggggggacaaagggagagggcaccaggagtcagggaaaggtaccaggggccagggagtcctgagcactgccctttttggcccccaagtttggtaccaaacattaccagagccacaaggccgcccgggacccatggctgtccccgtgcttggtccactacagtgccctacgtggggggaaggggtagagggggcggacacagatgtatggtgcaggccccacttctagccatgggaggaggggtctaggcccactaggcttcccttggagaggccaaaggctccctgctccttccaagccccgccccatctctccccccccaggggagggggcagagctaggaggccaagaacgtcatgaggaagaaggcgatgcccacggccaggggcaggtgttcccgtttggggctggtcccgctgatgctcttctcaagcttgggcacctgagggttctctccctcaaagtcttctgtggacagaggaacagacagactggtgagggctgggttgcgcgccagggcaggggcacgcggcagcagcaatggagccagggacgtgaccacccacagggtaggaagtatcagtgcccccagggaaggcatgcgaggtgagcaggcaccggggcggggggctgcggttccagcagtggccaccagagggcgctgcgcagactcacccagcacgttgatcttcacattggggcccatggtgaactgggggagagtggggaccggcttctccccggagtgcgatgctgcggggtggggtgcgggtggggagagaggaggggagagtcagggccaggattccctccccttgctacggctggggagcaagcccccctcacctgtgccctccgcccccacccccaggaagccaggggagccccaaagcagggagctgaggatgggggcgcggctcggagcctattctactcactggaggcgcagcagacgaacaccttcatcctcagacacttccagtgcaggttgtgagtgggcgtggctggggaggagaccgggcctgagtcactttcgcccaatgtgtgcctgtgccctccctcgacggctctatttctcaccccctccaaactgtccccgtcgggcggtctccttcaggagctcccctaccctttggacacgggtcactttagctctgccgtcggccctagacgcccctttggtcccacccctcaagaaactgggatccctgatgttccaaccccggaatgtccctcacagaaacagcgattctccgcagcccaaacttgggactgtcaccaaactcctctcttggccccacgacctcgtctgagctgaacccctcaggcgtcccgtgcccacgcctcctccctggtctcagccgcgagacctggcgcccgccgcgccggccccgccccggagcctaggggctccaccccccggctgtcactcagactctcgcgttcagacccgcccgcccggccgccgtcactcacagatgtagtagtactcgtggccggcgtggaactcgtagcccagagagaaggcgctgtagcgctggaacttctccgagaacttgatggggctgtgcggggcgtgcggccggttgcactcccagcgcttgaagccctggctggcgttgcaggtgcggtagccgttgcggctcaccatgtacagcacgtactgctctgccccgcctccgggccccggtcccgccccggggcccacccccgagctgttgtagtgcgggcagtaaatatccagatagtcgttcacgttcacctgcacggtgtagccctctcgccgcaggctgtggggaagaggaagcggctcagagagaagaaaccccagagcaaagccgctttccatctgaccgctccgcagcccctccccagggtccgcgtagccttccgacttttcctccgagcttcctcgcggctcagccctgtctctgcccccggggccctagtgccgccgctcccctaagtctccttccgtgccctccttcttggtctgtccttctcctgttggccaccagagggtagcaaaggcgcagggaagcccggcctgcctccaaagaaaaggaggcgagggagaggggcggagggaagaagggaacgtacgctttggttgccacagaaacggcgcaggccccagcgactctcagacccaggcccggatttcctccgtccatcccccataattcagcagccgggaggagggatgggagggatggaagccaagggtgaacgtgggagggatcccctccgagggacgcacacaccctccatcgcttctcccaccatgcttccctgcggctgccagtccaccccggaggccagtccaacaggacctgcccttacagacgcatgtatggcggcttcatgcatatacatgcataagttctatggcacacgcacaaatatgtccaccgcccactcataggcagcagacacacagaaaagctgggctgtatgtgtgctggcccgcatgccagtattggttgaccccaccaatctgggggtctccccctgccctccccatactacagtatcactggcttctgtaccttgagtcccgtgacagagaccccaccctgaggccaaggacagttaggctcccaggaactttaaacacatgagggcgctaagggactcagtaccaagactccacatggcatcatgccaaccagcccaaacttctgtctcattgtgcacctccttcctcaacctggcacaacggccccccttaatgatgctgggcagagcagtgggcacagggcctagacaagatggctgcgcctcttatttccctgatccctctttgggacagagaagcagatgctgggtcccttgtaatccccacctgccttgctagtcaccatcaaagtgttggtcttaacaccctcgatggcagtagtgagcggtgtggggatggagaaacctctgaatggagaaagaaactcggagagggggcaggagttttccctaatttctttagcgtaagaatgcacatatcttggcagtgcaaggagagtggtggacacagaaaggcatggggtccttggcaaaatgtcataccacggggtccctagtccctgggagctccctggggggagagactggctccctatgtcaccaggcaccacccagttccccaaacagtaattagatccattaaagaaatgagcgtggaggcttctgcacacggtggggccttgggggtccctcccccctgaccccacttccttggctttgcttgtgctgtcccctccaccagcaacccattccaagcctgacagtgaggcaggcagagagctgatgtttgggtaccccagtaagaattggcacagcctcctttggtcatcaggaatgccaccagccccactctgttcccatgggattaatgggtcactcaggcccctcccttgccctggcactcaggtgggcaggagcctcggcctgcggcactgggagcaggaaaacgggttagaccaggcctggctccaaactgccatcctaggcttgcctgtccgtcaccaacccacagtctgttcctcccctcaggccttggggagggggcctccagtggtgagggtgccaggtctggagcagctgcacagccacactgggatctctgtctttgagcctcacccatgtttccagtcccactctgaagcagcccctccctgctgtaccgcccagttccccctacaacacaccccattccagcagggaggaagccaacacccaaggtattcctacaggtaattccatttcctcaacagggcaggactagccttataaaaaaggttgcagggcgaccacaggtgaagggaagccatctgttatgtactcctgcgctgggtggcaggaacagctcctgaaatgcccccccaaggctgggcatgtgagagaaagacctgccggtggggtggctgggcccagttggtacacagagggcacggggacaaacggggtgagagccaggaattcccagccacaactctttggagacccaacgtgtctgcttggcttgggcactttaattgaatctgtcatcctccctccttctccctagcagtgcggagagagaggtgccgctgggcccacgcgaagctccgcagctaaccccgcctctagggccgcgcctcctgcggaagggtgggggtgggctgggacctggggaccgggttgtgccctgccccttcgtactgttctctcttcttgctccacttcatcccctatagcctctcgcctctcttgcagaaaggcgaatgccgacacaccccatttggagggggtgtcccctcaccccgttatttcggtctctcctggctctcacagcctctgaggcgcatcccgacacctctctctcgctttcagtgccctgccggcccgcgcctggctccacttaacccggagtgtccgcggagggggcaggcgggcggagcggggaaggagcaaacttctcccccagcccggggcaattagggcaggtaaacagggtgtccaacaagaccagggagtagggaaaggatcccagggggccctgaacttgtcaaatcctcgccatcctccacccccagccccggtcttagacgccgggctgcagagttacaggggtggaggacgaatgtagacccgggttcctcttccctctagcgcgcgcccccgaggctgcgcgccgcccgctccagcaggcgaggccggaccacgtgtgcgcggcgtggggtccgcgcgcccgggctttgagggtggtggcggtggtggcgggaacgctggggggcggcggttgcacgctgacacctctgcgcccctcaggcgccctgggcctcggcgccccgcccgtcccagtctggacagcccaggtctgggcgcaaggcttccctgggccgcgtcgggtgggggagaatcagcgcgcccgacacctccgcccctcctccctgcgacagcggcggcggcggcggcgaaggtttattgatctgcagcggcggagaggagcgagagacctgccgaaagcgagacacagagacggagtgagggggagacacacaccgacaaggggagggtggcagaggccggattcactgaaaggggaaaggaagggagacacagtgcgagagagacgcagaaaccgagagaggcagggaagagaacgagaaccgagagtcttggagaacaggagagacaggcaggccagagaggcccacagacggcggagacggagacagagacgcaaaggagagaagcagggacagggaagggtgcaaggctgagactcagagactgggagaaaacacagagaaagaccatcagggacgtagtagagcctcaataaatatttgttgaatgaatgcatgaatgaaagagagatcagcaacagaagcatttcagagataggtcgagagacagctatatagaaagatgttcccgaagctccttgagaacggagcaaataccaacatccttgctcagttctgcaaagaaatgaaacacaggccagggggcatatatttggccatcggccgtcccaacccccctcaccaagttcgattcccggcttaggggactcctcgacctcatactctaatgcatcgctccaatacagtccccccatccctagtttctgggccagattgggaacaggtctctcctgttccacgggactaaatggaagtactgagtggggggcagagggctaggtcgcggccggtgtgcaaggcacagtccccaggtctgtcaaaggaggccgacgcacgtgacccccccaggaggcggggtcgcaagaccctccccacgtgaccccaaggggcagagaccctccgcacgtgacgggaggtgggagccaggagcccagctcacgtgactagggggagggggcgcgggagcctgtggctcggtcggccccgcccccagctccccggccctctccattctcggctccggagcacgtcgctctcacgatttatggggccgcggctgccgcagtgagggagccggggagcccgggcgcagcggcaacaaaggcccgggaagcgaggcgggggcggcggcagcctcctggcccggtgtgcgccccctcctacctctgccggcccaggcccgcacggagtagagaggacagaaaggaggctcccggaacccgggctcccccacccgctccctgagctttcacctgcgcccaggtgtatgcgggggaggggaacctgatcaacacctccccccaccaaacctattcccgcatcctccccggctctggcttcccctaagaacgctgaggtgctccaagggtggcggggaacccggggcccctcacctgcgagctctccgttccccgccagactctagcggggtggggggcggacgtgtgagtctgggggagggggctgagctagatagagctggaaagtcagcccccagcgccccccggagttcttggagtcccgctccgggggggaggggccacgtccccacccccgaggtttccatgggaagcgagaggggggcgtcgttggctcatccccacccccagtctgacactccgggcgcgaggagggagagagggggaggcgcggagccccaaacaacaaagagcggagcggcgagcggcagcccctcctccgagaggttgggggtcgcggccgcccggccctcccggtcccctcccctggggtctggccatttgctccctggtcggtcggtccctggggtgggcagccagaggcagtgctgccgccaccgcccgggcaggtgtgacagtgacccccgcgtccccagggatctccccctactaacacacagacacacactgatgtggccagggagatacacacggcggcttggcggggaggagaagacaagggcagcaaggactgagcagaatgaggacccggccccgcagccagcacccggccaccgcgccacacaccccgggaaaccacacggccgccctgacacccgcccagaccgcggcggcgccaacagccaccccagcccagacgcagctggccgcgcggacagcgaccgcagccccttccccgacccgcagcccgctcccacccccagacgatcgccgacgcagacacacaaatcacacactcagacacacacgcacactgacagccgcgcacgcccgctcacacttggagccattcgccgtccccagcccgggcgtgtgtgtgcgtgtgtgacacaccgacatctctctgccgccttccgtctcgccggtaccccacgttcccatcctaaccaagcagcattcccagggccccccaactcagcgacccagccctagctcaccctagccgggcttatccacacaaccaagacaacccattcgccttccttctagggaggtgctcggtcggactccctgcctcagctctggaccccacttttaaaagcaggagtcctagacagaacccctggaagccctcatggccaaaaacaggtcatccctgggccccaaaatgcagcggcctatccccagcacagcgctacccccaaaccccagcccaactggtgggactatgggacaggggcatgctattccagcggcgggtgcggagagaagccaagatggggtggggggcccctccagcagcctcctccacacggcccgagcgctccttactatagcccaacagcctcttcagacacccccgagtttcctagacgcccacagagtgcgtccccctctccgtcccctcccagcccccagctctggtctcccaggactcccaccccgggatcccccaggacttctcgggcccaccggctccccctctcactgagacgggacgcgcggactcccagggtccccgactcactgctggttggagctgttccagtacaccgcatgccggtttcccagcgcccctccgggcccttgggccagcagcggcagcagcggcacgggcacgagcagcagcagcagcagcagcggagccgccgccatccccggagccgccgccgccgccgccccccgactgagccccgcgctcccggcttctccgcttcccagctccctgctgccgccgccgtcggcccccagccttaggccacgcccccagcccttccctccgccctcctgggcgcgcccccgaagccccgcccctggcgcgcccccgacaggccccgtcccgctccggtcgggagcgcgcgacgcgtgggaggtggggaccgtactgccccctcgggaaagaccagcgcgtgcctcgtctctccttcttgagttcagtttgctacaactggtcctgggtcttttgctccccaggctgaatttcccagaaggatttgggaacccaagataaggatctcgatctcagggaagcccaatcatctctgggaatgaggggaaggagaagacttgagaagaagttggggatccaggacctcttagtaagtagggctggaccccttcccttctgaaaactgtggccctctgctgcgtccatgcccccttttcccgtgtgcatgaggactcaggtgggcacagaagggtggtggagaagtcctcagctggcaccaaggctttgacagctggtgacctgaagcccccagctgagcatgaggcttgtttatcttggaggcagagtaaaagagctcagcccctgagaatgtcaatactgggagctgtaagagtcttcagtggtccagaacccaaggcgcaggagggggtcaaggagagagtcagctggggcaaagcagggttccctggacacctacaaaggattcctcactggcacttaggcagggcccctcccggggcagccagggttgtccccagggattctcactcctactctcagagacgctgatcctgagtcagagggcagagcaccttgtgttccagctctcaccacagtcattgtcctcacagtgacacccaagcacacacatcacacacacacattcaggaaaaaaggcacagtcacccaaaggcagagaacatagagacacaggtgcctgacacagacatatggacacacaggtacaccttccagacacacataggaaagggtactatcagactgctagagatcaggcacagagacacccaagcacacacctatatccatccacacacaacacacacacaaacccacatgcatcctgacacacacagttccttgctctcctcttctctctttctaggaagtagaagttcaggaaaagggttcagaaaccagacctagggctatctgtcccttatctcttctcttttggagaggcccagaccaggcggaaccaggcctgactgggttctcagaacgcaagccaaccacctgtgtccagggagacaggcatgctgctactttgcttctatccttcaggagagggaacatgcaggcacctccctatctgcttatctgtggcaggacagagtcttgaccacaagtcagcctcaggtgctaggctgggggcaggggcggtgctatccagaataggttcagtgtctgactgctgccaggtgagagtagtctctgttttctctgggctcctctccaccccaggagatctcttcttccttctcaggagccagcaaataaattaggccccttgggatgggagtgggggactctgcaaacagctctccctccctgcaggctcctcatccccagagagatttgtttcacccaaatgatgctaacctgcttactccaggtgccacaaatcccagccccctccactcaaatcatattccctgctccacaagggcagcttctctctgtaggggcccacagttggcagagacgctgctcatattgatagtgaacaggaacttgctggtttggtctaggactttaaattccattttagaaaagatatatccctgtttatcgaatctaggttctgcttaagaatttgggcctttttctatagggcctgggtactctttagaatctggcacccccacacccaccctccaataataactgagcccttctcttagaatccggagccctctctacaggatttaagcagctctctctatggagtcgaagcctctggttttgaagttgagatactctttatagggcctagctaggcctgtgtccgtgggatctagtgctttgtctacctgggcctctatccatagggctgctagctgatttgggcctttgtgtgaattagaaaaaggacccttctttgcaggctcagtccctagggtgcatctcttggcaagtggtgcctttgtgcaaaaacaaaggtgctgcctccttcagtgagaggtggctctagtggctccctgtcttagtgagggagcttgggccgatgtccccttccccttgggtggctcctttgtgccatgcacaaactatatgaccatatatggcaattctgtctacaggatatgtgcttctagctataatgcctatgtctgtctataggcctctattcataaggtctgggcttctctagggactgagtccctgtgtataagatctgagccactgtccacatgcccagggcctaatctaaaggcctgggcttctctctgtggcatgtgagtcatggaaggacccaggccttattgatggggtctagacgtttgggtataaatgtaactcaaattgtttctgactgtgatccaccacagtaggattatattttgcactgcagttcagtcacacacacacacacacacacacactcatacacacacactcatacacacacacatttaactgaaataataagtttcatgaaacaatacttacccttactacagaggatgcacgatgatattttcctctgttctagttttaaaattaaaaacaataaaataaaaagctggttgaagcccataaaattgacttcttgactttaccatccccactatagatcacaacctatagtgtgaaaaactggtgtctaaggcctgggccctgaacgacctctctgttggatgagggcctctgtggaggttggagctccctccatggggctggtcctgttttcagggcttcaggcctcctcctccttacctgcaggctctgactcttgggcttgctagcacactgctggctgccaagatctctcccgggacactgagctcagctcctgggaggactctgacatggtgcctcactctcctccatccctcaggggccaaggaagcagggagctgagcaggtgtgggacagagggagctctcaggctgtgtggccgaaggcagcgtctgggacagtaggtggcaaccacagagctgagctgtgttcaataaatcatggaggctagggcctggggaagggggaggtcaggagggaagcggggccatggataaataattcattaaacaaataaacaaggagcctgtgagagggaagatcaggcacacgtgtgagcaagagaggcagctgccagctccaggcatgaaatattcacaggttctgcaccttgcacagggcccgtgtgtgtggccccagcccaggcaggctgttggtgccgtcctaaccaggaaacctgggtcccagcaagtgtgtgtgtgtcggcatggctctgaggatgctctaacgtctgtgagttgacatggaactacatacaagcctgacagcagggaacataagcactggtatgtggtccagttcacaggaaattaggatgcagggcttggtgggtggcattggggtgtaatcacctctgattctggtcatgtcctgatccctctaatgagtccagcaagccaagaagcctggagctctggggtgttacactagaggtgtgtgtgagtcctctgaatgtatttcaagaaaagctgagaggcagcagtattggcttagcagtgaacagcctgggcttggattcgaattccagttctgccactcgctaactatgctagtcactcaacttctctgagactgcttcctcatctgtaaaatggggataataatgccccacctcagggagctggtagttaagaggattaagatccataatacctgggaagcacttaacacagtgtttaggatcccagaggcactggattaatggagggtttcttataattaagaggttatctactgaggtctgcccacctagaccagcccagactcttttccatttgttctccctcatttccaagctttcctaacagctaacatagggagagatgtgacctagggcttagaaagtatgcaaggggtaggaaaagattagatggaatgagaagaggaggttacagtcaaaaaaggaagtctctattcttgacagtgtggaagaagggaccttgaccttctcctcagaccccagagactctccttaagccttaaaagtcttcctaaatccagactttcaccaaagtttagctctctagaaagtgactgcaatggccgggtggctcacacctgtaatcccagcactttgggaggctgaggcgggaggatcacgaggtcaggagatcgagaccatcctggctaacatggtgaaacctcgtctctactaaaaatacaaaaaattagccaggcatggtggcgggtgcctgtagtcccagctactcgggaggctgaggcaggagaatggcgtgaacccgggaggcgaagcttgcagtgagccgagatcgtgccactgcactccagcctgagcaacagagcgagactctgtctcaaaaataaataaataaataaataaaagaaagtggctgcaatgcccatgcagtggctcacacttgtaatcaatcctagcactttgggaggctgaggcaggaggatgacttgagtccaaaagtttgaggctgccatgagcaatgatcacaccattgcccttcagcctgagcaacagagtgaaaccctgtctcttaaaaaagaaaggaaggaaggaagtggctgcaaggaggcagagagattggagcagaggtctctgagtagcatcataaccaccacccccaacaagtcttccctgccagagttctggcccccaccctctgcctagtggttgaaggcttccttgacaaaaatgattgtgtctgggcaaaaaccagaagagtggcaccccagagtgggtggggagaatccaggatggagagagcctcagagggccagggtggagtatctggcggcctcccagtaggtcccagcattccccagccctctgtgtcccctggaaaggatccgctccctgtgggagagccagcaaacaggtctgagctggcctgctcctccacagacagaagaagaacaggttgggggagggggcctgagatcttggtggggagtggtagcggtaacccccatgtctcctctgaggagttagggacagaggggactagagcctgggcacaccctacaaagccaggggcccaacccttcaccttctttggtcagcctgctgccactttgggagccaggggtctgggcccccaggtgtgaagatggtgcctgcccaccctttcccaaggagccaacatcagtctccacttcccctcccctgggctgggcaggttcaggccaatctgctgaagagcttcacagcaaacattgatctgtaataaaaccacaatgtgtttcaggagaagggattccagacacaacacacatacactaactcacacacatacatacggatgcaaaacatgccgctctgggagggcagacaccagcagtcctgaaaacacatccaaacatagacccacactgtgtcaaacccacagacattattagttctacacatcccctctctgccatatactttgtccttcaaaatcaaagccttctctgatgacccgttttccctgtgttcccataacacttcgtatatagctctatattagcattttcactttgcattataattactcattggccagtctgtctccttgggtaatctgaagatcccttaagggaagcgatcttgtcttatgcaagtgtgtgtccccagcatctagtatgcagcctagtatttacttagtaggagtagtgaggtgcttaataattgttgaatcaaggaacaaaagaataaatgccttctgacagtgggactcccatttctagaatccttcagaagcccacagtagaaaaccgtgcatgctactcaggcttctgaccctgccttcttttctcttggtcccctcaccaccactcagctctccagaagccctcctttccttcccttccctcagtgtgagaccacgaatttgagttcaacctgagggttggcaggcaaggtaagggttaatgacacctcattagtgtttaattggaggaaggaagctgccttggcaccagacaggtgggcaggcctgccccttgctggaaccaggcatccctagttccagcaccccgccaggcatgtgggtgatttggccctggagaccctccacccagccggggccaagcagtatagactagtactccccatctgtcaccaaacatccagcgggagaacaaactccttatcctttcttctgttgctggctttgccccatccgtccccaacagacactggagaatgggagaggtggggtatgaaggtggagaactgagggacagattacagagccactcagggatagattccagaaacagacaggcgacagggctggggatgtggagatgtctgcccaatttgaccttaaatgaagagaatgcaaatgagatgcagacgatatgcagatgaacacaggatctcagtactgacattcctggtggcagcagctctgcaccccaatgctgttgccaataaccaacctactcctaatctttctgcgttaagtggtgctgaccattactttgagaacgaaaaaggatctcaagagagataagagcttgcttgggctagggctgcaggacctgggaagctgagctccaccccagcttcctcaccccatcccaagcacccacccaagctgccacagcagctcaggcaaacattactctccaggttgcactcggacgcaccgtcggttgctatggggaccccttcctcacttccagacctgaaccaatgggcatcaccgctgatgacctcatgccccaggccccgggattctattggctatttggaagccagagcgcacccttttcaatggcgtcaccgctggggatcccccgacgaccccagctagcgtctggcctactgaaagaaaggcgcgctggaagctcacaatgtgctgagtgaatgaaaaaggaaagaaggaactaataaaagggaagaagaaaaaggggggaggtgacagaaaaagaacaaaacttcagggttgaatctggagaagaaaagggagatttgaaaccccagaaagtgtggagcaggattgcccgtcgcagagactctcaggctctcaaacagggagacagggcgaggtaaagatgagtggagttttcgcatctattcgggagagactagggcaggcccagcaaattgagggccccaccctaagccgcctagcgctactgagtttaggggagatcggtgacgccccaaaacttgcaggcctgcccagcctcctggaactgcgccctggaacacgcctcgacttctcgtgggtaaggcccggtgcctggaagacctcccagcgcctgcagcccgtctcggccccatgagtggactcagccctggctttccatggggacgcgccccgggactgaatcagccgcccgcgcatgctatgaggaaagttgtatagggaaggccggctgggcctgagcgcctgtggctgggcgggcctaagtttaagactccccccgccccccaccaacctccccagcccggctcccgtggtcgctgaggcatccgcccttgcacctgcaaggggctgggcggccggcaggggcgtgtgtccgtgtcaagtgggagcgcccgacagttagggcgtgcgtctgagtgcggagaaagctgactgggccccgcgtctctttcgcacatgcgttatcagcggcgcgtccgcgcgccagccccagccgcgggagcgagcgcgcccgcctggttctgcgaaaaggaggctggcctggggccgctgggagccgggtgagacccccacagttctcaatccagggaaagggctgctaactagtcgctcccagtctactccgcctatggcttcacttgggaggggcggaggtagcagtaaagccagtttccatggcaacgtgtagacaccctcctggatgacggtaaagatggaacttgaacacttgaacccaggacctgaagacctagcccatagcttctccttcagccgactacaccctccccttcgcgtcccagaccctcgcccccgctaaagatcaaggtttggggtgaaggccctgatacacgcacctacctacaagaggcattttctgaaaggtggcctcgaattgggggaagggacagactggagtccgctctgcccgcggtgctgccctccacccaaggcctcagctagagcaatcgaattaacatgaacgatggcagccgaaatgggtgcatggtggtgggggatagggcccccgccccctccgagagagaccgggatctgacctaggtgtgcaaaggggtgggggaggggttagaaaaccctagcacctctgtgtcggtctctggacctctagcgccctccccccaccccgccgtctcccccacaccccgtaaccatgttcacacgctgcctctcgctgccgcagccgggccgagctaatcagcacaacatccacctatcgatggctggctcggtgccaggcgggccggcaccgtgccagtggaggctgcggggcaccagggcgggtaaagtacagctgcaggggaaggggcgccccttacccaggcaccacctaggataccattcagaaagagggccccacttggccttgtggggatcatagcctcgcctaccagaggtggaagagacagtgtgggctgagagcagagggagccctccctcctcagccccacctcctcctcctccttataaaagctaagaacaaagaggccgctggggacggaggctttgatctgaccccaccttcccagttctaggccaggcaccgcccagagtgcccttggggagggggagggatgaccagctctcagggacccaggcattctgaaacccagatgctattaatactaccctttgcttttgctgggcgccctggttggtgctaccaggacttgggcagggccccaagcggatgggctgtcaggagcatctgcccctcctcagcacaggaagccggctggggaggtgagagagggtgccaagctccacagctgctgctggcacccaccccacattgcccagaggggtgcccactgaggcctggcatggatggcctgagcacagctggcatggaggtcaggccaagctaagctgagagcccaggccacagggagtcctgctatcagggaagtggcctgagggcagtagattggggagggcaacaaaaagatgagtggtttattgaaggtttggtctagatacttataaaaatacaaactggcatgaaattcaacctcatgaagagtccgtcttcatagaagacaagtgagtgatcccctggggagggcaaggtgctgccccagggaaaaggcccacagggcacagatggcagggcttcttctttgccctggtccagcaatcgacctgtccccaggtcttcagcctgggcccccagctggcttgaggatttgatcataccaaatcccagtcctcctgggggatgggctgagaccctcagagcagcctgcaaagcgcctgtgtttgtcttgcctctgcttcagagtgtccagggctgtctactgctcttctttagcctgtgatgaggggacaggctcctgcaagagtcacctcagaccctctgatctcccccatcaatgctccatcttgtcggtctgaattggcacccccagtgcaggcagcagggatccctcctcctccaggggatcttgggaggactctggctccttgggatgagagggaaggtctgcttggctcacagaattcgcagaagacgaagaatcagaagcagcagtaatagcaagagacagagggggctgggagtgtccccccctcgccaccctgatgtgccactctctccagggctcccaacaggatgggctgactcagactctgtgagggggagggggtagcactgatcagtcctcccactttaccatcctccttcctccccttcccattagcagttccctcctttcccatcctccagggtctcccaaaccagccactcccttcccatgatctatgacctcatcctttctaagccccaacttccaagcctccccaaaattgccaatagagacaaccaactcagctaagaccttgaagggccttgcccctggacaccctgttctcttggcccagctttaaaaagtgtacagtatgtcgggtgtgatggctcacgcctgtaatcctagcactttgtaaggctgaggcgagtggatcacttgaggccaggagtttgagaccagcctggccaacacggtgaaaccctgtctctactaaaaaaaaaaaaaaaaaaaaaaaaaaaaaaaaaatcagctgggtggcacacacctgtagtcctagctactcggaatactgaggcaggagaattgcttgcacccaggagggtgaggttgaagtaagctgagatcgcaccactgtactccagccctgggcgacagagcgagagcgagactctgtctcaaaaaaaaaaaaaaagtgtgcagtgaggccacacaagacatggtggctcacgcctgtaattccagtgctttgggaggcaggaggatctcttgaggtcaggagttcaagaccagcctgggcaacacaggccaggagttcaaggccagcctgagatcccatctctacaaaaaataaaaagtaatttagccagttgtgagttgtggtggcacatgcctgtaatcccagctactcgggaagctaaggcaggagaatcgcttgaacccaggagtttgaggctgcagagaggtatgatcgtgccactgcattccagcctgggcaacacagcaagaccctgtctcttaaaaaagaagtgggggagctgggggtggtggctcatgcctgtaatctcagcactttgggaggctgaggtgggcagatcacaaggtcaggagatcgagaccatcctggctaacacggtgaaaccccatctctactaaaaatacaaaaaattagccgggtgtggtggcgggtgcctgtagtcccagctactccggaggctgaggcaggagaatggcgtgaaccagagaggcggagcttgcagtgagctgagatcgagccactgcactccagcctgggcaacagagcgagactccgtctaaaaccaaaacaaaacaaaacagaagtggggagaggatggtgcagtagaagctccctcaaggctaaatggggagaagagaccacagcttgaagcttcaccaggacccctggagtctgatcctcctagattcttctcactccttccctccttcccaaggccccacattagccagtagggtccatgctcccaacccacttactcctctccttgcagcagacagacacctggagcctcaagcactggccagaactctctggagtgggcaccgctgggtagtgggaaagtgggaaaaagttagcacagggagtcacccctttgtatgcctcagactgtttcagaccctcccaggttttcttctctccaggtccctggaaagcgtttccttactttggggccacacccatgtatcaggccccatccagtcctctcatctccctggccccctttcctagctcctcctactttctcctttctagacatttccctcctcagtcctgagttcagcccatacctcaacccgatgtacattagagacccagccccctcctccttccaggcctctccttccccctccctacccttctggtacacaagaggtgtccagtgtgcccttggccactcacagatgtagtagtaagtctctccaggtaagaactcaaagccgagggagaagggtgtgaagcgctgaatcttctctgagaattgaacatggccaaagggcagggagcacacccagcgcttgtaggcccgggggccctctgcctggcaggactcatagcctggccagtccaccatgtacaaagcaaacgtctcggggccctcagggggccctgggccttcgtagtgggggcagacaatgtctaggtaatcgttgaggcccagctccaccacggcgtctcctcgaagcaacctgcaggcataacgcaggggtgggctgaggagtggagggcaccacgccatggccatggatgccagagacaccccttctcagaggcccctgccagcctctcctccacccatgtgcgatggagcagctcaggaaggcccgaggttcccagactgacaactcttgagagacaaagagagtgcaagaaatggatgagatgatcgattcacaggttccgagaggctaagacctgcagtgcccataaccacacagcttagatgtgagaaggagggtcaccacaccctgtcctacaggctggagctgccacacacctctctagctccagtgcccaacactcaatgtggtatagcaccaggcttgatcaatgtcaggtggatggatgctgtgaagaagctgggcagagaggcaggaggtacagttgcacacagtgcagctgcagacacagaggtggaaacaggggttgggaaaggtctcctcaaacagatataaagtgaggaacactgtcctttagactgacttcaacccaagggtgaaaagaatgtcacggtaaaaaaagaatgagggaggccaggtgtggtggctcacatctgaatcccagcactttgggaggccgaggtgggaggatcgcttgaggccaggagttcaagaccagcctgggcaacatggtgagactgtctctaccataaataaataaataggctgggcgcggtggctcacgcttgtaatcccagcactttgggaggctgaggcgggcggatcatgaggtcaggagatcaagaccatcctggctaacacggtgaaaccccgtctctactaagaatataaaaagaaaactagccgggcgtggtggcgggcacctgtagtcccagctacttgggaggttgaggcaggagaatggcgtgaacccgggaggcggagcttgcagtgagccgagattgcgccactgcactccagcctgggagacagagcgagactccatctcaaaaaataaataaataaataaataaataaataaataaataaataaataaaggccatgagtggtggtgcactcctgtagtcccagctacttgggaggctgaggcgggaggatccttagagtccgcaagttcctgtagtgagctattatgccaccgcactacagcctgggtgacagagcaagaccctgtctctaaattctaaaaattaaaaaaaaaaaaaaaaaaagaatgagggagtgggtgctaggtgcctcccttttttggccaggaggagcaagtgccaggcatggggggagtccacatactacccagtcttcagtcttctcaggactcccttccccacctcttgggagctgcctggggaagccagcacaggtgggaagggctggaaggggctgctccccacagtactgaatgctgcatgaaccaccccccataccacaaacacagcgaagcatgacttaggaaaagcctccagtgggtggtccaaggacgacctgtatcagttctgattagaaatgaagattcctgggctcagccagcccagacttactagaacgcaagctgagcaaggacagggccttggtaagttttgttctactgcatcccccgtgcctggaaaagtgcccagcacaggacagtgttcaataaatatttgtggattgaatgaatgagccagaaaccttaagattggggggtgagaaacctgaatttttaacaggtcctccaagtgattcagaagctttggtctgtgacagagatagagaattcagagtccaaggacaacaaaagctcttatcacttgttattggtattgtaatgacctgtctttatgcaggctctcctgcctgcgcctgttctccagagagtctgtggaatcccagagggcagggtcttgatcttctcatctatatagttaatcccctgcaacctagcacagggccgggcacacacagtatgtgtttaataaataaatgttagtgagtgaagaaatgaatagtcacagattgtctcaagtagaaaatcagaaagaaaaacagataggaaataggagaggcagggagacttggggagggggatggaaacagtaaaatatactaaggttcaaaggcaggcagctcaggagagagaaagaaataatagtttatatctgtacagcctgagcctctttcacatacatgacctcacttaccctgccagacttcccagggtactaggtattattagcccattatacaggtgagataaatgaggttaggaaggtcacgagacttgcccagaggtgattcggctagaagggcagggctgacactggaaagaaacagaaggaccaataaagacagagatgaaagcagagatagcaaatgagatcaggagacagagtgagagccagaggtgagacccagcgggcaggagagtaacccacgctctttcataagagtaaagccccctccctcgctctcaagttcgtcagccacagctccagcctgcgggaggctggggatcgccaggagagcagcgaggggggcggagcccggagtgcgggcaaaggcccccccagctccatgctccaagaccccctagacaacccttggggctggggtcttctgcctgccccccaacacatgcgggctgtggggagacccagggcgcgcctcgcccctcgcccctcccccctcccccgccggctcaaacaaaggagccccggcgcgcggccaggctcaggcggcgccgcgcaaagagcgggtggcgggcgcgcgcaaagcccgggagcgcgcagacttggctgtgcgctcgcccggttcggcccggctacctggggttactggagttccagtagactacgtggcggaggctggagcccccgcgcagaggggagccgaggaacgcggcccagaggacagtccgcagcaggggcagcagccgcatcgcccccgaggtccggtttggtctggcctggcaggtcccggcccgcttcacagtcgaggagagaaaggtacaaagtgaagagggaagttgcggaaaggggagtggggtacggagattcactgaccccgcccctgaataactttccgccaatgggagcgcgtctcctcctctccacccagcgccaactccagttaaccctctgtgcaccgcagcgcgcgccaggttcgccaaagcttccactgaggctgcaccgcactgcgagggggcgggaaggaaggacgtattccaacagcagtatttttagggaggtcatctctttcgtgtctgctttagtgcagggtagactgccttattagaagtttggaagattttaaataagggtacataacctttgcccagataggggaaagtgaggcgcgggcgaggatccatgaagcctgtccaaccaccttcatgcactgccccgttttctttgcacatctagggacagtgcaagcggaagggacaacacagctctgggaccaccttccctaaagagccttaggtggcgcgctagatgctcactttaggattggcgtctgtcccttgccgctccacaccttcgttccgggctgggggcccacgcggccccagtccctaagacgaagtaatgaggtggttgcggcctgtacaaagcacctttgttcccgatccctcaggtggcggcggcggagggggaggaggcaggtgcgcggccttgggatcgtgggagcagccgccgccccgctccgccctggctcctgggctctgggagcatcagccagatccacttttcccagccaatggtcagagtggggacggcaggtccaacagcttgacagattgcgccgaaagccaccccagtctgggcagagggaagctgcgagcatcccggggacacacgccgaccctttctggtactcccgccccacacagcccgccctcgtctgaggcggcagcgtcttctggcggccaaacctggaaccgcagcaggagcgacccgggttctagaagcagacaaactctggggaacgctcccaagatgtcacgtttattgcaactgagcagagacaggctgtgcggaccttcctcaatcccgtccaacccccagcccctccccaagcccccgctgcaactacgccggcaggtccgcagagtgttgcttgacagcgcgtggcggtgcccggagtcttaagacaccgccagtctctggcgccttcagtcatggtaggggactccagagggcacgcccgcctcttgaagccctaagtccggcttggaggcagcggaacctccggagaggtcagaggtagagcgaggacactgtcggaggcggtggcgctggtctggattgcgggaagccaagaaaaaagagtcagaggcccctttcccccaggtcactcgccccgcccacccatgcccagggctcctcctacctggagggtaccactaggggcgggattccagcccctgggccgggcaggtcacccgatgggcaccggccctgggggtcggcaggcagtggcttccttgggggtgggggcttggctggcccctgagactgagggagagaaggcaggaggccggcttaggtgggggggtgtcatgttgcccacccccaacgcactggtgctggggaacaccagcttgggggcagcaccagcggtcacccttgtctgcaaacaaacctgtcaccattaaaggcaccaccgggatatgtgccctcatgcactgagggggcatctcgccacggccaccaccgtcatggctaccagcaccacagccctaggtggggggagaggccgtgcccttctctccccccaccgttaccttcgggcttctcaccaccgggtcagcgggcagagggcgggtagggggattgggtcggtcagccagctcagcctgaacagagagaggggcagtggctgtgagagcataaccaggggctgtggacatgcacagagattccccagaggggttcaagtcaacatgcaaagtcagccagggggcaggagagaatgagggcatgcgcagagggcttggaggcatgccagctgatgtctcaggggaggaaggtgtaggtcaaccgcagtccctggccgactgcagtcccgccattgaccaccagatggtggtagaaaccaaggcaggaggctcaccctttgctgcttctggggctcagagtgtctgaaggctgaggggcaccccgatcacctaatgaagagcaccactggcagggagcagggatgagaactgcagttgggtaccaagcctcccacctgccttggctcagggcgggccctggcccagatttacctggagtctcttggacacagggtcaggcggcagcggcctggaagggggggccgggaagctgagagcactagcctgctgagagggcaggaggggcagataggcacagagggggaagaggaagcagagagacagagtgggcagggaagggtcagtgcccagggggggccagcaggggcccagggcagtgggtgctgtgcatgcagttatgcaggtgcatgcaggtggggagcgagtggggaggaggtgtgcacacactcccatcatccaagcagagggctcagggtggggatgctcaccagcccttctaacatggtgacctgggcctacggaaggccattctgagcaccactgcccttgtgccctcctggggtcactgctgggggcatggatagatccacctctcaaagccacctcttggccagcggacggagcccagcagctcctgctccagctggctgccctccccactcttctggactcagcttccctgcctgtagccaggggaggggagggcagggctggccctgactccttcgactgactcttgggcagtgctagcctttctctgagtctggagcctttaatgcgcaccccccagggcccaagctggatgcccggccaaggtggagtccccttcctctggcatccaggactcaccttagtgcctcgtgccagcagggccctctgcggaggtcctggccgttcagagggaccagattgggctgccctatgcatgaggaaaggcaagaagggagagggcccagcctcagaccctgttttctaccatatgccatccctgagtggggttaaccctttgcaggcacttatgtgtggtttaggtaaaattgtggtagggccggggtggggggcagtatttattagcttgagggaagaccctacttatccagcacaggggctcctggggagaaatggccctagcaatccagccaccccacaggggcacagctgtgaggtaaaaagctgtgggcacatatagggaagggaggtgtggggtatggcagtcagcaactttaaggtccaaggggcctggggctcagaaccaggtggcaggggctgcagaggtgaggcagccttcagcactgtccccagttgaaggaagtggtagcagggaggtgatgctcatacctgtactggcaggtgggtcccttgagctggcagagtcgctggtgcaggcgggcacggtaccagtagctggcaccaagcatcaccaggaccaataagaccaggaggctgaggagcagccctgtggtcagggagctggttgctgtgggcggaagtcaggtttaagggaggacggggctaagaactctagatccatgaaggcgcagggggcagggagtgaagtcaagtgatcagggagagtgaagggttcaaggggcacagactcagggaaccagcagcaaaggggggtcagaaagagagggccgagggggcaagataaagcatgagacgctttgccctcccagctgcccctgtcccccacccccatgctacctttgagctgagtggtgcagtcagggggtgcccagccctcctcacagtagcagtgcctgttgctgtcacagacctaggaggtacaaggcgagcaatgaggagctctgcactctggaactatttccttgtctctagcttttcaagatctcagatttctacaactgggggttgtgctgggtatgtgtgtagagacagcccggagggagggtctttatccataccagagcaaattagatcaaactaacacttactgagctccttctgtgtgctgggcactgtggtacatgctttctttctttgtgtttgttttgttttgttttattttattttattttagacagcaagtaagatggagtctcactctgttgcccaggctggagtgcagtggtgcaattatggctcactgcagccccaaactcctgggctcaagcagtcctcctgcctcagcctcccaagtagctgggagcataggtgtgcaccagcaggcctgaataatttttaaatttttccttgaaagagatgggggtctcactatgttgaccaggctggttttgaactcctggcctcaagtaatcctcctgccttggcctcccaaagtactgtgatttggctgggtgcagtggctcacccctataatcccagcactttgggaggctgaggcgggaggatcacttgaggtcagaagttcaagactagcctggccaacatggtgaaacccatctctactgaaaatacaaaaattagctgggcatggtggcgggtgactgtaatcccagcgagtagggaggctgagacatgagtaatgtttgagcctgggaggcagaggttgcagtgagccgagatcacgccagcgcactccagcctaggcaacagagcgagactctgtctcaaaacaaaacaaacaaacaaacaaaaaaactgtgattataggcatgagccattgtgcccagcctgtgctagatgctttcatactcatctcatgtaccctggatggggatactattattatagccatttgataggtggggaaactgagctcagcaaagttagtaacctgcccgaggtcacacaactgggaagtagtagagcaaggattaaaacccagatatgtctatttccaaagcccagtatccttttcctctctagaggctctctgctccccttccacttcccccatcccagctcaccccatgtccatggcatttgcttcgacattcctgtgcccccaggagatccacacgctggcatcgatggtctatacacacctgacccagggagagaagagcctggatcagattcccacaaagctttaatgggactgggaggccaataaggttgaggccataccctgcgtttacagatggggaaaccaaggcatagtgagttgataggactttgctccatctgaagtaagaaactgacttcccttggagtccctgcctttgacattggtgaatggtgaagtctgggctctgttcattgtggtccaaatgtcccttctcacacctggtcttgcccacccaggctgctcaccaggccagggccacaggctgtgccaggcagagtcaggaggggctgggccacatcactgcccaggtccaggtgcacccagctgcagttcagctcagtcccattcacatctattgtctcccagagtagatcccggatggagcccagcagaggctgggtcctacctgtctggcactggagctgcccacaaatggcatctctgtggggagggggaagggcacacagagttagtaggagcagggccaaggctctcagaaacccaaaggaggagccaggtttcctcacttacctaggggtgcaggacacataactgccactggggttgcgcccacagctcccaaaagcatttccccgagtattagctgtctggaggcaaagtggcgcagcgggctgggctccaggtccccaaagtgactggcactgctgggcataggaggcacaacgcccgtgcatgcacacagcttgcccgccagcgcagggctcgccatcccctaggctgacatcagggggacactgggagctgtctcctgggcagaattcaggcaagtcacaatcccctctggtaggacgacactgccagccagacgggcgcagctgtggagggtggatgagcatcagtgtgggcactgagcaaatccagccgggggtcagaatgaccctttccaccttggccccggcaggtgagctccgggtggccagtctagtctctacccacctggcaattttgacaacagggtccgtcagatgcacactgtgcacctggcctcagctggcaggtcaaagaatcacagcagggatcgacgcagtcctgtgggcaggagcacgggggccgggcatcagagcaggtggggcctgtgagcctccctccaatctctcctcctcccacaggccaagaccagaagctacacagcaagcgagggctagagcccaacaacccatgtgctgtccccacagacagggcaagtaggagaggggtggaaagtcccttcagaacccaagagctcaggaggctgggatagggctaatgagccagggtgagggtacagaagtgagtggggcgaggctttgggaaaggggctcacatccaggaagccacagtcacactgctcgcccggctccacaaacatatttccgcagaaagcagccatagggggtaggctaggcagccgttcgaagaggcagctgcccattccatccaggagggctttctccagggcccgtcggctgcagttgctgaagttcaggcctggtaggaagctggggagggtggcaaggaaggttggggctgggggcctctccctgccccctgccccacaccctctctccatcctgcagctacttactctgtggaggcctccatgatgcaggtcttggctggggctggacctggacaggggcagctattcccaggcaaatcatggtccaggcccaggctgtggcccaactcatgggctatggaggaggcgactcccaggatgctggtggagtggtcctgtcattggggaggggtactgtaggtccagtcccagcctgcctccaccacaatgcccagaccaccctctctgctcctgttccctccacgtctgacctcgtgggcactcagcaggcactgcttccctcctgaattgcttctaaagtaggagaacccaggcctggatggcagaaacttgggttctagctcagctctgtccccctccctcactggagggagatcacctctgttctttgggccttagctgcctcctaccctcctctaagaaatgggaagactgcacaggggatgactgtgtacactgtgactagctggccataagcgagggctccctgatagcaaaggccacatcacgtacctccaccctctatacctgtagctttggggttgggcaactttataggggggtttcagtgcataaatgccaccacacttgggaggaactgaattgggaatgaggaggagacctggaaataactcaccatgttcacacctcctgagaagtcaggagaacagatggagttctgaatggccatgcccaccgtaggcccagagaatgaagtaccactgtgggacagagaggctaaagttcagggccagaagccacggtggtcagagcttcaggggctgaggtagggtgctgaaggggtgtgaatttggccaggacaggactggcctctctggctgagtctggggcccttacgtcaccagctgggcactgtcatggggcaatcgaggcagcaaatgtgccctgcgccagtggaggaagttttcgagggtgacagctgggtttgggctgatctccaccaggtcacgctgggtccaggcctccaggcccactagtgccactcgtacattcaggggccggaagaactgaaagacagctggggctcagaagaggggttgccatggtcaggggcctggggtgggggttgccctgtccagcactcactgtgtccagcaagagggccacttccagtgtgcggtttagcaggtgctggaagtcccggtatttctgggcctgtaggccaagagaggtgacatgaaaggcggcagggcagtgcagggggaggaggatgtgcaggggccagcaggctcacctccgagtgatcagccacaatcaccaactccacagtcttggtctctgttaccacatcccgcctctactatggacaagaagaattatcaggcaaacctgccgctcgcagccagcagctgtgccgggctgaccaagaggcagccactcctactctgtgggtcaaataggagggtgaagagcccattttacagatgagccactgaaggccagagggcccaggaacttgccaaggaggaccaggaagtagataatgaaggttggagtagacccctgcttttctggctccaaactcagtggtttttttcaaatttttaaaaaacagtaatttagctgggtgcggtggctcacgcctgtaatctcagcactttgggaggacaaggcgggtggatcatgaggtcaggagatcgagaccatcctggataacacggtgaaaccctgtctgtactaaaaaatacaaaacattagccgggtgtagtggcgggcgcctgtagtcccagctactcgggaggctgaggcaagagaatggcgtgaacctgggaggcggagcttgcagtgagccgagatcatgccactgcactccagcctgggagacagagcgagactctgtctcaaataataataataataataataatttttaaaaatcccaataacaactcttgtcacttaccataggtctggcatagttttaagcactttacatctatatggacttatttaatcttcccagcaactctatgcagcaagtagttttattatcttcattttacaaattaggaaattgggtttatattgcttcatcattggtaactatgtattatctataaccaagtgagagctctctgcaaatgggatcataagacagatgaagagccaaatacaactaataaatggataggccatttattagttgtagggcctcgggcaaaccacctaatctgtctcagctagattttattttattttatttttattttattttttgagacgaggtctcactctttcacccaggctggtgtgtagtggctcgatctcggcccactgaaacctctgcctcctgggctcaagcgattcttccacttcggcctcctgagtggctggaactacgggtgcacgccaccatgcccagatactttttgtaaggtttcgtcattttaaaatagagctattgatagcacctacctcctaggtatgggaggagtacacgagctaatgttcacaaagtgcccagcatgtggaaagtgctccattcgcaggagctgttgttactgtgcacacatagctctaagtgtctggggatcagccctcaagacaaccaaagcccacccccctgccattcatcctcacccggcgaatgtggcgctgtcccagggggtgctctggtggcttctgagtgtgtacagattcccgccagctcagggcacaggtgtggcctggcaggtggagatcttggattcgcgaaataatgggaggaccctgaaggtccccaggcccctgctccagggtatagcttctctctggggtcaggaccaccaagcctctaagaaaaaagaaagtcagagaacatttcagctccatgcctgggtctccttactttctctactgtcattaaatccgcccagtatacctgagcccagagcaggtgcagatggacacccaggagcctgcatatccccgcactcttccctggtagcagcagttctcctgcagcatgggaacaacattagtgctgtctcagagagcacaccaggactggaactgaggagcctagcttgacggtaaaaatatgcagtgtcctctcaccttccagccaccccctccctctttcccctaagccaaaaatggcacaagagggcctgactcaccaaagtgtgtccctcactgaccacccgagtgccatcgggctggtaccacaccagggttgggcggcctgggaccaactccctgtggagtgaagaaaaagaaggcagtgctaaagccacttcccaggtcgtgcattgacaagcagaggcttgaaggtggttgtggggctggggaccaggcaacccccgcagccaacttttccactcctgaccccggggcagcaaagtatactggttgggccactgactctgttagtttatttgaattccaatctggttttcaccacatactagctgtgtgacctggggcaagttatttaatctctctgtgccttgacttcctcatgtataaagtgaggacaataatacatgatagtatatcccttatagggctgttatgaggattaaatgagcacaagcacttagtacctggcacataataaatgctatacaagttgttggccatgtggtcactgttattgccaccatcactattacctattctgtagcagctccaggatatgactgtcaccgtccagctccaacttgatcctcaggggctcaggcagactggtctgtgggcaccagagggcaggtcacctccctagacctgtccacaactcccagcctctctaaccagaaaacctcaggcccacagaagagcaccagcaattagatcactggtggggggatcccaggggaggggccaggaaaccctgcctggcctggagcattgttctggggggttgtgtgcggaggtcaaggaaggtatctgagccaccccttctcggcttcctgcccagagaggaagcaccgtgtaggacccagcacaagccccagcccttcctctgactcagctttagaatggggtgggggggggggggtttggtaaggtcctgactctttccaaatccccccactgagaaaaccgacaacatgagatgaagaaagcaagtttggcttcacaatttccccagtggagatggatgggttgggtggggctgaggcagacagatacacgtgtgtgcagagggagagggagataagtgaagccaggtgctggggtgtggtgggagaggcagctgggcctgggatagacccactacagtgagctctacccaccagctcctcagccaagctttggctttgagacacctggctataccggggcgtgtgtggattcgtttatttattagaggggagtgagagctcacctgaagcacctttttgaggctaattgggagatcgtcctgaaggacctggggctccaagggctccctcggggccttctctgactctgcctgctgctcctcagtgccacctgcaggtcccaggacaccccaagacagtactgagggaatcgacagcagggctgggggtgacaggtgccctcagatccaccagctcccagcccatcaagacccttaggtacctgaggggcttccacattgcatgctgagacttaaagaagaatactggaaggagagggtgtctctctaatttatggctttccacccaccaacccattcacaagtccccaagaaagactttcggcttgcgcagcctgtggccctccttgtccccttccggccaatcccaggttctcacaggaccctccccggttcccactccctcccaatcactctccccccacttcaggaacgccccctctcgagactgagctaagccttgtggccgggtgcccgctcaccctccccttcgctcacatcggagatgccaggaacgcccatttctgggtgagcagtgcaaacacccccacctccctaaacaccctcatgcccagtcaggcacacccgctgcctacagcctctgcttcctcctcgagcaccccccacccccccaacacacaatggccctctctcctccggacactccacccgcgcctgccctctcggtcccggcccaagacagcagcgggaagtgaaagttccaaggaggagttggtgtcccagcctctttcctggccaattctcccttctcctggctcatctcgggcccctcccgctcggccaggcactggtggcaacagcaccagggtgaggagtgcctggcggccccaggcctggaatagaggctagagagaatcctcttcactaaaccctacaagccatgcccgctcagcgccctggcaccgggtcgaacggttagctaggccccagagcagcgaagatgccagtcctggggagcagcgaccctctcatcacgatcttgaagtggcgctggacaggcccctcggtacctggtacctgagcctgaaagtgtccgcagggaccgcgcagaggatgaccaggcaggaggcagggggcgccggcatcccccctccttctcttttcaccccatcgccaagtcaccgggccctaggcccaggacagcggaccagggcgggccgcgctctggctgggctctcccagggtctccgtccggccccattaccctaatgccttccgactttcctgcacctccctcccagtccgccccccgacccactccaggcggaggactcacctatatttgggagcggccaggaaggcagagggctgcccgcgcccaggagccccagggcccagagcagcgccagccgcatggcagcggcgctccgggccgggcgagggcagcaagtgcggaacagcgcgcggaggagcggccggcggccaggtcgcctcggagaacccagcagcgccgcgcggccaccaggccccgccccggcccgccccctcccacccggccccaagccaagctccgcccccggcaaagcccgccccgctgcgcgccgggtgcctcgggagcggggacaccgcccactacgcccgcgctgctcagcgctaccgcttccccgcaactgtgcggagtgggagccggtgcccggtccgaccggcttgggcggcgcgccttcacccggcgccaggtccggacccctccctagtagcttcgcggcctccctgcctcctgtgcgcggcctggctcggagaggtcgggcgggcaggctttcccgactgcaggcgaggcagtgcgcggctcaccccagtccccgacccacgtgaagcgtacagggcattttattaaccgggaaggacggtgcggaagagcgagcaggacgcctcttcaccccgcgtaggcagtgtcgtcgttgctgtcactaaaggcggaggaagagagctcttcgcggggcgtgcagaccgggcaccgctgccgcatgtcgtcccagcacgaccagcagtacacggcctcgcagtccagcgtccggcacacgtaggactcgggcgtctcgggtgcctggcacaccacgcagcgccggcacagccagcggcgcaggagcgggcagccgcggtgcaggatatccgccagcgggtggcgctgttgggaggtgggcgttagcgccagcccgggagcgaggcgggaaagaaggggaactggacagcgtttcctgtctgaagtcgccaggcctgacaattcccgcgtgttggaggaggctgggttggacaaaggaaacccctggagggcgagggtgcctccctccccaactctgtgatggagaatgggaggatgcaccctccaggctctctccaagcggatatcagccacaactctcatttgcactttcctgtaaatcatcttatttggttctcacagtgaggctgagaagtgagcaggccagatcgactatcactgttgctatccccactttacagttgagaaaggtgaagtgactctcaaagtcacacagatagtaaacaatccaacttggctggaccccaggggccctgattccaaaccacaaacctagttcactatgctccctgccatccctcacgacatgtctctacacagttgtcagggattttccacaggccaccttacccaggaagcagccactctttgcccaagaaactccagaggccctgctgcctgccagacaggcagaactcttgggcttggccttcagagccttccctcacctggtccctttctagcctctttcctactttagccctccctgagagctgtctcttctgagccagtttctcctgagactagccctggcacttcgcattccctgtggactgagtctttgcacattctgcttggaatgactgtctggcacatttccatctgtgcattcacattcagtttgcttcacgaccctgtcaaggaatcccagcatgttcttttttgttttttgtttttcattttttcacaacacattcatttggcccctattgtgtgtcatgggggctgggggtatccaggccctagggaaaaagctaagcaaacacagtctcacttttatgaactttgttaggactgattaaataagaatggctgccactcattgtttataatgtcaggtcctgtactaagatactgtacataaattatttcaattctaaattagccgggcgtggtagtgtgtgcctgtaatcccagctactcgggaagctgaggcacgagaatcgcttgaactggggaggtggaggttgcagtgagccaagatcacgccactgcactccagcctgggcgacagagtgagacttagtctcaaaaaaaaaaaaaaattcaattcaattgtcatgtaaggcagatagtgttattatcatctcctttttttcaggtgagaaaactgatgcttggagatgtgatcactgcccagggtcacccaatgataacatgcatgcatatggaacttgctgcatgccagcaccatgtaagtacaactcatttaatccttaaaacaaccagatggagtagttaaccccattttatggaaggcaaaagcccaggcacagcagttaagtcatgtgctcaaggtcacaccgttgtcatagtaatgagggaaggagccgggatacacacttaggccctctggcaccggagtcccacacctgaccaccactctaggctgatctccagtgagcaggccttacagatctctccagtcttgccattcttcagagggagaaactgaggctcagtgaagaccttggccaaggtgacacaacttaatgagggagtatggactggagtctgcttcctcagattccatgtgccttaccatgtgcccctgcatgaggccttcctgactcccagcccacctgcctcctcctgtcccttgaactgcactgagcttctggtctgcagccctctggtagaaactttggttttgccttgggcctcctgtttctgtgcggccctcttgcttttctatgagcagactgtattaaatctcattctccttttctgcctgcttcctaatggtccactgagtgtcttaggctgggctgaatcctgggattcagaaacgggcacagccctgaccttaggagctggatggctggggccctcagcatgtgttgcatcagattacaccgggcttggctgggcttggtggctcacgcctgtaatcctaggactttggaaggctgaggtgggcagatcacctgaggtcaggagtttgagaccagcctggccaacatggtgaaaccctgtctctactaaaaatacaaaaaaatagctgggcgtgatggcgtgtgcctgtaatcctggctacttgtggagtggggggctgagataggataatcgcttgaacctgggaggcagaggttgcagtgagccgagatcgtgccactgcactccagcctgggcgacacagtgagattccatctcaaaaaataaaaagaacttaccaggctcgagtaggcctgcgaccattggtgggtgctgggtggactgaagggagctgccccttgcctgctgtacttagacccagccaggagctggcagcagcacttacgcctggacttaccggagccttctgctgtcgctcccgcctcaggatagcggccctcctgagtttggtgaaggctgctcttttcttcaataggtcattgtagaggaacaggatccgcttcttctctcgctgggggcaggaagggggtcaatgatagagaaaggcatcccccaaatatggagttggtagggagctgggtggtgtgtgtgtgtgtgtgcaggtgtgtaggggtggagaggtctggggaggggcaaaccttggggaagtagaaggctgcgatgaccctccggagtcggtagccaaaagcctgtaacaggcagagacacactaacaggccaatcggtactgcagctctccagtaggccctggcatccaggcccacaggctggggcaggcaggctaggggaggggcaggccaggggtctggtcaggaccagccaaggggcagggcagccctgggttggacttcccatcccagtgggaggtgcagtcctctgattcccctgctctcctcctgcctgcccctcactgcagaactgccctgtcagtactgtagccgctgggcccaatgtggcacagatcttgcagatttctatcttgactgaatgtcctgttggacagtgctgctctggagggctggggccccctagccacaagaccctggcctccagactcctctgactgaagctggtcatgctcccctttttcaagcctgcccagatgtgttccctgctccgatttccccagctcaagcgctccaacccccatctctccacacccaaggcccaggcccctaactctttaccttggagtcttttgacccttgccccaccgccctcgattcctctgatccaaactttcagcatcactcacgcatgttgtttgattccatcactgtctctgaggaggtgttcagggccccaatggtttttcgaagaagccgggctagcatggagtctcccccgaccttcacctccagtttatgactgcctgcggccaggaggacaggtagggaagtcagggcaggtggagaaatcaggaatgtgttaagggggtggatgtcagggaggggtcaagacacagaaatgcttctcagctgcctgagtctttctgtcccttcctgaatcctaacccctccctgctcccagttgtaagtgtaaaggggtacagagcccccctcccctgctgtgagagctgtcaggttgcagggctgtcatttgaccttgaggaggacagggaggggctgaatcacagaaaggggaaaagaacaggcagaaggatggctggcacagtggcacacacctgtaatcccagcactttgggtggccgaggcaggtggatcacttgaggtcaggagttcgagaccagcctgaccaacatggtgaaactctgtctctactaaaaatagaaaaattagctggccgtggtggctcacacctgtaatctcagctactcaagaggctgaggcaggagaactgcttgaacctgggaggtggaggttgcagtgagctgagattgtgccaatgcactcctccagcctgggtgacagagcgagactctttgtctcaaaaaaaaaaaaaaaaaagaggcagaaggacgaggcacagttggaagaactagggtggggtggctgtgcaggcattggagttctccagagggtgtctcttgggcctggaatgtgtctgggggatgggcttactgcggaaggagtactgcaggaaggagtggtggcggatggtgtcgaagatggagtagagagcccagtccaagccacacagcaccaccagcagcagcagaatgggcagtgtctccaggagctccctcacctggccaaggagcaggaggggcagagctgggcagtgccatctgcctgggcacggagcactctctggtgccttttaccctccaccctcaccttcaggcctgtctttgcacccaggagtccgctccccatgctgtcctcaccacattgctcatttctgaggcctggatggtgggcttgcaagggaagatgacggttttctcctcagctttgcggagtggcagcagagtccgtttgccctggaaaacaaatgtccacacagttaggaagcccaagggccctctgccctttcctctctgccttcctggagcatgaacccacacagggcacacagcagcaaggcatccccgggcagtgccgtgcccactcaccagcttcttcctgcggtcatcgatctggcagaagtaggtactgatgtagatgttgtcaaaacgaatgtcatggttatagctgtccatgtaggagaaagacctgtgggtggatgggcagggatgtctccatctcttccaggttctcctcatctatccccaaacatgggcttccttgaggcacagtcattcaaccaaccagccagcattcattgagcaccatctatgtcctgggcactgctaggggatggtgataacagggagaagactctgtccctgccttccaattgtgtagaggaagacatccccctacatgatgggtgagacatagcagaagtgagtaggggatgaggtgggggctcagaggagggcatggtcagcctgtctgggagggagttgcatgtgtgcatctgaggtagggacaggcatgcatcttacaggatgaatatcgagcagagttacagagagggggaaactccttgaggtttcaggaatcacctaatccactgtgactcacaaattcctgcctcttggctttgcctgcagcatatctcctggaagtgtgctggggcaaaactcatcccagaccaccatctccatcctcccccaatacaccctggctctccctggctacccttgagcacggtgcacgtgtgcatgggtgcatgcctgcatatatagctatcccccatgtatttcccaaagccctacataatgcttcagtttgctaaggaaaaaatgttaattactgcaaatgtgtttaaaactgtaaaagtacattaaacaaactctgtaaagtgtgaaacattagtttcaatgctattgcttctggggccctgtaaaaatccacatctttgcctttaaaactactgtaagtgcaaagacatactgtgagtgccctcttgtggagaggctcacagaggtggtgcctgggcttcctgagccagggcctgccctcccgccagctgtcctttcagtgcatgacctcacccagcttgaaagcctggaagtagcttttgactctgtgcctccttccttccctccacaagctggctctgagcctcgctgcacctttccccttcccccaccatctcaagccatcttcctgccatgctctacccgggccaggctccctaacctccaacccagcctggcctcccgccctccctccagacttcctgaggccatcttgccaccaccgccagttccaggtcttcctgcagggctttccagactgttctggtcatgcccacttcagttctccaggccagcctctgccctctgcatcccatggataccaggagccttacgcaagggacacccttctttccttgaccaccgttccgcatctgcggccatttggagcccagttattgcccttccaaggggcaccttcccagctcccatacacgtctcaaaagccaatccatagaatggcccttgaaccatctctgtcttgtgggtgtctcatgatcccaactagatcattagctttttttttttttttttttttttgagacaagctctcactctgacaccaggctggaatgcagaatgcagtggcacaatcacagctcactgcagcttcgacctcccagtgattctcctgcctcagcctcccaagtagctgggactacaggcatgtgccccacacctggctgattttgttcattttttgtagagacgaggtctcactgtgttacccaggctggtctcaaacacctcaactcaagccatcctcccacctcggcttcccaaaatgttgggattacaggagtgagccgccatgcctggcgatcatgagcttattgggggcaggaatagagctccttcatctttgtcttcccatggggccctagatacacacatacccactcacttgcagtcactctaggccccccacataggggcagacagagcaacagccctgtggcagccctcacccaagccctgcccatctcaggtgtttgggagtggagatgggaaatagagggtccagagaccagcaggggagctagagcagagcaaggcccggggcagcccagctggacactgggctgggtggggttgaggactttgttctaaatggagggaaagtcgctgccaacgcagcaggcaggagaaaatgaaagcaaaatggaaagataaaaatggcacaaagtcagagccaaggggaatatgaagggcaagaaaaaatcaaaagtcaaagctaaacgtaaaaaaaaaaaatcagtattgggataaaggctggaaggaggtggatgaatgaagacggttggccttttaaggcagtgggaacatgggtaatgttcttctgacaaaatgtccacttttcctttaactttgtgtaaacaaagacaaaggtaaataatattcagattcagaggtgaggataggtgctagggttccatccttacagcctccctcagggcagggctccagtccggggcagaggaggggctgctggggtggggactatggctcacgcatgcaggaccagcaggaaagtgcaggagagcagcacgtgcagcagccccagggcccactccagccgggcctcctggcggtacacgtagtcccgcacctcggtgctcacgcgctcccagcttgtgttgagccccagcaccccagcctgcttctcttcctggtggagggcacatgagcaaactcagcctgcggccacctcgtcagacctgggtcccacctcttcatgacatctgttccccagtaccccacttgtgtccctggggccctcccaggacctctaggagttgtcacttccttctgctcaccaccctcctggacacagtcttgctcccctgcacctacatcagctgacatcatctcatatctggctgatagctcccaccccaggccaagtctgcacaaaccacaggcttggcactgtcccctcctcaccacctttcccctcccctgcccatctcaggtgttcgggggtggagatgggaaacagagggccccctcaacaccagcgacattccccctccttgtccccctccctcacccctggtcacctctttcctgtgccctctcacttgtccttcctctagctctattccctcatgccctcctcccactccctatctaccccccaccaaccctcgcccttgccttctaccttgaagtcaatattggctgaaaattccccatccaggccacgaatagactggttgagggagtcgtaggtctgcccaaagttgccttccactgggatgcgattgcggcaccaaacctccatcactggtgaacagtggacggggtcaggggcctccccgggcctgtcctccaggtgcaggcctggcctgcctgtcctcctgtagtcctcctcatcctgcttttttgtctctctgcccatggcttgctaccacaccaatgctgagtcttcccctctctgctctctttggatcctgccctccaggaaccagacctgagttccctcatttttgtcaatctatcctcaaccataacaaacatcagtaaggagagccagcgtttacagagcagctcctctgtgtgccagctctgccactgccttcacatacgttagccccataaatccttaaaagcccttaatgtggctgggtgcgatggctcacacctgtaatcccagcactttgggaggctgaggtgggtggatcacctgaggttaagagttcaagaccagcttggtcaacgtggtgaaaccccgtctctactaaatatacaaaaattagctgggcatggtggcggccacctgtaatcccagctactcaggaggctgaggcaggagaatcgcttgaacccgggaggcagaggttgcggtgagccgagattgcgccactgcactccagtctgggtgacaagagtgaagcaccccgtctcaaaaaaaaaaattaatgcaagaactactgttattctgcccatgcgcatctttcagatgaaaagccacagctcagagctttgctgtaactcaccctgcgtcacagagctattcagcaggtggagggctctaaggatgctgtggcctcagggccaaaaccctcctcatctgttgctttcctgcctgtcacctaccagtgggtcccaaggactcagctccctaccccgatgctccccacccctttgcaactgtgcagacccttggcaatgccacagaagaacttgaacttcataggcaggcagagcaggtgggtgaggagtgggacccagatgtgcttcatgcactgttcatgcttgcggtcaaaccaacgacggcagctgagtatggcctggttcaccacatctgtaggaaggagcaagggtgtctgaggttcccacatcttgatccacaatgctggccccacatcccaccccaccctccactccccagggatacccctcacaggagcaacgcagcttggtcttcagctcatacatcttctgtgtcgacaggtggagtctggaggctggggcttggcgggcctccctgccctgggctgtctcccctgagtccatggtatcctcaggcgtgtagcccgtctcactattcacctgggcatccaggtcctcaaaagtggcggagatgttccgagtctctgctctcagcaattctttgctactctgggattggaggtggagggaggaaagggtgagggctggggctttagaacttctgctgcctgagggcctgtcctcccccagtagccaagctttgggttctcaccccaggccgacagggagcctaggccctgagacacagcctctcacctcaaattcccggctgtccattgcccttgggagcccccccaccagctgccttgtctgatgccacatgtcctggctctgcgtacctcccagactctcagctcttcctcagtcctcccatcccagacccttcctggtcagtggttccccaggtccttagaccttacccttcaccactagtctctgagatcattatgccatctgaatgcccccaacttccaaacccctcagcccccatgtccccaactctccagctctccaattctcccaaacccccagtctccagccttccaatacccaattcttgaatactcttgtcttcgaaacttctgagctactcaaggccaaagcccccaaatttcctagatattctagttcagctgtccagagtactgaccactcaggtattaggaaatgtgtatagagcatgtcctaatgactcaggggctctcctggcatttaacaccaggaccagggcacgttctgcaatgtttgggaatagttctgcaaaaaatgccagtagtatccccattgggaaactgtaaatccagggtgacaactcccagctcaagttaacttggccccagggagagggaccccccaggctctgcctgtgcagattcctgaccagcaggtccttgaacatggcccgtaagggggctgtggagatgcgccaagctgcgcgggtgttgttgatctgcagctccacggtgcagcccagcgatgcgatcacgttgttgagattgtgtcgcagattggctactggccctggagaaagaggccctggttggtcacctccctgtataaccagcactttctcaaacccgctcagcttccctctgcaaatagtgcccatcgcctagaactatacagtggtggggccgagagcctatgaaaggtcaacttgttcaacctttgatttttttcactgtttttttttttttttttttgagacggagtctccctctgttgcccaggctggagtgcagtggctcgatctctgctcattgcaacctccgcctcccgggctcaagcgattctcctgcctcagcctcctgagcagctgggattacaggcacacgccaccatgtctggctaattttttggtatttttagtagagacggggtttcagcatgttggtcaggctggtgtcgaactcctgacttcgtgatccgcccgcttcggcctcccacagttctgggattacaggtgagccaccgtgcctggccttttttttttttttttttttttttttttttttgagacggagtcttgctctgtcacccaggctggagtgcaatggcgcaatctcggctcactgcaggctccgcctcccaggttcaagtgattctcctgtctcagcctcccgaatagctgggactataggtgtgcaccaccatgcctggctaatttttgcatttttagtagagatggggtttcaccatggctggtcttgaactcctgacctcaggtgatccacccacctcagcctcccaaagtgcagggattacaggcatgaaccaccgtgcctggccaatgttttcactcttataaactgaggaggcccagatatggggaggagctccctcagggacatacagtgagttagagcagctgggatgacactcctgtcttttctccttcacccggcctggctcccattggatgacccacccagggtcactgcttcagtgtaactcactggcccccacatactcacccacatagatggcagccaaggcgtatcccaggacaaagagcctgccttccttgcccagcatcttgggtactagtaggaggctggcacagcggatgtgaggggaggtcccccagcccatggcccccaagcctgtcaggagagcccaggaggtggtgagctgaagtgaggaagctgcctcccttcctcacgtttaccagagcacccacctgcaacacccccttctggaaccaccaccatcctgcccttatccccatttacactgactctgatagacctgctgggccactcattcattcattcagcagccactcacagagtttagctatgtgccagtctctggaagggcatagagggatggctagaacttaaaaaaccacaaatgattgacttgtgtgtgtttgtgttagggaaggaagccaaggttttccgggctacagtgacactgaccctaggtgctgagggagcagagagagcaagagaaaatatctggaaacaggtgctcatgctcagaatggtcagaagagagatcagagcccacctcagtactcccagtactcagacacctacagcactcgcagtccctgcctctaattttagcccttggtcatgtaccgcctggtatgttttagcagtttcacatgtgtctccctgtggtctctgcaaggagacagtgaacttctggaagctcataatccagagaaagagacagatgagtaaacaagtgactacaacacgatgtgctaagtgcacaagggaggtgcttatagagcgctgtgggagccaaggagggagtacgtatttcttcagggaggggtggggctgagaaggctggacaaagacaggacgtgtcagctgggcctggaaggtgagtaagtgttgttaggaggtgcagatggcattccaggccaaaggaacagtataagctggtcgggggagctagaagattcctgtgttgatggaatgttcacccaatgatcgtcaaagcaaatcccaaatccttacacttcctccatctccactgtcgtggtagagtccccatcatctcttactgggactataacctgatgagtctccctatgtcctctcttgctaccttacacttcagtttttacaaggcagccagagtgatcttgcaaaagcataaatcggatcatgtcccttccctgcttcaaaccattcggtggctttctaccacatttggtataaaatccgaactccctaacatggtctacctagcttgtgatctggctcctgcctgcctcctgatctcatgctatgcagcccttcacccaccatgtctacccacacagacctcgttgctgctccttggacaagccaagctcattcctcctctctggtctttgccctagctgttccccctgccaggagcactcctctccctgttcttcacatggctggctccacctagtcattcaggtttgtggcaaaccctgtcgggtgccaccccacagttttttttgtgccttcttccttgctaacacaacttgggttttttgcaagggcaatagcctggccctgccccagcccctgagggataaatctggatctgtctaaaccagtcatggtagaacaggacactgaaagggactagttctgtggtcttggccttctggccaaagactcgagctgaggctaatagttgacaaatagttgccctatgttctaatgagagccccatggagctatgggtgtcttctttgggctcaccaaaacagcaaaacttgactctcactcctctatcccaccccatctatataaaaagaacagcaatatgggccaggcatggtggctcacgcctataatcccagcactttgggaggccaaggcgggtggatcacttgaggtcaggagtttgagaccagcctggccaacatggctgtctcaactaaaaatataaaatttagccaggcatggtggcaggtgcctgtagtcccagctactcaggagtttgaggcaggagaattgcttgaacccgggaggcggagattgcagtgagctgagatcgtgccactgcattccagcctgggggacagagcaagactctgtcttaaaaaaaaaaaaaaaaaaaaaaagaccaacaatgtggatttcctggaaggggagaaaagtggttggaatgggcaggcagagagggagagtctgtggagaggatgggtgtcacatgtcaagtgagagactccaggagtccaagaggcttcagggactggcgctgcaggaaggggaacctgcctggtctctgtagactagactcctgctgagtgcagagcctcatgaggccactccagggctcccaccagagcacagagtggagggagagctcctgggagagctcagcctctgtaatgcctctgtagacctcccctggacgatgttggcacacaagcatggagactggcatctgcttctcatcagggcaggagagaggcaaccataaggtgctctgcttttgatggggcgttggtggctcacgcctgtaatcccagctcttagggaggcagaggcgggaggatagcttgagcccaggggtttgagacctgcctgggcaatatagcgagaccccattctccacaaaaaggaaggtgcactgctttctctgcctggcagggcacggacgtgtgcactcccagcctgctggagggagggatccaaaaagcaagaggctgtgggtggcccctgaaggggggcttcactcgaggtcagccaaaaagaactgccctctgcaagaaaccgggcattgccgaggtccacacacagcctccaaggggacaataatcaggcctactgggacagccagggtgtgagtgcctgctacacgcaggcatccacagtggaattataatagcattagtgacttaagacttttgtcccttttcctctaattcttctaatctcccttctgacatcagaagaaccagaaagggaaggaagtagaggaaaaaagggaaagagcaggccacgccccttctccattgcaggaccccatgctagggagcaggcctgagctgggggcgcaagggatggggagggcaagataaggagggaagatgcttgagaatggatgaggttaaaagtctgatgtagagtggactggacctctttaacccctaaaaataagtcttaattgttgaagtaggactaggtcttctaaagaaatacaaccagaaatctaaggggctgtgtgaaaggttatcaatgggaaaaaacatgtttgaatacagtgggtcagagaaaaagtagtctcctgttggtatccagcaggattaattcaataaacaggtgatgaaatgctaattctatttcccttgcctgggacaggttcaggaaagggcatgtgttgcacgcagttctgaccaaagagatgtgaggaagtctactgtggggattataggcaagtttcccttgttcctaaaaagagacatgaggaaaggatgtttcttccttttttttttttttttttttttttgagacagagtttcactctgtcacctaggtcattttcctttttccctggcctcaaatcgcacagcccaagacagtgaagttgggcctgggattgaacttctattcttttcttttttttgagatggcctttcgctcttgtcacccaggctggagtgcagtggcacgatctccactcactgcaatctctgcctcctgggttcaagcaagcctcctgcctcagcctcccaagaagctgggactacaggtgtgcaccaccacatccggctaatttttgtatttttagtggagacagggtttcaccatgttggccaggctggtctcaaactcctgacctcaggtgatccacccgcctcagcctcccaaagtgctgggattacaggcgtgagccattgtgcctggcctgtttcttcctctttttttatttttttctgatctttgatattattgtatgaagatgtgatgccagagttgctgcagctatcttgtgacctgaagagaagtggtcaatagactgaagatggcagagaaaagacagaaggaacctgagtccttctcgaagctactgagctgttaaattatccaaactgggctgggcacggtggcttacacctgtaatcccagaactttgggaggccgaggcaggtagatcttttgaggtcagaagttcgagacctgcctggccaacatacagaaaccccgtctctactaaaaatacaaaaattagctgggcatggtgatgggtgcctgtaatcccagctacttgggaggctgagcaggagaatggcttgaacctgggaggtggaggttgcagtgagctgagattgagccactgcactccagcctgggcaacagagcgagactccgtctcaaaacgaaaacaaaaacatacaaacaaaaccaaagcaaaacggctggatgcttgtcatccttgtttactgctaaatcctcagcagattctcagtaagtgctgagtgaatgaatgaatgaatgaatgaatttaatttcttaggaggatcagaaaacgaggtcagacaggtcaggagagatgagagttatgaagggttatggggttggactatatcatgtgggtgatggggagtccctcggaatggagagactccctcagggcaaggacggtgtcttccttcttaaattggcagcctcttccctctggacctccccgtaaagcccaggaggaggcggaagccacaggggatgtatgggtacagaagaaacaagtcccgactccttcctgggcatgcaggacggcgctgtgttccacaggccgcttgagtgttcctggcttttgcccagcactaacccaccaagctgtacaagaacataatcttctgttcttcgtagatgttcatggggttcaccaggagctgaaagagacctaagggcacaaggtcaagccaaaggccaaaagatgggtcctagccctggtccagcctctgcccaccccgaactttctgcttccacactcacctatggccaggagccccccagcgcctgcccccagcaggagagcagtgacaggaaactcgcccggctggcgccacaggaaccagctacaggagactggcagcccccaggtcaggagcctctgcaccgctaagagggggacagggtagctcaacagcccactcttctgcctgggatggggctcattaggattcagggcttgcaggtggatagaggctggggaaacctggcatgtgaaacagtaggaacttaggggaccctggaggaggatgagggagcctgaggaagtggtatgggtgtaagggacagcaaaggcaagggctgggctgggaggcgggaggcactagaccagagaggtggtggaggcgcggacaccgagttgggggatagtgtgcaggagttccaggaggagagatgggatgagagtggaggtcaagggatactgggtctctgctgagtgactcactggtatgaggctgttttcttctttgccctcttgtgccattctgatgatgtttaatgtccatgagtctgttttggggaagcaccactcatcccaggtctcctgaaggacctccttggacacaaggttctggtgagagaagagaggtgctgcctgtctcttccgcttcatgggaagcctaggcctgagctctgggccttttaatccttctgctccgagaagtggggaaggagattagagacctacctatcccctctccagtcctcggaactgggtcaaggattccaagacatatgcagtgaaagccctttggaaccttagaatacggtgagaaattccaggagcacagaagtcagcgggcatctcctggagacaggcagacatttggtctcagcagccatgcccaaagtcatgaaggatgttgtgcaccccttggggggagaggagcctagcatggcgagagctgtggttcgcagcgtgggaggttttaccctgggcttgtctttagccacggcctacgggcttctggagctactggtggaaggccacagcccctggggttgcctggtgggcaccctcactttggctgccttccttagcctgggcatgggattctctcgccaggtccgagccactgtcctcctgctgctgcctcaggccttctccagtgagcttggcacccagggctagggggcaggtcctggggctggtgctggggcagaagagatgctggaggagaggcaggggttaagggaaatattctgaaggcttatgtaagggacttgctgccatgtttggggctggggtcttggttctaacaaagctgtcgcccccagggcagggccggacactactgttggtggctgcttttgggttggtgcttcaagggccttgtgccaacactctacgcaacttcacccgggccagcgaggctgtagcctgtggggcagagctggccctgaaccagaccgccgaagtgctacagagggccaagcaacctcttgtcagtaagtcccccacctctaccactgtctcccacgggcccccctcgcccccctcatcctgcatgttctacagtcctttggcctccttctctgctggtgctaatcgcggagcatctgggcctggaagggactctgggcacagctaaaccctctctccttgctctctggcctcctccactcccagattaacgatctcccaggccccagaatccaggcttcccgcctctggaaatggtggcctcctctctactccctgcttaaggggcaatggtgagaaccagcccctagaggagaagactccaaagtgcctctgtccctcacccatcaggtgccctgaacaagattaaagctattgcccggaagaccaaagaggtggctgaccgggtccgcaagttctttcggtcaatcatggatggtgtgaaacacataggtaagcacattagcatgtctatcccggggactcaaaatgcacccagtcctggccgggtgcggtggctcatgcctgtaatcccagcactttgcgaggccgaggtgggagaatcacttgagcccaggagtttgagaccagccttggcaacatggcgagaccctgtctctataaaaaataaaaaaatagaaaataaataaaactagccagatgtaatgacacatgtctgtagtcccagctactggggaggctatggtggaaggatctcttgaacccaggggtttgaggctgcagtgagctatgatcgtgccactgtactccaatccagcctgggtgacagtgtgagactccatctctaaagaaaaaaaaaagcgggggggccaggtgcggtggctcacacctgtaatcccagcactttgggaggctgaggcggtggatcaggaggtcaggagatcaagaccatcctggctgacatcgtgaaaccccgtctctactaaaaatacaaaaagttagccgggcgtggtggcacgcagctgtagtcccagctactcaggaggctgaggcaggagaatctcttgaacccaggaggcggaggttgcaatgagccgagatcactccactgcactctagcctgggcaacaagagcgaaactccatctcaaaacaaaacaaaacaaaacaaacaaacagaaacaaaaaaattcagtctcctcacctgtaccctgtccagggttttttgggccccttctgggcgctggctagtgttcactggacacagcacagccaggtccctgaccacaggcctctccagccctggatactgtggtattgttccccaaaaccctgagaagaggctgtaggattccagccctgggtgccaaccctgcagctgtccccagccagggctctccggaatgtgtggcagtggctcctgcacatcggcgatgtgtgcaactcggaactgggcaacccttacctgaagtgtgcacgggttttcgatgatgccaaggacagctgcatgatggtcataccacaagcctaccacctgtgttacgtgctcatgcccttcaaactggcgctctgtggacttgccagccgtgagaaaaccagggtctgccagcggggaggagccgatgtggggtggggtggggtgggaatgtgggggtcagttgggagggcaggctcaggaggacgattagagggcaacagagaggaaccaataagcttggtaggaccagtattgggggtgggggtgggcagtagggagggactggtgttgggagagaagggcgacagggaggtgctacaaggttttgagcaaatgtggaggccaataggaaaatcgaaaagaggccctgtgagaagaggtctccagaggtcgggggcaggcctggctgtgcccctccttccgacactcagccgactccgcccctcagtggtccaggtgttctgcgtcatccctaagtacattcaacccttcttgcgccagaccatcggcacccgtgagtgaccccctcctgccacatatggtgctccctagtggtctccctccctcatcccggtgtggccatggccagcccccagtgctcccagcccataaaggagaatgtaagagaaagaaaggggctcaagtgatcacccaggcccatatccatgctgtacagatcaggaaacgggtccagcgaagggccagtgcctcaccacagcctgccctgagagcaggagctgggaacagaaccagggcctcctgtccacattcaggtccacactcaggtcatcaagatcattccttaggggcatctgttgcatgccctgtgtcatgctgggtgctgagcatgtgatggcgatggcacagatacgtggaggctttgtcccctcctcagtccaccttgacccaagcactggggggttcccagctggtctgtaagctgcgccccctgggctgtgccaggcccctccccaggggcagctccaccctctcctaactctccttgcccacgtctcccctgaacctgctggccccagccgtgattcagttgctcaaccgggtgcgtcaggagtttgagttcaacatgacagccacccaccacttctctgtggatctcaatgcctctcggagcctgtcccaggtagccatggacctccacgaggctgtcagcatgaagctgcaccgtgtccgagaggccctggctctgatgggcttcaccacgcctctgctgcttgtgcttctctacctccagtgaggggctgccgggcagcgtgggggatgcagggccgggggtgcagggccagggctgcagggagcagctcatttctccctgccccagcatccagggaggttgaagttgtggggttgaagcgcggatgccctgtggggtctggcctggggtcctaaggggcctcacatgtgctccacctccccttcccagagccctattttaccggtattgttacctgaactgggaccattatgacaatatctacatcactagccgattcctgcgcatggaggctgtgcgctccacggcagggctgcccacagtgctaccgctcagtgctcacgaggccaggcgctacatcccaccgggtgagggccctgaggacagggagagcccaagccagggaggccagggcttccccccaccccgctgccctgcccctaagcccctgcacaggcagggctcaggatgggcttggggcaggggccagagggaggagacacaacccagagcttaaggaactttcaggctgagggaagacactgcccggtccttggggagcccgcagtctgaaagggggaacatagacacccttggagaaagtagccagagacaagaggggcagatggtgcttctgggagcaccctggacatcaggacagcaggggatggacacagagcgagggaagtcaagttgggagggcttccccggggtgggcaggaagtgctaatatggagggggaggactgcctgtgaggtggggaggcaggtaaggggatgagggatgccctaggagggagggctccttagactggaatgggccacagggccaggtggagatgctaggcaggcccctcccttctagccacggagccccctcccctgaagagtattttccatccttgccagagtcctcacagcttcttttcttttccgtattcctgatgagcagacgggcccacacctgattaggggcaggaggcctctccaagaactgggatctggtggacgggagaactggggagcatcctcctgaccatcccactcctgctcaggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcagtgagtgcctacgtgacagcctcctcccactcacccactgcagccccctcggcctgtttctgatctccccgcctgctcccaagccttctcctcttcccatcctcagtcctggtgactgcctgaatgtccccatgtcactgttactcagcagcccacaagtgtgccactctttcaactctatgctttgcctagtaacacctatgtctaggtcaagattataacttacagagtagttaaaaatgcaagctctagagtcacactggccagggttcaaatcccagctctgtcctttattaggcggtgaccttcagcaagttgcttaacctcttcagcttcagtttcctctttttttttttttttttttgagacagagtctcgttctgtcaccaggctggagtgcagtggcgccatctcggctcactgcctccgcctcccaggtttaagtgattctcctgcctcagcctcctgagtagctgggactacaggcacatgccaccatgcccagcttatttttgtatttttagtagagatggggtttcactgtgttggccaggatggtgttgatctcttgacctcatgatctgctggccttggcctcccaaagtgctgggattacaggtgtgagccaccatgcttggcctttttttttgagatggagtctcactctgtcacccaggctggagtgcagtggtgcaatcttggctcactacaatctctgcctcccgggttcaagcaattctcctgtctcagcctcccaagtagctgggactacaggcacatgccaccatgtccagttgtatttttagttgagacggggtttaaccatattgctcaggctgctctcgaactcctgacctccggtgatccacccacctcagccttccaaagtgttggtattacaggcgtgagccactgtcctggcccagtttcctcatctgaatagtggaataataatggtagcaacctctctgggtcactgtaaggaataaattagattatgtgtgttggggccaggcgggtggctcatgcctgtaatcctagcactttaggaggatgaggcgggtagatcacctgaagtcaggagtttgagaccaggctggccaacataatgaaaccccatctcaactaaaaatacaaaaaattagccaggcgtcgtggcaggtgcctgtaatcccagctacttgggaggctgaggcaggaaaatcacttgaacctgggaggcagaggttgcagtgagccgagatcctgccactgcactccagcctgggcaacaagagtgaaactctgtctaaaataataataataaaataaaataaaataaaataaattatgtgtgtcgagtgcctggtaagccattaattgagaatgtgagccaggtgcggtggctcacgcctgtaatcctagcactttgggaggctgaggcagacagatcacctaaggtcaggagttcaagaccagcatggccaacatggtgaaaccttgtctctactaaaaatacaaaaaaatgagccaggcatagtggtgggcacctataatcccagctacttgggaggctgaggctcaagaatcacttgaacccaggaggcagaggctgcagtgagccgagatcacaccactgcactccagcctgggtgacagagtgataccctgtctcaaaaaaaaaaaaaaaaaaaaaaaagaagtaaaaaactcctaaaaaacaaaaaccaaaaccccaaaacaaacaataaagcacttggttaagtgtctgctacacagtcagtgctcagccaataaatgtttctgggggtcttactcggtggctcacacctgtaatcctagcactttgggaggctaaggcaggcgaagtgtctgctacacagtcagtgctcagccaataaatgtttctgggggtcttactcggtggctcacacctgtaatcctagcactttgggaggctaaggcaggcggattgcttgagctcaggagtttgagaccagcctggccagcatggtgaaaccctatctctttacaaaaaaaaaaaaaaaaaaaaaatagccggtcgtggtggcacgtgcctatagtcccagcaacttgggaggctgaggcaggagaatcactcaaacctgggaagttgaggctgcagtgagccaagatcacaccactgcactccagcctgggtgacaaagtgaaaccctgtctcaaaaaataaattaaaaaaaaaaataaatgcttctgggtggtcatggaggccggggggtggactcactgaccattaaggtcatcttagatatggtggcttggataggaagaccagacaccagtaccacccagttggaccatggggccagtcctaggagccagaactgaggtcaggccccagggcaccatgagggtgcctgaggcatcagaggcccccagccaagggtctgagtcatcctatgacctgcgctgctccactttcctcattccagaaggtgtggggttttctgcatagcaactgccatgagtgtcactcacacagtgtctttgtgccaggtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggtatcaactacaccctgaggtccctgggggcgtggacaccatgtgggaaatgaggggtgcagactgctgaggatgtggggggcgccaggggtgggctggcacttgtgcctgctggtgaggctgactgtggctgctgtgctcccaggcgtcatgtatggcctatgcttcttcatcaccctgtttggcagctatgtcagccggctgcggcgagtcatctgtgcctcctactacccatcccgggagcaggtgaggggtccggggctgggagctagtccctgccccctccccagggggcttagctagtggctggcttttttggctttgggagctgacttccttcagcagccccagcccgctctcctctggttgaactccaaagcaaatgacctggactgcaagcctctggacccaagatggggctgggagaaatggtgcctctggggtggggcttcctgagacagcatttacatccaaagttttgttaaaatcacaggggtgttgagggggtgggggatgagggacgggggagagttggagagtggagcaggcagcatggctcacacctgtaatccagcactttggaagggtgaggcaggcagactgcttgaggcaaggagttatagaccctttctgcaacaaagtgagcctctgtctctattaaaaaaaaaagaaagaaagaaaaaaaaagaaaataaaacgccaggcatggtggtgtgtgcctgtagtcccagctactagggaggatcgcttgagccgaggaattcaaggctgtagtgagctatgattgcaccactgcactccagcctggtaatggagtgagaccctgtctcaaaaaaacaaaacaaaacaaaacaaaaaaacatggtggtgaggtgggggcagtgttggcatgttgaggtgtaattaaaaactcaccatcggggctgggtttggtggctcatgcctgtaatcccagcactttaggaggccgaggtgggcagatcacaaggtcaagagattgagcccatcctggccaacatggtgaaactccatctctactaaaaatacaaaaattagccgggcgtggtggcacgtgcctgtagtcccagctactcggtaggctgaggcaggagaattgcttgaacccggaaggtggaggttgcagtgagccgagattgcgcaactgcactccagcctggcgatagagcaagactccatctcaaaaaaacaaaacaaaacaaaacaaacaaaaaaccctcaccatcggtttactcatttactaatcatttactgagcatgtactgtattcccctatctctttgccagtctccaaggatgccaagatgaaccagacacagtctggagctcacagattcgaggcaggccagacaagctttcttttcttttttttttttttttttgagacagaattttgctcttgttgcccaggctagagtgcaatgacacgatctcggctcaccacaacctccgcctcccgggttcaaacgattctcctgcctcagcctcccgagtagctgggatttcaggcatgcgccaccaccccagttaattttgtatttttagtagagatggcgtttctccatgttggtcaggctggtcttgaactcccgacctcaggtgatccacccgcctcggcctcccaaagtgctgggattacaggcgtgagccacaacgcccggccagacaagcttttaacaagacgttgtaatttaaaaagcacttttatttaggaatgaataaaagtgttatggaaacccagaggagagagtggtaactccacctgggcaagtccagaagacttcccagaggaaggggcatttgagccaaacctagagggattcataggagttggatagaaggaaaaggtaggtagtgggtgcagagggcattccaggcagacaaaacagggtcaagtgggaccccatccctgatctccccgcaccaggagaggatctcctacctgtacaatgtacttctgagccgccgaaccaatctgttggctgccctgcaccgatcagtgaggcggcgggcggctgaccagggccacagaagtgccttcctagtgctggccagtcggtgaggccactgtcttttctataggggtggggcaagaggggatagaaaaagagccaggagttggaatggatttctgtgctatctaagtgtcaagagatttggttgaagagaatgcccattgcatacccttaacgctgtgaaaggtgggaattcttttttttaatttattattattatactttaagttttagggtacatgtgcacaatgtgcaggttagttacatatgtatacatgtgccatgctggtgtgctgcacccattaactcatcatttagcattaggtatgtctcctaatgctatccctctccccgtaaggtgggaattcttaggggtgaggagtgaagggaggaaggaaggcagggccatggagaggttgctgctgaaatcagagggatggaggatgtactgcaggaagtcaggaagtcctccctgccatttggaggttggtgctggagtggggagggttaagctggctgggctggcctgcttagtgtctgtgacccttttctcaggtgcccctgcctaggtccatttgtcagccacttttggctgcatcaggcctactgcctgggctgtgggcagccccaggatgagggagacatggagaacactgtgtcctgcagtacccccggctgccaaggtgagaccccctggggcgtgtgcctctccctgctcggacttaccccacttgcatatgacaatccactgtggtccttccttgatggacttctcttgtacctcatcttttgtgcccctcccttcattactatgcacgttctcatttacacagagccttcaggtagctcattttctccatgcttgcctttattctcccgggtatttatgaataggatttatatgcaagtggcattgcagcagctccctagtgtgcaccccttgacaaggatggttcatccaggtctgtgataggggaggcaggggctggcaaccaggaagcacagagggtgggtgggtgaactcgggttcacctccattccccatggcctccaccaggtctctactgcctcacttgcttccgcctcctggacaatacctgctccgtgtgtgcatctcccctctcctaccagggggacctggacctggagctgtgagtctttcagtgacatggggtggctggagtctgtaggggcagtggaagtaggcacccttctcccaggatgtctgcaggccactgagatgagagtcttctccagggactccagcgatgaggagggccctcagctatggctggctgcagctcaaaggaaggaccctgagcaggcatggttattgcagcaacagctccaagaagtgctcggcaggagcctctcaatggagtccacttccgagtccaggtgagcaggaagcaggagttggcacctgggaattgtgagtcctaagcatgttctgttccatttgcaaaggccttcctgggtgtctggacctttgccagggcttgaaacagacatgaggggaggggaagtaactgaggtttgccaagcggctgctctgtgtcagcaccgtggcccaggaggagctcaccatgcccttggggagagtgacatcgaatagataacagggtggacagcaccctgataaaggagtgaagtacactctggacagcacagaggacacaacagccaatttgggaaaaggggcatattaatgaaggcttcatagaagaggtgatacatgagctggatttttgttttgttttgttttgtttgaaacagggtctcactctgtcacccaggctggaatgcagtggtgcaatcccagttcactgcaacctcgacctcctgggctcaagtgatcctcccacctcagtctcctgggtagctgggatgtcaggaacaccatcacacctgccttattattattattttgttattattattattttgtagagacgggggtctcactatgttgcccaggctggtctcaaactcctgagctcaaaccatcctctcgccttggccttccaaagtgctgggattatgggattataggtgtgagccatggtgcctggccacgggctggattttgggggcaacttggtggtttgttaggctgagaagtagaggaaagcattccaaggggaggcctgtgtgggtttggagaatgtgaggcattcagaagggtagagcccaagggatgggtgtggctgggtagagacctcagagaatgctgggagatgaggttggaagtcaaggtgggaagagatgggcaagaaccttaacttgtcatttgaaaagcttaggttggaaagtgatatgctcatatttgtcttttaagaccataagcgggccgggcacggtggctcatgcctgtaatcctagaactttgggaggccgaggtgggtggatcacctgaggtcaggagttcgagaccagcctggccaacatggcgaaaccccatctctactaaaaatacaaaaattagccgggtttggtggtgcatgcctgtagtcccagctactcgggaggctgaggcaggagaattgcttgaacccaggaggcagagattgcagtgagccaagatcacaccactgcactccagcccagcctggatgatagagtgagactcagtctccaaaaaaaaaaaaaagaccataagcaaagaaggcagagtggaggttgggcaggagcagggaggtcagagagaagcttgtcttagtctaggagaagttcgtgatggcctcagtactgaagtgctgagcgtgactgggatttctatgcttgggcctgggcaggtgttagggcaggaagataaacaggttctggggaaagacgactggcccagtttgagatctttgaggtgtctgtagggcatccagctggagatgcccaggggggcagttagaaaagggcagggatccgggctggaggtatatttttggggggttaagttagagactgtaagagagaggatgagctagatcatcctggcagagggcatggcaggagagtgggaggggacagggaggggagaggctcaagaaagcaggagagccaaacatatgaaatcaagtagggggatgggcacagtggctcacacctgtaatttcagcaatttgggaggccgaggtgggccgatcacttgagtccaggagttcgagaccagcctgggcaacatggcaaaactccatctctactaaaaatacaaaaacttgccagggcatggtggctcacgcctgtaatcccagcactttgggaggctgaggcgggaggaccacttaaggtcaggagttcgagaccagcctggctaacatagtgaaaccccatctctactaaaaatacaaaaattagccaggagtggtggcacgcacctgttagtcccagctactcaggaggctaaggcaggagaattgattgaacctgggaggtggaggttgcagggagctaagattgtgccaccgcattttagcctgggtgacagagggaggattggtctcaataaataaataggtaataatacaaaaattagctgggcatggtggcgtgcatctttagtcccagctttcaggaggctaaggtgggagggatcacttgagccagggaggctgagactgcggtgagccaagattgcaccactgcactccagcctgggcaatagtacaagacccagtctcaaaaaattagaagattaaaaaaaaaaaaatcaagtaggatcatgtgaagacaggtgacaggcagttaagacatcactggagtagcttgtgggaatatttttcatggcatcgggaagaccaaaactggatctgtcatgatgggttgaggggtgtcaggtaaagaagactcagaaaggctgggtgtggtggctcacgcctgtaatcctagcactttgggaggctgaggcgggcagatcacttgaggtcaggagtttgaaaccagcctggccaacatggtaaaaccttgtctctactaaaaatacaaaaaattaggcatggtggcaggcgcctgtaatcccagctacttgggaggctgaggcagaagaatcacttgaacgcgggaggcggaagttgcagtgagccgagatcgtgccactgcactccagcctgggcgacagagcaagactctgtctcaaaataaataaataataaaaggactcagaaatatggtatgtggctcctgcatcactgttgccaggagtttgataatgcttttaatctaatgagtgctgtagtttgaaaaaaatgtaagcttgatggtgaagagaaagagagagttagcttcacagagcaagaaagtagcttgaaggggattcagcactaaaagggttttctagatctaagaacaggaagatttgagcatttaggcagtgtaaaagcacgttggggagggaggtttgggctccagggccaggtggaccaggtggcctgcctgagaaaggagcaggctggcagaggcagagggggagagtataggttcccctgagcagctgagcccactccagcctggtggcctcgcttctctttggggagtaggaggcaagagcacctgctgagagagcagagcaggcagctgggagtggaataaaggtttcaaggagtgggtggtagaggttgaaagacctgccgtggcaagtgtgcaaagaagccgactagggaggttaagggatttccaggtagcgtcaaaggcccagatgatgctggaagctgtaacttgtaatgattgctccagtgcgctcagttatgtgattttctctggcaaatgtggtagccatgaataggattcacaggtggagggctttttctgggcaggtcaggaggacaagatggagtgagaattgaggtgtctttggtaagagtgtctgagatgactggggaagaggaggggctaaggcccctgggggcagcccagggtctctgtcttgatgacgtgttagagcaggggcagtggccaggagggagagctggctgaacaggagggactcagagagggggccatggccagggaagaactctggaatgaatccagtgaaaggccaaggctgaggaagacgtctgagtgggaacagagatgacggtcaatagaaccaaggaggttagggattgagaggccagagaattgggtgggtcctctagcgacgaggttgcaggaccatacaaacagcaggagtccagagccggcatcttaaacagatgtggcaggtgtctggcaggcctgaggagacagccacagcactggtggtacagctatcatggcagccaggggctttgcaaaaaaacactacgggccagctgggtttgagaaggttaagctgcctcctcttgggaggactgcaaagaaaactgtccagtgggcacattccagtgtgaatggggcggtagaggtcatgatgagtcaagaggttgaaggggaagcaaagctttcttttcagaggttctagagggcccagtgaaaggataagctgggtcagcagaggggacagcttgagccttgagcaggtgtgactactgaggtcactagtgattctgcccttcctagccatgtggcctcaggcaagtcactgcccaccccccagcatcagcctaaaatcagaaaatatctacagccatgggctggtacgcctcgtgggcctgagagagcaggagttgctcagaaagaacaggagctggatctgaacagatggggcagggcagggggcagggatgcacctgtgaagacagaaggtgggtgatccggccacccccttcctctcctcactagtgacctggatgaggagaaggggcctcagcagaggaagcacgggcagcagcccttacctgaagcccatcagcctgtcagcattctcaccagccctgagccccacagaccacctgagacatcctccgccactaaaggagcccccactccagcttcagaaccctcagtccctctctcacctccctctcttcctgatccttcccacccaccccccaaataaaccaaaagtggacacaagtgtgaatcttaaattattattatttcttcctgtcgcttacacccgaggtgggggagttggggtggggggaagggaataggagggggggagtgcctctccccctaaggcactgactgggaaagccgaaagtagggagaagggaggccacattgtccccactttctggggctgggccccaggtctccccagccctgggctccccccatcacctgaaatgctaagatgaggcccaggacaacccgatctccccgccaccccaatatattacatcatcactttttaaatagataacagggactggtcccgctaccccctccctgtgacccctccccactgttaggggtacctgggcagctgtgcaaatgggcatgggggtgcatggaagggaggaagagcaccgggcccctgaacctgccccttttaaggagggggaggagccgtcaggccaggaaggggaaatagtgcaaggcagagcccaggctgcaaaaggggtccagcacccagcgaggaagggggggtgtcccccacccccagcagaattgggtagttaaaaatctgaaactagatttcaacaagaccaacagaagaggctatgtacagaatgggggtggattcaatcctaagagcagagtggggattattctcccctgcctgacaggaagcccggctggcaaggatctgggaaggggatcactttcccacaggtccgcagccccttcccctgcggccaagcgagaagttctgtgcccactgccttggcaagggggcgccgctcaccagctggggtggatgaggagcgtgaagacagctcgctccagtggccgcggggggcgctcgcccactcagagcatggccgccagatggcgccggctcgcccgctctccacaaggctcttccaaccccttaccctgtcccacacccttcgctgcgccagcccgggggcggcgtgagtcaggggcggcagcggtggcggcggctccggctcgcacctgggcggggaggagatggggaggaggagaagagggtaggacgccgcccggcccgccctgccctctggccccggggagggagcggcgggaacaagacattccctgcccagggccgtggggagggagggctagggaggggagtggaacggagcggctcccctagctgggcggggcccctctactgcccccaggggcaggcgagccaatcaggccaccccgcccccttctccacgaccccatgactcagcgccgggagcagggcggagggggactgggatggctccttccttacaggcccagtcccccagtctttcaagcttccacctggctttcccccacctacccttcctttgccggccccctttgcataattcactgccaggaaaaaggaacagaaaccaggaaggaggggtctcgaaagggaggggcagtccttcacccccttacacagccaaaacccccaaggggcataggggcggggcaaggctttggtcccaagcccccaccccctagaaacccgcatagccgaagtgggacccacaaattagaaatacattattgcttctactccccaggagcagctggggacagggaccccacttttacaatacagctgtaaatatatacacaatatatgtatcactccttgggggatcaccccaatttggggagcctctgccccaataccttcttagcttggaattggaatgagggctctgggaggaagggctgatgctgatgccagcaaggctccgtgccccagacccctgctgtgtctgtcctgcgtgctcccactgcttggcatgggtgtccccggccttgtgctgcttcagtctggccctcgtccctctttaagaggactccatggcaccttcagcctggggtgtggtgggtgccccttcctcctcatcgtcatcagggggccctggggtagagaccgggggcccagtgggggctgactgctcccagaatcgagctagagagaggcggaaggtgtccaggtggccattggagaggtcgaggccagcgggggatgcagcagcggtagagggtggtgggtagtggggtggtgcatcgtccttgcggcgccgtcgggtgcgcacctccaggcagttctggcctttgaggtggcgctgcaggtggtcctccttggcgaaagccttgtggcacaggtggcactcatagggccggtcccctgtgtgcaggtgcatgtggttcttgaggtcgtagctgtgcaggaagcgggctgggcagtgcgggcatgagtaggggcgctctcccgtgtgcttccgcatgtggatcttcagcttgtcgttcctggcacaggcaggggtgaggggcagggaggtgttcaggatgggatccctggctcctcctggtcatcccaccctggccttgtcccatccctgttcctcaccatttgttaccccactattgccccaggagataccctgctagctcacctctagcttaactaggccttgtcattatccactcctctgcttccagcactgccctcctgggcaccgaatcctccatgctccagatccaccccctgctggcttgttttcttctgctctcctcactccagtaacccacccatgccccagtccctccaggaccacctaccaccacctcgggtctcctaacttcttccccatctcctcccaccctgtcccctacccatggcccctgccgggcccttccccccttgctgctcacctggtgaatcgaacaccgcagacctcgcaggcaaagggcttctcgcctgtgtgggtcctcatgtggcgaggcagtttgcctgccccatggatgatcttgtggcagacagggcactcctgaggcatctgggagcggcgtttgcgcaccagcttgtcttggctgtccaggcctggtgccaggttgtcctggtgcagggagcttaggtaggccatcaggtcaggatcgatggcatcctcatctgagcccagctcctctggggacagcgggggcccgccaccctgcgccagcccataggctgggggatataccagctcctcttcttcttcctcaccctcatagggttcgtagctctggggaccctcaggaggggaggcagttcctgtgggagggctgtagctgtcccccggcccactgcccccactgctgcccactctgcccgccacctcctcctcctcataggtcaagggatgggcgggcactgtgggcacctcagggactaggtggtttgctctggcccccttggtttgcaggaaagctttccggggcttgcggctgcggcgggcaacaggccgaggtggcggtggcggaggtggtgggaggggcacctgtggaggactgtcttcaccattgggaactccagaggccgtggctgtggcaaaggcctccagatactggcgggctcgctcacagtcatcctcgtccgggctgggagcttctagcccactgccctgcagaatctccatgcaagcagcgatgacacacgggatctccagcaggcgggcagcctggagcacagctggcatgttggcgctgctggtggtcagtgtggctgtataggcaaattcaaggagggcgcctagtgcctctggccctacaaagtccagctcacacacaccggcccctgctcccccagtggccgtcccgctacccccggcccccatgacagctccgccaccgccctcagtgaaaagcttcttgaagtagtggctacaggcagctagcacagccctgtgggtgcggtattcaaggccctgcgtccggatggtgaggtcacataggtggcccagctggcgctgctcattgaggcagctcaggagctcactgctgtggtccgggaatggaatcccaatcaggtcatcctcggggctccccatcttctcctgcagagtcaagtagaggggagattaagagcgctcagcccacaggggtctggggaaagaggaccaactttagccaatacttattgagggatgactgcatgccagtcacccttctgagtactttacactcatttcatcttccagaaccctctgaagtatgatcatcatctgtttcacagacaaggaaactgaggttcagacaggtgaagtgattttccaagttaagtgcagaacagtgttcaaactcagggagtgggcccggtccttgttcctaaccactatactattctactctgcctctgtggcagcaggagccctgcctttctggccctttcatggaggtccatctatgtcacctgccccattccccatctctttggaaggagcagtggactgggagataggatgcctgggtcccggttcaggcttcataaagaattggctgaaggaccgggggtggtactggcagctggcctcagtcatttgaaaagtgaggtaacagtctttgtaatgaacctcctcataacctggggagaggccaatgagagagttcagactcacactggaccaagatctgctggaggccaggcacagacaggtgctttaactcaagttatcgctctccaaagcggttaggacactgtaaaacatatgcaaacaagagaaggcagcttccaagcatcatcctcttcctcctcttgcccctcccctggctaccaaaagttcatctccccttctagatcccccacttctccaggccaaacgggaaacacagctcccagcatccctccccccacatcctcccctcccccatggggccaaggagcagccaccctttgctggggtgtcactggctggcgcgggtgcttcctgccccgcacagataagcatcgcccccgccccctcccccactgccaataggccaagttccagtcccaccccccacctccccctcagctactgccacccctccctccctattccaggagagccccgtctccagaaggccttggtcctgctctctatcctttaccctccaaggcccagccacaggaggtgggtgcagagcagccaggaggtgggtgcagagcaccaaggctggcagaggtgtcggcaggggttggggcctggaagggggtgagacctgctttaaatcctggctctgctactgtcttgctgaatgaccttgggaaagtcatttctctctgtgcttccatttcctcagctgtgcaaggagggggtggaagtagtggccccaatggctcagaccttcagccctgacattttgtgggtctggagcaactggagacagtgctggggcttggaaagaactgggctctggagtcagccaggcttgagtttgaatcctgtctctgccaccagttagctccatgaccttaaacaagtgatttaatctctgagccgccttcctcatctgtaacataggataattccacctgactcctagggttgtggtgagggttaaatgagaccaaatatggcacaatgcctgatatgcagtagggattcgataaatgttctggccttggcctagcctggggtcagattccactatacagatggcctctgttaagaaaactacttggggacaggtctgcctccctccctcaaatcaccctgagggaaccaagctactactagctacatgactttggacaagtcacttcctttcctgaggaagcctgttcctcatatgtaatattaaagactggcccagatgatccctaaggcaagtcccactgacattttgtcagtgtcccctctgccactccagcagctgttcagacctggccattgatggggaaaggttttttttttttttgggtgggggggtgaatgggggagtcaagccacaaatttcctctttaggacacaagaagtgcattctctgtgtctgcctccctgcctgccctcttcattgcaaggccagggctcctgcacagaaaccttgggtgagcagcacccgcatgtccttctttgcttgtaagccacctctaggcacccttagatagctcacctgttcccaccgtaagtccgcaaaccacttctctccctaggaaccaagccatctgggagctctccctgctccctttaatcctcctgcctgtactttacaaatggtacaagtggcaaatggcccccagacttgggaacaaacaaaaaccaggtgggcagcagcagcagcaggaggagcagcagcaacagtggctgcagctacttaagcagcagtaggcaccctcctgggcccaagtggatcctgtccctcctaagggggatgggtggggctgtcctcgctgtccattggctgggagctgggcactggcaggcacgtggctcaccccatccctctccctccttccctgcccaccccacccattcccgctgctaaacccgcctcctttctcccaccccagggccggtctccgtggcaacttggtgtggtgggggcgctgattggctgacctcactgtcaggtcacaggctcaggctcgttcaccacgcaactcacacagggattgggcaagggtgggtgtttaactccttaggcccaaatccaatgcccatggccaagaggtagcaatgaaagagggggagaggcagaggacatgtgtgggaaggagagggtgttcataagcttctctagcttctgggaaactcccctaacccttacccagggctctaacacccatgccaatataggtgccacctggagctatggtggtgccaaccaggccaaggggccctcctagacccatcatctgggagggatgggtggggcaaaggcctcccccttctttctgccagggcagggcactggtgccagggtgcccaccctaccttgggcacctttcccacctctgcatcccagagggcccagtcccctgacgccccatgaaggcggcccatccccacccaatctggcatgccccctcttgctaagaccttgtgggcatgggtgtgtgtggtggttgggggtgcagctgtgccagggaaccgggcaaggtctgtttggtctgtttgcctggtagggggaagaactgggggccccaccccatcactcccctctttcccgccacccccccaggctcccctcactgtcaggcctgctagaccggccaagccggtgggcagctctcttgaaactgggccctgagtcaagcctgccctgtccttggttgggggaagacttcagggtgagaaagttgggagggggtaaaggtgggagtgcctatcacctacccttcagtgctcaagggcacctggcagggtatgtccagcaccaagaaaccaaaaggtggaggccactggcctggtcttggaaagaaaagggagatgggaactctttccgggtgctgacctcaggcagggtccagtgcagggctgggggccacgaaggccaacactgctggcttgagccagccgaagggcagggatagcaggccctgaacagggcagctgagtaaagctgacccccctttcccccaccctggggattaggggagtgaggcttagtgtggggggcagcaggcggaaccaggattagcagcagagaaaatagatatgggcctgggacacaggcacgcagagccccccctccccaggttccaaggcccctacctctaggctctgccagggagcctgagaggggcctggccaggcttctccaggagcagcagcttggggtgagggaggatgaggaccaggctgtaacatcttcctgccagggatgatggagagacctgaggctcttcccaacgctcctggtgccttggctggccacccctcccccttacttctgtctcctttctccctccacccccccaccccaactccagcctcaggttctcttcctgtttttttggagctaagtttgcacgaagccatggctttggcctgcgtctggaccaggggggtggggaaattggacagccagtccaaagtcctaagggacccaggaatccttgttctccagcttcccccaccgcttcccagggcctctggggcccaggagctgcagccatctggattgcccagttggggagggaaggtaaaggggctgagcctcttctcacatgaggactagaagggcttcaaagaagaggttctctgcccagggatgctctgacatttatggagcccttctctccccaccccagcccctccaagcttgtgcatgccttccccatcccccatatgacgcttccccctcctaacctcaccacccccagcactcacacttcctgggggccgaggcggggaagagagaccgcaagccacgaagggggaaggaggcgaggggagttggctgcttcccggtgctgtgggggttaagtctctgcccagctccaaatcccccagtcctggttctggggctcctgaaatgagggagaccttaatgcttccctacattttctttccatgacaccagcccttgcccatagccccttagtccccatcaagggaaatatgaggaagataaaagatggcggaggaaggaatgggggcaactctctcagccttagcgccgccacctttgggtattccctgccatcatccagccctcactcttgcccctctcttggcctcctggttctgtcccctcattgcctcctccgacccttgtcttccctccacaagtccaccctttgctttccttccttcagccctccctgaactccgcatcctctccaccccatcagtgtccctaggcctcctcccaggaactgtccctgcctctcctttctcttccccttggttctctcttgctcaaacttctccactttctccattggccccctgctccaaccatccattcccttcttcccaggcatatgaggggtggagagccgcagaggaattaaatcagggaccaggcctgccttccaatgcctggtcttgccaaaagatggttgagtttagggcacccacaccccacttttggatgaagcaggggaccacaatttgggagccagttggggagaatgagtggtggaggggggtttgcagcgagagcggatgtggggtgggggtggggggacaacctgtgcctctctgcccgtcagagtttccagccctggagctgctggactttccccggagggtgcccaccctggaccaggcaattgtccacttggacagactctggccatcaggattctcagcagggtctgcctggacagtgccagctccccttagggcctgaggagaccgcacaaggtgccagggtctgccctgtgcccaccccctcccccccagcctagtgtctccggctgggtaaccgagctggctggtaaccccacacccgccaagccgccagcagaaacctgagccccccagccccagaggacaccccagcccgatctccggagcccggctctctgccagcctgtccagcctcctggcctggcccagcaatcactcagtccctataggcccctcttctgcctctcctgatctgctcgggtccccttaaacactgaggcctccccacattcccgcttctcaagccctcagttccctaaactctcttgtgaagtctgggcaccctcttcctgacctgtttttcagtcctctgacccttggctaattctaggcctccaagcccccctggggcctgatctcccaagccagagcagggcctactcacctgaacgctgaggggcctggcggcaactcctcctggcccctgggggcagcaggttgggacaggtgggggagggccaggcttggggggaggtagggtggctgttccccgctccagctccctccttcaaaggggccgcccacgacctggcccagcccctcccccctacagccttaaccctctgggtgctgtcccccctccccccagcttggagggaggggttaccggagggctggcggcgtgggagagggcccagagtctctgcctgtggtgcctgaagccccagcagaacccacccactcctgtccttactcagtcctaaaagaggaaaaaggtgaggggtaggaaaggtaggagctgggacagtccaggaggacagagatgaggaggagcaatgggagaggctactggaggtgggaccaggagaaggaagaagggaggggaggggacggaggcagctgtggctagaagagggaggaggggaaccctggacagtcagtgccaggggtgacaggtgcctgggtcccagcccctcagagtatgtgggatggggaccacaaggaagccctctagaccccagcaagctcctcagtccccctgggagctggccgaattctccctaccctgtactgggctggggccctcaggggctgggcaaggcggcaccccgccctccccatagcctcaccccaaacccactcacataccacagttccttgcccgggtgccaacccctgccaaccaggccagggggcagcactcatgccagcccccaatagccagggggatcagggggaacagagctggcctgagggggatagacagattgggggagctgtgggcaccgaaagaggaaggagctgggagggggcatctgctgggaagcgcctagccccaccccttgcgcaagctgctgccaccctggccggttgggtgggacccgcctgggcctgaggggcaactcaggagagctctgagcccagacatggatgggccaccaaatttcacttaaacaactcctggggtcccttattcctggaatgaggggtgccctagtgacccccagacactaggccatcccaaatcctgctaggcttgggggtaccatagaaatgccccctaaaatatcccctcccctttcccccaacagctgctggctcaatgccgctggcctgctgcccctcaccagctcccggcccggttggcacctacccaccaggatgctggcagtcctgccctcctctccctcctacccccctgctcccagcgccccatgccaactgtgggcctgaggtgggggagggtcaccctgtgccttggtgccagccagacgggcccaggcccctaggccttacagataaggcctaagaccctgttctcaaaccacctcctcaagaggtagcacactggtcagggcctacacagagagagcctaggaggcaatggacagccctgtgagtagttaatgaaggctccacaccccagggtgggggccagtgtctctccctaccaccaggtgccaacctcccggcattccccctgcccaagcatttgcttgggcaccaaagtccctgcaattcctgagagccctagtgcctgcagcctgcaagggagtggggtggggctgctctctgccctttgatccccataaagggagggaaccagcctagagggcagggggcagggagggagttcatggggcccctctgtttcacccctgccaggggcagcagggcagggtgtgggcatcttttgggtggggccctaaggtgaggacaggtagcatgtctcagcaagggagatggatgtcaatcataggtacacagcatcccatggcaatgcgatagcaagaataaagtggggggatgcagagggtacccacattccaacccatcccagttctgactttcaccttcatccagaaacacttccagactcagccaaattgagagctcaaggactacaactcccagtgtgcaccacaattgctttgtatgtaccttgggagttgtagtcccccttgagaagctctgggttctcctcttccccagagccttgctgatgggtgagaagggcagatgacttggtcatgaatctccaagggggctaggtttaagaagaggtaaaaggctaggatgtccatggtggaggaaagaggacccctgctcccaggcaaagggggaggaaaggaggaaggaaggaggagaggatgtctgttgaaaggggcatatgggtggggaggagttggggggacggtggaaacaggaaggaaactgaagccagagacatgaggtcgaaagtaagggcctgggggagccccactctgaggcctgtcagggactgggatggcatttccccatgtcattctgttggcctgggaggaagaagaggatcagtgatgtcaaaagatagcaaattgacatatttatgggggatcactgtttcatttgcctgccatcagccctcttttgcctggggcaccttcgacccctgaatctggcacaggtatttgctgactgggaagctctgaaggctgacctggttctggggaagatagcaggcaaaggaaggggtttggggagatcagggctaggcctgatggtgaatatggtagaggtatatgtggggttaggcccaggtgtggtcagggcaagtgctggcaaatgagaatgctatcctccatagcagaaccatggcatctggaggcctcagggaagagagggctaagatgtccatcccaaactatgggacaggatgaagagggcagccctctctggtctccctggggaatttgttaaaggtagctttgtccctgtgccagtgaatattaaagatggcaactcagggggccaggtggtagctgggtgcctttccctagtagaggtggaagtcagaagtgggcagaggacctgctttgaagccacttttcctgggctccccagggctctgggacagatgctggcaggccccagccaagactcttgccaagacctaggcctggctgggtgtgggggtctttcttgtccccaccccaccaaacacttgatggtggatgacagcagctctatccccttcctcccagtcccccgggcccgccttggcgcctggccgcttctgtgttggcaagagtgggggggagggggcagcgaggcaacttcaaactgtccgggcaaaacgtcaagtttactcacgagtttactcagcacaaggagggggaagaggccagggcgggcacaccccatgccagggtcctatccatctgcctgtccccaccttcctcccccactgttctctcccgccctaggccaaaacaggcataggccctaaggcctggtgtcagggcagtcttaactctcaggaaggtcagggagccaagcggggcagaggcaggaagccccgcagcaggcccagaggcttctgtcagagggcagtgccctgcctggagcccattcactactcatcttggggccttggtcttgggccagaagaattgggtctctcagccattaagaagggggcagtaccaggccaaaccttctccatctgagcagtcccctgggcagtgacttctgaccccaaatgcccagtcctaggctgtccctcagtctgatgccatccaggcagccataggatcaggggctggttctctcagccttggcttggaatggggggctggcaccctatctgacctacttccctttcctccccacctgctttcatttgcttctctcccccagccttcactgtccccaccccagagcgctccgccccccatgcctgctgggccccctcccccacccttccccagggtgccaagtgcaggcacacaaagggcctgatggtgcattgttagcccagcccccgctgcccgccgcaccctccctgggcaggcactaggccaaggaggagctgggggccctgggtgccagggggcaccatggggaagaagaaggggacagcacctgtcttccagacactggggtctacatcagccagaactgagtagtgatgagagtcccattagagcaagcctgtctccttgacacctgagcctagtgggcactgccttctttcttccccagagccccattctggtggtattaacccctttttgacccctgtgccagggctgggggtgtgtggtacccaagggaggggacagtgtctgggggtgccagcaggttgtgttgtgcccacagcaaccatgtaacagaggcacgctgggggagctggggtccctggggccagggacagaggcactgacagagatttctccttgtttcatcagctgctccagggggagccccctacccttctccccagttaccactaaggaggaacactaactatcatccagacatagtcacacatatgtccctctctagcgcagcacaacactccttatgcccactctctcctccccaacctgatgtccactccatgccagctctcccagcagtgccaggcgggtacaggggtgaccaaaccagttggtgtgtgtggggcagcaggaggcaaccccataatcctccaggcctcatccccacactcacacatactcccttagggaccagacagttcccatcctgctttaacccctcacagcccaatctggttcccccgtccctgataagcggtctccctcctccaggaataagttgggggaagggggaatagctgcgctgactcattcccattctcggctgcagctaggggtctccaaggcattcgggcgggggtcaattcaagaacaccctccacctggcccggaagcctggacagcctgccggtctccccctctccccagcacccacttccggtgtcccaaactaggtcagcagcgctcgtttcctgtgggtcagctagcaccggcgcctctgcccctcccctgctccggacccaggctccccgcccccctgccccccagggcgccccgaggtctcaccatgtctcagccgccctttgatacgtgggggttgtgcggggcggggggcaggggacccgccctctctctaaacaccagcagggccggggcgcctgggcaggcacgtgtccgggcacaacccgctgcccacgccgcccccccactcccgcccccacctcgctctggccgggacacgtcgctctcttacttgggatggggtgggaggagggagagaaagctggaaattgaaagcagcgccccccacccctttgaatggcagccttctgccaggcgcactctgtaggttctacaacaacacagtagcgacccccactctgggctggggcaggtgcgccggcgccggtggggggacgggtagtaggtaggagaattcttcctagtcacccgccctcgctcttgggttctgtggtcatgagctggcgtggaaaaggtagcggcgggactggagcctgaaggaagggagtgggattgaggggcagggaagagagcggtcgttctatgtcggttcagaggttgttgctgagccccactaccgctggagagagcgcggctctggaagcgcaagaaaccgaatagtccagccggtaactttcccccaagccgcggctcctcctgcgcccccccaacccccatgcaactggcctggggccaatccaccgcgccagggggcgcggggtggggggggggtgcgcgttgtcctagttagagtccgtcagcgtttccattccctcaactcagtccggtctggggtctccccctaaagtcacgaaggagactgggggaacgctcagcgtcgcctcaccccctctccatcccgaagccgtctgtctgtctgatcccaggagaagtgcagataaactttctggggaccctccgcctagggttggggggcatccgcagttccttctctgtctttcatctcagttaaaaccaattccagagacccggggtgttgggaaagcacagggaaggggagtggtgggaatgtgatctgcatgcgtgtgtatctgggggtcccacttacaggacggacgaaggacactgcagtagtctcgagcctagtgaaccccgagccaggagacaaaagtggggtacactcacctctcagccgtcgggtccgctggctggagctgctgaggctcacagtgtgggaagaagcgcgtcccccaccaggcccgggggcttggggccctgctccggtcctggtcagaaggccgcggtcagttgctcgccgctcgctgctggggggctcctcctccgccgccctctgcctcctcctgccgcccgccccccctcggccgccaagagccgtacattcacctggctcccacccgcccccccctcagggcccgcctcacctgtcctgctgtctcacctgtcctccagcttgctttccccccatccctcccctccctccccccgcccctgccaccccccaaactccccccccccaacacttagaaacaccctctgtcacttcctggtttttcacccgcccccccaggccccctccctccgcccaataaggacataaacttcaaccccttcgtccagccagtccctgcagagcgcagatgggtccctccctccttttttgcccccttctccaaactcttacttagctctcctagcctttcccaccctcctcctttccctccttctttccttctctctgtctcccttcacctgccgcggtccctctctcccccccctttctcctgcccctatctctcccagtccaccttaactcaaactccgcccccggcccccatccagccctttgctgctgctctgcccgccccctgcacgccaccgccctgtccgctcattggcctgaatacccgctcatctccagtaggtctcgccttgcgttcgtccagggagggggcggagccgaggggctggcctggaacctggagaggaggggggagggggcagtgtccgcagcggccagggaatcgagcaccccctacaggggctccctctccttcaagaggggcttctgtagggtcaggacctcaggagggaagggtatgagaggttagggataggctgggtgggggtgaattggggacttagggtcttgagggagggggtcccgtgaggggctgtaatcaggtcagggacctagaagggagggggagggggagccaccaggccttcggctccggcccctacgccccaccccctctcggagggagccggggagttgagcctgcgggcgccctgcgtccctccccacgcgtgacggtgccccgcggggagggaagggcgccccaggcaagcagcctctgtgctgtcgccagtgcccgctgcggccttggcattgtcggaggggaggggcccagtctgcgaagggggagggggcgcgccgacgcttttgctccccacctccatcccgcgggttccctaagtggagaaactgagtctccaccgaggagggatagcttgacatgaattcgctgagagacccaggtggcgaggggtgcctggatgttttgggatgtgtggtatgtgtaggttttggggaggaccgggataaatacttaggagtcccccaactgagaaaggtagcgggtgaaggatgtttctgactgagcctgcggagctgcgtaccccaaagggcccctcccactagtgtcaaatggaatcaaatccggctacctagggccaggtttggctcccctgcgacaagccaggccgaaccgggtcggactcgctttcccctcccaacccccctccgcagggggcctccctccctttccagcaggtggcttctcgggacaccagctcaacctgttggaccacaatgggcggcgccaggggggccctggccctcacccgggctgacccgggatccccgcgcacgaggggcggagtccaggtccctccctccctctttctccctctctccctctccgcgccgggccgtgactcagcctcggggccgctgccctgcgccccagccaggggcggaaagtgtgaggcgcccctgagggctcaggccaaaccaaacagccccccaccccagacattatctcactggagaattaggggggctataggaaggaggaggtagcggcaggcatggggcgctctggctcgagtaatccgctccgggttttcctatcgtccctgacccccttgggtcgcgaggctgatcactgctccgggttttcttctcagccccgccggacagatcctggtccggaggggcccggagccgtccaggccggggttttccccttcctactccagccgtctgggtcgtgcaggcctggtgaagggctgtgctaggggctaggcggcagtgccacaagtgaaatggagagggggctgctttggggaggaaggaggatagccaaggaaagggggcggggggcagggggcggggggcggggggggtgggaacgtggcccggggagggcagagccagggcttccagaggcaatagaagggcgggctccctggcaccagcctttgggtacagaaactcgaaaggtgcccagtgcctcaggctcgcctcgcccaacttcccccatgtttgagggtcgcgttctgcgtctggctgaacatgactgatctttctgcggctagattgccactcctcacctcattcccaatggtcctggaacccgcagttagttcctcagtgacgcccaccctcccttgtctctctttttctcctggtgcaaatagctcccctccttactcagaaatcggagcggggaacccctacttgaaattccctcttaccccaacccctaaccacgccaaacgactgaaacagcggcggcagagaaacgctgactggggaccccgccccctcccatgaaacccctgctgggccccaggggccggccgcccccgccccgccactaggcccagactggaactgggagctggagggcaagtgaggggcctgcaggggccgcctggggataggagagcgtcccagatccgcatgttaagacttaaatttttaggtgaccagctagaccttaaatttggggagagtagcacgagttggacaaatacccagagaaggaagtgtttaccctaagagaggaatgaaagccccgagtgggaggactgaatacctggggctggggacagcgactcggaatgacggccaggtgcgcggactggccgggccacgtgcgccgaagggtagaagcatagaagttagatgcttgcagaacctgggggaatgaggccttcaggtgttaagaaaggcgaggctttgcctgggcggggtcctgcgtgagtgggtctgggggcctgtttcggaatgtggggggctgagctgcaagcggagcgtcagcatgcgccaggcgcccacctcttctccgctgctcccccccatcctccgctgcctccgcttccctcgaaaaacccgccgcccaggaaaccgctgggggcgctcagaccgcagaccccccacgccccccgccccccagcgctcccaccgcgaccgcccaacccacctgaaggggccgtggccgccaggggtacccccctcccgccgactccccccaacacctgcgggtggcactatttataactccgcgcctattccgggcctctgggttggagccggctgccgcgcagcgctaatcgccgccgggatctctgcgccccccaaggccgggggaggcaaatttagcttcaggaagctcaggggaacagtttccaaaactccacgtcccagagaaggcaagacaacccctctgcactcagcctccttccgatcagccaccaggaggcgcaggtccccggcttctcgaacccagccagctaggaggttacggtcgcttctttgaagctggggtaggcgaaggcctgagggcgaatgatggaaaggaactgaggccgaagaatggctggaggaacgggtacgctccaaggctggcgaacactctagagtctgagagtaactgagaaagttgggtggagggaaataactcacatgcaagacagatgtaaatatgatgcaaataagagcctatgcccatgccgggcgcggtggctctcgcctgtaatctcaacactttgggaggcagaggcgggtggaacacctgaggtcaggagttcgagaccagcctaaccaacatggtgaaaccctgtctctagtaaaaatacaaaaattagccagtcgtggtggcacacgcctgtagtcccagctactcaggaggctgaagcagaattgcctgaacctgggaggcggaggttgcggtgagccgagatcgcgccattgcactccagcctgggcaacaagagccaaaccccgtctttaaaaaaaaaaaaaaaaaaaaaagcctatgcccttggggatgggtctgcgctctggcgctgccagtgaaatgattgccacacacccctttttgccggcctcttggtgttgggaaaacgtgggacatccccacccacccacccctccccgccgccagattattgctatgatatccagtttattgcctgccgctcctcagacccttgggccgtgacccctctcctccaactgttccttgcatgccaacgagggtcctgtatccgatgtaatccgccgggaatcctggatatcaggcttctcctctcgctgttgtacttgagggtcacatccagctggtccctcctgtctccattcctactccacccattcccccaccccctgtgaccattagagggcaccagggcaccgaggggtaggtgaggttttaatggcaaaggccgcaattacttttgcaccaacctaatatcttggtaccctgtctccttcacctccctcccaccttactccacttgagttcctgagggagtaatttggacactcaaaacctgagttgccctagtcggggagagatacttgtgggggaacagccacagagtggggagccatgggccaggaaagatctcttggctgtgtggattaggtgaaagggctgcacctgaaacctccaaatgggctgagaacagggagcttagggctgaggtgggaagtggcatggagcgggtgcatggaggtggtaccctccatgcttttgtttgcatggccctgcctccaggccactttggccaccatctccatgcaaacaccagctcagaagaggaaggcaggctcattaggagaagccgtgagttggggatctgaaaatctgggttcgctaaatgactcctttacctcagtgtgctgtgtatgttcttgggcgaatcatttcacctctttgggcctatttccttcatgttaacatgggataattgctgaagtggactttcgtaaggctcaaagcactctgtattgtgaaaagggctctctgaatggtatctgaggtttcttttattctcctcatccctctcctcagtctttacactgccaaagccctctttcccactctgacattctccttgggccactggcagtctctacctgtcactccccctgctgctctctattacccttctcaccacaggccacagccctggattctgccttcctctacccaccacttccccagtggtttctgccagacttcccctcccctggcaaaggcccttgggctcagacctcagactccaggatccacctctaggcactgccccgcttggtgggagtgaggcctaagaaaggaaaagaaggcggtaggccagggcctgagtcagggaaggaaaggctggagctggccaagtagggtgcaggctctgagggggaagaaggagccccagattcatgggaaggtaaattctgactacccccatcactgggaccaggtgagagcctctcaacggaccagccaagagcactaagctgcattttgtggatgcctaaagagatgcactgaggccgggcacggtggcttatgcttgtaatcccagcgctttgggaggccgaggtgggcggatcacttgaagtcaggagttcgagatcagtgtggccaacatggtgaaaccctgtctctactaaaaatatcaaaattggctgggcgcggtggctcacgcctgtaatcctagcactttgggaggccacggtgggcggatcacgaggtcaggagatcaagaccatcctagctaacatggtgaaaccccgtctctactaaaaatacaaaaaattagccgggagtgggggcgggcacctgtatcctagctactcgggaggctgaggcaggagaatggtgtgaacccgggaggcagggcttgcagtgagctgagatcgcgccactgcactccaccctgggtgacagagcgagactctgtctcaaaaaaaaaaaatcgaaattagcaggacatggtggtacgctcctgtaatcccagctactcaggaggctgaggtaggaaaatcgcttcaacccgggggacggaggttgcagtgagctgagattgtaccatcgcactccagcctgggtgacagagtgagaatctgtctcaaaaaaaaaaaaaaaaaaaaagacacattgacctgccagggataagaaataagctcaagttggagtaccgtagaggctaggctgctgtaaaaaagaatggacaggctctccgtgtactgatgtgggatcctgaatcctgtccaaggtttatcaaaggaaaagaagcaaagtgcagaacagcgtggagagtatgttaactaggaagagtaatatatccagaatccagccacccctcactactgctattgctataaacctggtccgagaccaccaacatgtctggcctatattgtgccattacctcctaataggtcactcgtattctacctttgctcccctgaaatctattctcaacacagcagccagcttgagccttttaaattaaaaaactcatttcacactcaatattcggcaatagttcctcatttcactcagcataaaagctcaaattcttaggccctctatgacctgcccccattcccacctccagctcgatttccacttcttttttctatagtgcctatcatctaataacatatacatactttaaaaaatgtttatagtttgtcctctccaccccctaaaatgtaagcttcacaagtacaaggatctgttttgttcactgctgcatccaaagacccacagtgacatataatatacactcaataactcaatatttgttgaatgaatgaagatgcagtctatgcacagactggaatgttctccaagaaactggtaaccatggttgcctccagggggagcgctaaaggattgggggatagacgtggagacttttaactattagagttcttttttttttttttttttttttataagacgaagtcttgctgtgtcacccaggctggagtgcaatggtgcaatcttggctcactgcaacctccacctcctgggttcaagccattctcctgcctcagcctcccaggtagctgggactacaggcatgtgccaccacgtccagctaatttttttgtatttttagtagagatggggtttcaccatgctggccaggctggtctcgaactcctgacctcaagtgatccacccacctcggccttgtcccaaagtgctgggattacagatgtgagccaccgcgcccggcctttttttttttttttttttttgagacagagtttcattcttgtcccccaggctggagcgcagtggcatgatctcagctcaccgcaaactctgcctcccgggttcaagtgattctcctgtctcagcctcccaagtagctgggattacaggcactcaccacctcgcccagctaattatttttagtagagatgcagtttcaccatgttggccaggctggtctagaactcctgacctcaggtgatctgcccgcctctgcctcccaaagtgctgggattacaggtgtgagccactgtacctggcctggcctaaagttctttactctgggcatatatcacctttacaaaaagaatctagaaaaaaaaaagagttaactaagaagaaggctgaggaagagctggtcccaggcagggaggaagagggcactatctataatctccaggccagtgccccaagtgacaaagggctgggggatgataactggccccccaggaggggccagagaatgctggatgggaatcccagggaaatactgaacagtcccaaacaggctggctctgaggtttggggggctgtgggtgggcagatcagtaagcataagcaccccctgagcaagacgatacacatggctggtgtatatctaccaccgggagtaactcatggaaaataccagctgtggctaccaagaggaagtaaagagccaattctgctcaatctagctgtttatgtcctgatagggctgtgtcatgataagcctgagggacctgtgtggccacacaggtgtctttctctggtaactttgtatgtgagctgggagctcttgtagctcatggggtcctacttccttgatgagctggggactagcctcagcgcagtgctttccccaagatcctcagaggcaggaagctgcctggaccaggtcttctatttgggaaagggctgggtcctctgggtttccacacacccttggcctcacagatgaagaccctactcaagctgggtcccctccttacccacagattgagaggaacctgaactgtcttccaccctccccactcaggaaccagtgagtcagaaaacctggctttcaatcttggttctattcaggacaagctccttccctccctggtctgcacccttgctcccagaccgttctagtgctgactttttctgattcccctttagacacttataatcttgggcctcaaggcctatggattatatttataattcagtgattctcaaacaggtttcttagggggcagtccattcttggtactatgagggtatggtaagatcaaccatctgagctggtgggctcactgtgccaagcttggaggagtgccaggtcttgccacaatcttactggggtcctagccagagcagtccaagctcctgcccaccagaggtccaccagaggcaggggttgggaatgaaggaggctcagagatgaggcaggtctgctagatgacacagctcaaagcaggatccacactttactgtttactcattgtttatggcccatccttggtcaagcacagctggcttcaggagtcttgatggcaattgggctgggggctaaagaagagaatgagaagctaaggcaagctctgccacagaagctgcagctatgcctcctgtttactctaccctgcccacctgagcgatgccagccatggtgctggtggggagaggaggcagttccctgctaccattaatccagcagttccttgatacaccagcagcagaggaggatgtaggcgacttccttcagggtccgctggaagccctcccaccctgtgcccatcttaatgacaggcacccgcagcccagtgtctcgaggggcccctccgaggaagaagggtagggtttgggctaggggctgtgtccggggctgcatgtgggcaacagttccgaggaagggtgtgggagctgcctctagtgccttttatcaacactgtccccacccccttcagcctcatgactacagagacaaaggatccagggtctagcaaagggaaggttctaggcctgggaacaggctgagtcagcccctctagacagggatgggagggtggggttagtgggagggagggcctggccactccatctttcatcctccacagctaggccaaggcagcttcccctcttccagcccaggtggtgccctgcctgattgcccttttcccagtggttggcacaactcctgctttcgccctctggtgggctcctgctgaggctgacattgagaaccatcagtgagagctcctttccagcctgttctgccctgcccctgggccccttagagtgagcacagccagtcagagctggcagcatttgacccacttctgcttctcccatcctctggagcaggaagacacagctagagcaacaggcacagtgagaggcacggtttattgccaggttataccctaggacggtgtccttccctccctcctagggtgggaggtcatgtgcgggagttccgctcctcttcttcgttctccagtagataggctggacggtatgtggggtgtcctcctgggctcaggcacttcagggccgggttccgcacggtattctcccgactccccagtgatgtgtatctggagcagggagggtggagggcaagcatgtggtagggtgggcgatcctattggccctccctatcccagcaccctaaaaactcccttacccattcccttcccctaatacccttaccctcggtcatacaggatacagtatgggacaaacagctgacgcagaaaatcccagatgtctctgtaggtccagtcctgggaggtcagagtaatagaatagtcacaaatgctcacctttcccacttctacccctgctgtcctgggaaggggcccatccatggctcttctgctcccttggcctctgagggagggcttgctatctgattctctggtatagcttgctctatgtatgcaaagagaaagagaaggacttcatcttctccactctctgctttccattcttgaaccaccctctagtgcaagggtggagcttgaggacagggagaaaccgtctattttttttttgagacggagtctggctctgtcgcccaggctggagtgcagtggcgtggtcttggctcactgcaacctctgcctcccgggttcatgccattctcctgcctcagcctcccgagtagctggcactacaggcgcccaccactgtgcccagctaattttttgtatttttagtagagacgggatttcactgtgtagccaggatggtctccatctcctgacttcatgatccgcccgccacggcctcccaaagtgctgggattacaggcgtgtgccaccatgcccggccctatttttttttttttttttgagacggagtcttgctctgtcacccaggctggagtgcagtggcgcgatcttggctcactgcaacctccgcttcccagatttaagcaattctcctgcctcagcctcctgagtagctgggattacaggcatgcgccaccacagccggctaatttttgtatttttttagtagagatggggtttcaccatgttggtcaggctggtcttgaaatcctgacctcgtgatgtgcctgcctcggcctcccaaagtgctgggattacaggcgtgtgccaccgtgcccagccctattttttttagacagggcctttactgttgcccaggctggagtgcactggcatgatcatggctcactacagcctcgacttccctggctcaagcgatcttcccgcctcagcctgagtagctgggactacaggcattgatcagcccacctcggcctcccagagtgctggggttacaggtgtgagccactgtgcctggccagaacttcctgtgatgatggaaatgttctgtatctctactgtctaatatggtggtcatttgaaatgtggctagtacaactgaataactgtattttttttttgtttgtttggacggagtctcactctgttgctcaggctggagtatagtggtgccatcttggctcactgcaacctctgcctcctgggttcaagtgattctcctacctcagcctcctgagtagttgggattacaggtgcctgccaccacgctccgctaatttttgtatttttagtagagactgggtttcatcattttggttaggctggtctcgatctcctgacctcaggcgatccacctgcctcagcctcccaaagtgcagggattacaggtgtaagccactacgcccggcctgtgtatgtgtgtgtgtatatatatatatacatatatatatatatattttttttttttttttttttgagacagagtcttgttctgttgcccaggctggagtacagtggtgccatctcagctcactgcaacctccgtctcctgggttcaagcaattctcctgcctcagcctctcgagtaactaggactacaggccaccacgcctggctaattttttgtatttttagtagagacagggtttcgccatgttggccaggctggtctcgaactcctggcctcaagtgatctgcccaccatggcctcccaaagtgctgggattacaggcgtgagccactgcgcccagccagaactgaatttttaattgtacttaattttaaaaattgaggtatccacataccatcaaattcatccttttaaagtatataattcagtggtttttagtcatatgtatttcattctaattaattaaaatttaagtataaataaataattaatggctatattggacagcacaagtctaagtcactattctatccacagtaggaagtgcaatgcctgctattgaatttgggctcaataaatattggtcaaaaggatgaatgaacagatagcactgcctcccttggatgatgaggccccttcatccaggttccaggctctagcctccccactactgcaggtgagctagggtgcagtgactgctggggcacgtgagactgaaggtgataaaccctcttccccattaccagcagtgggttgatgcgcatgaatgcgggccagcctgggtcagtggggctgaaagggcagaggctacaggagtaggggtcagtccggcgggtgcccataaggacagcctccagctgggggtgccgtgcctgcagttcacccagggcctgcttcatgctgccctcagcttccaacatctgcagattataccttaggaagaaacagaagtaggggtcgggcgtgggctctgtcaagcttctcttggagcccaaacctccaggcccctagtacctcttgatagtgtcctgtagaaactgttccagctcagggaaaggggagatgctgcggatatacaggatctggagggggtttggaacatcaggtaatttcctgcagagggggaagaatccacaggcttgtgagcatggacaaggaaatggctcccctgaaacagctcactgttctcgttggcccctaggacagactctcaccccttctcccttttccttgtcctttccatccattagacccacttcctctgggaagcccactctgacctttcacctctcaaatctaagcacgcatccctggttcaggtatgtaaatctctcatctccccagcaggactgtgacctccctgtcgtcagggatagtggcctgcacatccatacacaaggccaggcacatatcatatactcaatatggtgggagaatggaactgagaggtcaccatgactatctccctcttgaactccacctgtacaccccctttctccttgctttctgggatgtggaactggagaaacagatcaggggtcttgtctcccgggggcaggctcacctctgcacagctgcatggaagaggtgcaggagggcagtgcagtctttgcccccgttgaagcccacacagagctgggtgaggctgtactgagccagggaggtctcaatggtctgtagggcacctgccacctttttccccaaagaagaccctgccaagcaggcagggaagagggcatcagatggacacatatggctatcaaaggggagtgaaggcatgctgcccttgcttaaacccttcaatatcttcccagtgttctgaggataaagtccaaactccttcatgctgcccgctaggccctgcagtctgcccctgacctgccctgccatctgccacccagccacacctcacagtagcctcagtgtcattcctctgtagcagggggtgtggggtgtgggcttccttccattccctaaccccatgctgcttccttgcaggccctcattcatactgttggctcttgcccacctactgaactgatcaaatcctccttatcactcagtttatgtcatttggccttctctgaccccagatcaaggctgatctccctgctgtgggagatcactcctttcatcaccccatgcaggatcacctgtttaatgtccatctttttttgttaaaacactggtccataagagcagggcatacattatcctattgagccatatccccaacacctagcacagtgctgatgaaaataggtactcaatcaacatttattggaagaataatgaattaacagaagctatcttctgccctctcagggatttgcaggaagcacccaacagcccctgcattactgagatctggggtgccaccaatggctttgggcataatgcccctcctccataaggtccctacctgattcagcgagtttgtatacagcctcactggcctgctccacagcgttgggcatgtaggggaccagcgatccctggggcaaacgggcagtcaggtaggccaagcattcctccaggggtccttcttcctctgagtctagagtcagcttcacctgatagtagttgctgccccagtcagggtaggaacccaggccaagcctacgtccaaagtgggcctgggcctcagccagaatgggggcgatggaggcttcatcagcagccacatatagctcctttgagtggaactgaacagctgggttttggaatagtcccttcatcccctccagcacccgccgcagcagctctggaatgcctgggaagaggtagacgtttcggacggagaccagagggaatctgaaaggttgaccagtgcaaggatctgtgccataatgcaggcgggcagaggagggcaccaatgatagcttctcccagccttcccctcctagggctttggtggctgcttccaacttggggtgtggcttcagctcatctccaaaggcctgtgccactgcctcaaaggtcacatcatcatgagtggggccgatgccccctgctgtgaggacatgggtgaagcggttggagaaagaagtgacctcagctgcaatggtggctacctcatcaggtacaactgagactcggcaaacctggacccctagggagcgcagtgtccggcacagaaagaaggtgttggtgtcctgagtgtgtccctgggggttgaaggggaagatgaggccatcagtactgtagggatgaaggggaggggttgaagatgatggctgcatccacctgatgatgcagtgctctgctctttgaaggacaccacctcaggctgctgaggggcctggactggacacaagagtgggaaaatccatttgtttggttttaaagctgggtctctgtcacccaggctggagtatagtggctcagtcacagttcactgcagcctcaacctcctggcttcaagggccaccccagccttccgagtagctgggactacaggcgcgtgccaccacattcagctcattttaaattttttttgtagaaatggggtcttgccatgttgcccaggctggtgttgaattcctggtctcaagtgatcctcctgcctcagcctcccaaagtgctggaattataggtgtgagccaccacgcctggcctgctttcttctttctgtccccactgccaccaagcaggtccttagcacctttcacctggacaatggcgacagcttcctggccaggctcccagcctccagccacagtgctctgatgtctccggagtaaccgttttaatgcgtcactgtgattgcatcactcttggactcaaaagccatttgttgtttccaactgtatacagaagaaagttcaaattcctttgcagagtatttggggctgtctgtggcgtataccctatcttcttttccagccccatctccctctaattgtctacaaagggtttagtggttaagggtctgtgttctgatggccgggcatggtggctcatgcctgtaattccagccctttgggaggtggagtggggtggctcgcttgagctcagaagttcgagaccaaccggcacagtatggtaaaaccccatctctacaaaaaaatacaaaaattagcggggcgtggtggcgcatgcctgtagtcccagctacttgggaggctgaagtgggtgggctgcttgagcctgggaggcagagactgcagtgagccgagatcatgccactgtactccagcctgggtgacagggaccctgtcaccaaaggaaaaaaaaaaaagggtctgtgttttggagtaagggagcatcaggcattaggctggaatcccatctctacaacttcctaggtatgtaaccctgggcaggtttctcaacctctctgacccccagtttcatcaattgggattttttgccgaccaggtgtggtggctcacgcctgtaatcccagcatttttggaggctgaggtgggaggattgcttgagcctaggagtttgagaccagcctgggcaacatggtgaaaccctgtctctacaaaaaaatacaaaaaattagctctagcctaggcgacagtgagactttgtctcaaaaaaaaaaaaaaaaaaaaaagggtggggggctgggcaaggttgctcatgcctgtaatcccatcactttgggaggctgatgtgggagaattgcttgaggctggcctgtttaacatagcgagaaccccgtttataaaacaaatgcacacagaaaaataaaattttaaagaagaaaaaaagtgccaacttcgtgggatttttgtgtggggttgttgtgaagattagtaaaatcacatatatgtgatgtataggacactaccagactctagtaggcacttaaaatataggggtcaccagcctggccaaaatggtgaaactctgtctctactaaaaatacaaaaaattagccagtcgtggtggcgggcgcctgtagtcccagctactcgggaggctgaggcaggagaatggcgtgaacccgggaggcggagcttgcagtgagccgagaccgcgccactgcactccagcctgggtgacagagcgagactccgtctcaaaacaaacaaacaaaaaccccacaaaaattagccaggcgtggtggcgggtgcctgtaatctcagctactcgggagactgaggtgagataattgcctgaacctaggaggcagaggttgcagtgagctgagattgcgccatttgcgctccagcgtgagcagcaggagcgaaactccgtcacacacacacacacacacacacacacacacacacacagccgggcgcagtggctcatgcctcccagcactttgggaggctgaagcgggtggatcacctgaggtcaggagttcgagaccagcctgaccaacatggagaaaccccgtctctactaaaaatacaaaaattaaccgggcgtggtggcccatgcttgtaatcccagctactcgggaagctgaggcaggagagtcgcttgaacccaggaggcggaggttacggtgagccaagatcgagccattgcactccagcctgggcaacaaaagtgaaactctgtctcaaaaaaaaaaaaaaaaaaaaaaaaaattggggtcagggccaggtgaggtggctcacgcctgtaatcccaacattttgggaggctgaggtgggtggatcacttgaggtcaggagttcgagaccagcctggccaacatggcgaaaccccatccgtccctactaaaaatacaaaaattagccaggtgtggtggcacatgcctgtagtcccagccacttgggaggctgagacaggagaattgcttgaacctgggaggtggaggttgcagtgagccaaaattgatcacgccactgcactccaacctgggcaacagaacaagactctgtctaaaaaaaaaaaaagggtctattaaggctgagtgcagtggctcatgcctgtaatcccaactactcgggtggctgaggcatgagaactgcttgaacgcgagaggtggaggtgcagtcagctgagatcccaccaatgcactccagcctgggcaacagagtgagactatctaaaaaaaaaaaacaaaaaaaacaaaaaaaacacaaatttacaaagaatattaaaaaagattattattaaaacttgacatttggccaagctcagtggttcatgcctataatcccagcaaggtgtgggaggattgcttgagcccaggagtttgagaccagcctgggcaacatagtgagaccgtttctgaaaaaaaaaaaaaaaaaaaaaaaaaaaaaaaaattagccaggtgtggcggctaacacctgtagtcacagcaactccagatgctgaggcaggaggactgcttgagcctggaagatggaggcttcagtgagctgtgactgtgccactgcactccagcctaggtgacagagcaaaatcttgtctcaaaaacaaaaaaacccgtgtcatctgttatgtcctctagtaagactttcctgatcattcggaggggattcatcccttctagtaccttccttctagctcacttatccactacgctgagtaccttgagtcatttccaaaaaggctgggtaaaactcttttttttttttttttttttgagacggagtttcgctcttgttgcccaggctggagtgcaatggcacgatctcagctcactgcaacctccgcctcccacgttcaagcaattctcctgcctcagcctgccaagtagctgggattacaggcatgcaccaccacgcctggctaattttgtatttttagtagagatggggtttctccatgttgaggctggtctcgaactcctgaactcgtgatccacccgcctcggcctcccaaagtgctgggattacatgcgtgagccaccgcacccggccaaaactcttaaatatacaatacacacacctgtacctcctctactcgaggggcttcctgtcattgttgtgtagctcctctgccctctaccatactgcttggtaaattgcaatgacctttttatttttctttttttcaatcagctctctcaggttgaaaaattgtagggactttgctacaagtttttcagtagagtaattgaaagaatgagggttaattttcctccaatatgctggattcactccaggatcctactgcagcaaagaggctcccaccctgtttcacctccttccatggagggatgtgcagcaggcccttaaggacaggagaacgcagcgccctccccccttttctgtcccagacacaccttaaggatctcatctccaacaatgatgatgccagccgtcacgctgcgccccggagaaagttcagaggccctagatgtcatggtcctgccttctctgcccctctgcaaggccctccagtagccacccagacccccaaataggggtcgcaagcacggggggcctgccaggtctacagggcactgggggccatagcctgggaacagggggtcctgggtcgagggaacctggagaagccagaaaagacaatgggggagagcaggcgtgcgcgtgcttccttcgaggaagaccctagtcttctctaaccagatccttgacaagcgactcctttgttcctgcctctggaataaacgtgttcccaaatcccaacccatgtccttttaaatgtcttgcttagctctagtcttaaaaacttcttctctcttgagaacctaccactttaagtgtcttccgtttgctgagctggtctcctcaagtgtctgctctaccttgggcatccgtacccctttaaatgtctaccttatcctgggccttggcccttttcaatgcattcgctctccaccccggaccaaaatcccgtctctttctacttcaggcttctgcaccctttctagcccagaatcccttcttcccaccaagcttcagattactgagccctcttagactctcacctgcctgttctgccccttcaccggctctttcccttgttcctttcctcatgtcccggggcagcttccgtacttaaagtcccgccttgcacctagctgacattgaatggtgattttggctgtcgcttagactcttccagggtcccattggtgtattcaactgtcgctctcaggctttagccagtggatgggagcagggccggattgttataggcgacaaccacgtggtcacttctcgcccggaaatacgggggccggaccttagcccacggtcgggggcgggacctcgggagtttagggcgggaaaggagccgtagttaaaggtgctgtaaggccctcggggagtttctggtgctggattcaaataattgttatgcatgtgttgctttgttttgttttgtttaatgggtcagttagccatggtttaagctgttttcattcaccgtgactctaacactaggctaagggcttttactggagtgagaaagcatcttatttatagcagaaggaagttggagggacaccgagaaagattattaccactgtctgtcggatatgaagaccctggagtaggtgagcttttgatgtgtggaaccttaatttatctctagtatagtagacaaaacgaattacttaaatctctttgacaagaaagagtccaaaaaccctctcttcctccaccttgctccagatggtgcttagttcaaatgacctttcccagtaattggtcttgtaggtgcaaatgaggcagcgaatagggagtgccttacatgtttactctggatcctcacatcatccgagcttacccccatttcagttgcctttgttctaaaagtacatcttaaacttttttccaacaataatctggggatcttttcatatgcagattgattcagtaggtttgggtggggcctgagatctgcatttagctagttcccatgtgatggtgatcccactgctctatggactacattttgaatggtaagggcccgaattcattctttgtttttttgagacggagtctccctctgtcacccaggctggagtgcagtggcgcgatctcggctcactgcaagctccgcctcccgggttcacgccattctcctgcctcagcctcccgagtagctgggactacaggcgcccgccaccatgcccggcttttttttaaaaatttttttattttcattttttttttagtagagacggggtttcactgtgttagccagcatggtctcgatctcctgacctcgtgatccgcccgcctcggcctcccaaagtgctgtgattacaggcgtgagccaccgcgccgggccgaattcattctttgtaggactggtaaaccacaccttgccaaattttactcttcaaaacccttggtcgggcgcagcactttgggagtctgaggagggaggattgcttgagttctctcaattgaaaaaaagaaaaaaaggccgggcgcggtgactcacgcctgtaatcccagcactttgggaggccgaggcgggcggatcacctgaggtcaggagctggagaccagcctgatcaacatggagaaaccccgtctctactaaaaacacaaaaaattagccgggcgtggtggcgggagcctgtagtcccagctactcaggaggctgaggcaggagaatggcgtgaacccgggaggcgcagcttgcagtgagccgagattgtgtcactgcactccagcctgggcgacagaacgaggctccatcaaaaagaaaaaaaataccctgtaagatacacatcatgctcattttacagatgaggaacaggctcagaaaggtgaagggatgccacacaaccacaaaacacagtgaatggtggacccaggtgatcaggtgtctagaccattcttttaagtaataagccccccctcccttttttttttttgaaccagggtctctctgttgcccaggctcgagtgcagtggcgcaagcaccgttcactgcagcctcgacctcctgggctcaagtgatcctcccatctcagactccagagtaactgggaccacaggggcgccccaccatgcctggctaatttttgtatttttagtagagacggagtttggtcatgttgcgcaggctggtcttgaactcctgggctcaagtgattccctgccttggcctcccaaagtattgggattacaggtgtgagcccccgtacttggccctcatttctttcaattataaaaagtcagctctttgaaaaaaaaaaaaagggcaaaacaagaattccacttgcctagtaaaccacatgttccaatatctttattagcaatacaggtgatatttgatcccctcccaaaacagaataccaagactgttccagtattttcctagtggattctcaagcttaagtgtacatcagaatcagctggagagcttgttaaaacattgctgtgcccaatcctgagtttaggattcagtaggtctaggttgttgcccaataatttgcatttctaatgaattttcccgatgttgatgcctgctattttaggaataagtggatggaagacaggaaaaatgggggagattaatatccttacttagtactagtatttttttttcttttttttttgaggcggagtctggctctgtcgcctaggctggagtgcagtggcgcaatctcggctcactgcaagctccgcctcccgagttcacgccattctcctgccttagcctcccgagtagctgggactacaggcgcccaccgccttgcccagctaatttttttgtatttttagtagagacagggtttcaccatgttagccaggatggtctcgatctcctgacctcatgatccgccagcctcggcctcccaaagtgctgtgattacaggcgtgagccacgacgcccggccacttagtactactgttttgttagactagaggggaagttattattctgtggaatgttttttttttaaattgagacacagcttctgtcgcccaggctgagtgcagtggtgtgatcttggctcactttcacctctgcctctcgggttcaagcgatcctctcacctcagcctcctgagtagcagggattacaggcacacaccacgcccggctaatttatttttatttttttgagacagagtttcactcttgttgcccaagctgaagtgcaatagcgtgatctcagctcactgcaacctctgcctcccaggttcaagtgattctcctgcctcagcctccggagtagctgggattacaggcgtgtgccaccacgcccggctaattttgttttagtagagatggggtttcaccatgttggccaggctggtttcaaacttctgacctcaggtgatccacccacctcagcctcccaaagtgctgggattacaggcatgagccactgcacccagcctaatttttgtatttttaatagagacgggagtttcaccatgttggccaggctggtctcgaactcctgacctcaagtgatctgccctccttagcctcccaaaatgctgggattacaggtgtgagccaccacgtgtggcctggaatgttttcttaaacagctacattttgcacctgttttctcaaagcttagttctttacctacctgcataagatgcctgaaatctttacccccagtccacactccagaccaattaagaatccttaagaatgactcaggcaggcatcagtacttgtaaagctccccaggtgattccaacgcccaagccaagttaagaacagctgaaaaccttccccaaccaaggggcacagtgaataggtcatagatatgcctattattcctattaggaattgggacacacaagcagcccctgactgacagcatccttttatccatgtgtgccattcaaatattgggactatgttaaaggcagcaccccgactgtaggaagcagttcatttgtttggatgagatgaagttgtccctatataacctctacctcaggctagtagttagagtgaaatatatttcagtagatgtttgacagcaagtctgcttaaagtagattaaaaaccagttatctcaatgttaaacctcattatcagcaaagagctgagcttcattatcaaactgaagggcatataattagaaccatgatattgatgatgctcaccctgagtgagggggaaaaaacccgtacaattacagcactagattataaaaacttcctctttaatcaaggcttttaacatgaacagatttcttgaataaaatggaaagtttccagtacactgaaacataaatccgcaagtcaccacacatacaacacccggcaggaaaaaacaaaaacagcaagtttacatgatccctgtaacagccatggtctcaaactcagatgcttcctccatctgccaagtgtgttctggatacagagcacatcgtggcttctggggtcacactcagcttaggctgtgggtccacagagcactcatctggctgggctatggtggtggtggctctactcaagaagcaaagcagttaccagcacattcaaacagtgtattgaacatcttttaaatatcaaagtgagaaacaagaaggcaacataataatgttatcagaaagatgttaggaagtaaggacagctgtgtaaagcttgaggctgaaaagtagcttgccagcttcatttctttggtttcttgggtagtgggcgccggaacagcaagatgtgaggttctgaaagagtgagggaaatctaagagacaagctcacaccattctatgtacaacctatagtgtattccactaccacctccccagctatcacccactcagatctttataactaaataaagacttaagcatatggccttagaagcagacccagaagtctggactgtctgccaagtacagaattgttaatatcagttcttttgctatgtttatacagccccagggtgtcccttattagttttgcctggcagctgggtgtctggtgtcttatcaataaatatactttcctttgcttatttagaacacatccaagaatgttttcgatggagaatgaggcaggggctatgatcaggctatatgtggccttaaaaagaataccctctgattgaatgaaagattacaggaggtttttcagtgacaggttgtctctgaacttcccagatattttagtcttatttttggtcactagtttttttttaaaaaaatcccccacgactggagggggaaggaaccagtaaaccatttcctatctccctatttgggttatacaatcttattctttcattctctcagtgtagcagttctatatggttgtttttagccagtgcactgacctggttcatggatcatataatggacccatccctgactctgctgaacgccaagattcctccattcagattcagacatcagatgggttttagggaccagcttggctatgtccttgggcagcatgacatgtctgtaacagaaacggggaagtggggaatttatgttagtaccagatacagtctcttagacaaatgcctgtttacaaggccaagaaaggaaagaaaaactggtttttgatgtcagagtttatataattttattgtggggtagcagcagctagaaatacaggctatgttatataaattccgagagtatattaaaaatacaaattagtgaataattccagtgaatgagcacttaagttcaaggcacattttctccgccttcatggaccttatagtcttctagttgattatctacaacataatgggagccccacggagcacacagtgttaataattagaaggaaggaagagaagttattttgtggcgaggaaaggccttttatgaagtactgtgtggacaagttattacaaaggatgaaatgaactatcttgtcctttaaaatctaagccaggcatggtggcacaaacctacagtcccagctacttgggaggctgaggcaggagggtcatttgaacccaggagtttgaaaaagatacagtatgaagtttgaaatctgattaaaatacagaagaaataggccaggggcggtggctcatgcctgtaatcccagcactttgggaggctgaggtgggtggatcacttgaggtcaggagttggagaccagcctgaccaacaacgtgaaaccccgtctctactaaaaatacaaaaattagccgggtgtggtggcatgcacctgtaatcccagctatttgggaggttgaggcaggagagaatcccttgaatccaggaggcggaggttgcagtgagctgagatctgggcgatagagtgagattccgtctcaaaaaaagagaaaaaaaataagaaaaaagaaagggctgcaatgcacaatggttgtgcctgtgaatagccactgcactccagtctgggcaacaaagcaagaccttgtctcttaaaaaaaaaattaaatctatcctgaatcttattttcctaactctggagggatgtaccttgagactttctgggtaaattccgtgcttttctaaccaaggataagtctcccttcatagcaaaaaaattattaccctgatgtgaatcaaactaatccacatagtcttcgtcatgctcaatgaaaatgtactaagttctccctctgtgctagtaacagtgattccccaccattctcctaaaagaaaaaattctagtccaaatataatgaaaatagctcacattctaacaccaccctggcacgaaatttggcttcaatacatacaccaaaaaacccctcttaaaccaaagtgccactgccaagagtttcatcttccaggggatgaaatggtgattccttcccagctccacaaatctcttataagcacatacagttttaagttagtttagttcagatgtagaggaaaacagctgaggaaaagaaagttaattaaaggagggtctggagccgtcttggcataaagatgattatgtatttgtcaatgcacatcgagttctctggaagacccaaagccctgaactaggctgggtgaagagacacaagaaaagcaagttttcattttatgttctccaactgaggagacaagatacaaaccaggaagtggtcttaattattacaattaatacagattagcataatgccaacatttgtggaatcctgtgtcttcccttattcccaatctagattatgcacttaaaatttatcaagcccgaatgccacatccagtgccaggattccatcatcaccatccttggcagatggctatccagtgtcttctaaacaatttcagtcaagaggtgcttcctcccacatacctttttcttagagtctcatctcaggctctgccctctaggaagctttccccaacattccctcttccgtttttcctctcagtattttaagtttcatgttcaagggtacatgtgcaggtttgttatataggtaaaatcctgactcgggggttcggtgtacaggttatttcatcacccaggtactaagcatagtacccgacagtttttttttttcctgaacctctacctcctcccaccctcctccctcaagcaggccccaatgtctgttgttcccctctttctgtccctgtgtttttatctccgacatataaatgaaaacacgcgtagtttactactggtttcgttttcaatggtggtgaaagagacatcacgctgaattggcccttaggacactcccccgcccccaaaccaagcccagggaagaagaccgaccgaaagtaagaggtcagcctccaaggcggtggcggggcggggggcgttctcgaagcgtgggatgggggagcgtcctggagttagcaaaagtaggggactgactttctagccccacctcaacccccgctcacagctaggaagccgcagccttcgggtcgccagttccctctccttagcaagtcttgtgtgctcccatcacaccctgtaatggctccttgcatagcgtgtgtcacctttctggtgtctgtcggtaccacccacagatttttaaatttgtgaacagcagagaccatgtgttatccttgcactttagcagaacacctgaaacctgttaagtattccgtaactgttccctttgatatttaaagggcatctattagacccatattaagtattttctcaatgctcctagccagttttattccattgcagtcccaagcgatccccttccttacacaagccagacaaccacgccccttgtctttttcacgagttaataagcaatattcaactctctcagcgctactctcctgttagggacgccaggaaacttccagctccgcttttgctacgttctcccactggattcgacaagattactgtgaaacagtctctacaaggcaagttaagtttgcccgataaagttcagagaatgatccagaaagcctcatgggtgagggtggtcagtaccctaaccacgcccacccctctctcctctctactgagaggcgactccaaattcgcaaccactttgttttacgagcgcctcccacctccgcgcatgcgccttacgccttccacaatatcacaccattgcccgttcgcacctcgtacgcatgcgccaattctatcgcctcagttcctgttactaattccttgtgccctcagcggccaaagctcacgaccctcgctattgctcccgcgccagcactaaccgatactcaaactcctcgtcgtcgtatttgtccgaatagtaaatttgtttgtgcgacatgatcgctcggtttgctagccttcagccccgcgccgccaacctccaagcaactcccaacagcacgcgctcccacccactttggcctcgctttcaaacacgccgcccgcacttcctattggtccgtttggctcgaggcgggacacctctactttcaagcctccgattggcttagatttacttctcttcggatccttattggagggcagttctcacgcttctcaagaacgagcgtgggtcaaaagtaggcgtcttattggccaccactgcctttgtgcgcgatctcgcgctgccattggctaactcgggaaagtgggaagcgtgaaggagggaccctgaggtagagggtcaggggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctggtgagtcttgacttttttctccttaggtgactcactctttcaccccggaacccctctcccgggaccccacttccggtcttcatttataagtcccgcccctgagacccctctccccggaagtcccacctcccaacttcagggggctcccccgaaccccgacttgatttttattttttgtctccgaccccaccctgtcgcccagtttttctggaagtccccaccccccgacacgttccaagccctactacgagaaacccttcgttactccttccattctccgaaactccgcctcctagcaacgatcctcggctaactcctgtcaaaaggcctatctcccaaaagggcaaaaccctgctcttcaaagaacgattcgaatttgttgaagctccgcccctccgaagccacgccccctccgtaatccacgtctgactgtccagaaagcctccccgcccagaagtctgaagttcgcgtccttaggggaccacgcccccttaggagctttatctttgtgggacctgggtcatcagctgaaaagccttgtcgtcaatccctgaaactccacctgcttatattttcctgtcctttctctttttgggccttgggatcagttttccgagcactctcgtgctcccccaggtgggaagtcaaagttcccatctctggctgtaaggagtgagattaaaggcagccgttttccgttttcctttctatcttttttttttttttttttttttttaagacggagtttcgctcttatcgtccaggctggagtgcaatggtgcgatctcggctcactgcaacctccgcctcctgagttcaagtgattctcctgcctcagcctcctgagtagctgggattacaggcgcccaccaccacgcccggctaatttttgtatttttagtagagacggggtttccccatgttggctaggctagcctcgaactcctgacctcaggtgctccacccttatcagcctccttaagtgttaggattacaggcgttagccactgcgcccgtccccgttttcctctttcttaacctcctccaagggtagaactatttgaaagggctgaacgtggggtttggcacgagagggagagagagacttgccctcagactcccagcctcacttcctggctttcccttcccaggaccaacctcatcccagaagtagctctaggccttcctagacataagtggataagaccatggatttgttggtgtgtggcatgtgggtgtgacatgagcaaaagttttctactaccagaagaacggtagtttggagtgggggtagataatagtgctctttttgttgtttgatttttttttttttaagggacagttcagtcgctacttctctgtctcttcccctccccctaaccagagttcttgtctgggcattcctcctggccccgtttgcccagccttccctgctggaaacattcctgaggctttcgccatttcctgccacttcccgcccctgtcccctcctcccagttgggctgcgaagccacacacagcttttcccctacacccaatcacctggacttccagtaggcaatctcctttctccctatgtaaatttcaagagtcatacgtctttcttttcttccgaacgcccacacccgttggtccttccctggctctggatactgtaggctcccacagaacatcatctctacagatgagggacatcctagtgtgtgtttgtgtgttttgggggtgtgaggctatggtggaatcctttcctcattctctctatgcccgagagctggctggaaatgaagtgataaaattccttctcaggattggctggcagagtgacaaagctcttctggaatgagcactaaggggagatgtaagagttaagcacagcatctaacacacttcaagtgttaatgttgttaatcaggataattatctatctatattttaattctctgaagtaaatctaagggtaattccaaggtgagctggggggaatacgtatttttttttttttgagacggagttttgctcttgtcacctaggctggagtgcaatggctcgatctcggctcactgcaacctccgcctcctgggttcgagcgattctcctgcctcagcctcctgagctgggattacaggtgcccgccaccacgcccagctaatttttgtatttttagtagagacagggtttcaccatgttgaccaggctggtctcgaactcctgacttcaggtgatccacccgcctcagcctcccaaagtgctggtatcacaggtgtgagccaccgcgcccggtaggaatacgtatctttgtttttttttttttggtcactttccagctttgcctgtggcattctccggaagagcagtggcaggaagccgtgggtggcaggaatgggtttgggactgttccctgtgtccagcttcaacccatcttctcctgacacccctttctcctgtacttatttttctcctgtccttattgacgcagatgtgtcttctgatctctctgtcccttcctggcctgtagtttctacttctcttggagaactgtttcttccacctcctccagccaggctccttccctggtgtgaaggatgctgtgctctttggtggggcttagggccctgtaagaggagggatgtgaattggggtggtttggagtgggagtggggacctgattgcctcattctcacccttgacagtgtgctgtgttaacaagccctgtggaaaggggagacaggacagtgcttggctatgagccatcggtcttggtgtggtagatggcatacgtagagaacaagccgtgaccagcatgtcctcttgttcccttcttgcctggtagcttcctgatgtatcatccaggttgaactttattccccttttttcaccagctttgctcttcctcttggccctgctctgcatccattgggaccacttacttcccatccccacttcgctagctccagtccacagctgctgtagcagaggatgctaatggcccaggcttactgtatggggtagcggttgggggtggcctgggctggggccagccagctttcgggcatagagagggtgggggaattcgagtgtccaaccaggacaggaagggaaatgctgagctctgagatctcctcccttttccacccccagctgcctctgtttcctccctcattcccctgtactcctgcctggcttcctgccccctttggcctgcgtgtgtccggttttgagtgacccagacctcctatctccttcctttccgtcccactcttccatccttccctcccacccccactttacttctccccagattactagttgtttgtatagggcaggggagaggggcttggatagccctaccccctgctccagttcgaggttggggcggggtgggggctcagcccctctgagcctgtgagtcagcactgtcctcacgattggtctctccccttagctccccgcccctggggaggagccagaagcgctgggtccagcctgttctcttctcagccagagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcgggtgagtgaacatcctcctctccattcccccgcagaccccctccagttctaatgctcactccagcttggccggaatctcttttttcctgctgttccccaacaaccccgtttcagtgtcctatttcctaaacctttctcatcccttccccgattctgtagccccttcccttccagctttgcctgggcccccttccttcttttcactcccccacccccaccctggcatgcttagcacaatgcccagcatggcagaagctcttaataagtgttggaatgaatgacttcttgatctttcctccattctcctcccgctttctggagttgtcactccatcccagccaatgcctgtcggtcccctccaaactctctccccagtgtgtgaggtccttctagcctgccttttctttttctcctcattccctgttgtctttcaccttggttgtgggatgtagccacgggaagtgggcagaacttcttcctctttacttcccttagggaccatatgggtaaagtcctagggccctttgtgaaggggctggggtgggggagccgctgacctgctgtcctcttctccctccccttagtacatgggttgtgtggaggtcctccagtcaatgcgtgccctggacttcaacacccggactcaggtcaccaggttagtggggagggagtggattgtgggagtcctgggattagtgaggccatgggaaacagaggaggggagtgggtcacttgggtgctgctgctgggggctgatctttgcgtagtaaaggggattgagagaaagctgaggtagtgattccgcctcttactgaaaggaggcccctttggcccggatcctccttacctatccagccttgggagttgtggggaaggtggcagaagcagctggcaggtggagctggagtagaaaaggggggtagatggaaggttgctgctgcctttgggaagggaatgggacatttggtagctggaagggggtggggctatacccattgaggccctaacccaatcagccaggaagtggcctctcagtgtcatcaaatattaaaggcccttaattcaatccaccatgacaaagagcctggagtgccctgggagtctggcctggctttcccctcccccagccctgtggcagccccagttgagtgggaggcaggcaggcaggcgctgggtctgagtacccctctttccccagggaggccatcagtctggtgtgtgaggctgtgccgggtgctaagggggcgacaaggaggagaaaggtacttggggtccttggggatagggatgctgctgggaaatgtggaggggcagtggggaggcaagtgtggggcatgtggggagagggccaggaggcaaaagtgtggtttgcctgtgctgggaaccctcaccttctgagaccctgggccctaccttagccctgtagccgcccgctcagctctatcctggggaggagtaacctgaaatttgctggaatgccaatcactctcaccgtctccaccagcagcctcaacctcatggccgcagactgcaaacaggttggtgaaggtgggcagacggaccagaaacactgatgggggtgctaaggggagatctagttaggaggccaaaatctaggaagagggcttgagagcaggagaccagtagggaaggaggaaatgaggatatgggataaggaacccagagaatgagactggggcaccagggttctgggccctgaggctgcctgacacatggcattcccttccttcttcatcccctgccctaattctcagatcatcgccaaccaccacatgcaatctatctcatttgcatccggcggggatccggtgagttggggaacagagcaaaggcggtgggagaagagcaaggggctagggattgggaagacattgattagagaagtgggggtgctaggattgtggggatatctgaaaaggactgggttttaggggtcaggagtaaagtagaactgtaaaattttttgaccttcctccccaggacacagccgagtatgtcgcctatgttgccaaagaccctgtgaatcagagaggtgaggcatggtggggagcactgggtgggtctggctgtttgaggaggtgagtaggacctttggtcatctgtacccactctaagtagatctcagtgggggttcctgcagaggaagatgagggcccctgtctgtgcctcctcccagtgggctcagctcactgacagcctctgctgtgccctcagcctgccacattctggagtgtcccgaagggcttgcccaggatgtcatcagcaccattggccaggccttcgagttgcgcttcaaacaatacctcaggaacccacccaaactggtcacccctcatgacaggtgagcaggtggggagagtgtggagcagctcttggattaggattaggaaaggagggctgctcttcctacacttgagttgagaggttcagggagggaataacctgtgtgcctctgcttcccacttcctgctattcttctgtttcctgtggcccaggaggaaagacttttgaggccctgcttgccgcaggaccagcttttcttgtttgctcatggtggagttgtagtccggggcctccaagttacatctctctctggctaggtgggattttctactcccatccctctttcttgctcatttctctgcttggcattatgtgttttcctgcctctagaagccatcaagaatttgggtttgggaggatatctcttttccctgagattacaacctttcccacctcaggccttgagggataagcagtggagccagtagggattgaatatttaggagaggttaaaatattctggagctggagtgcctcccccggccccccacccccctacatggtgcttcccttccttgttgggagatagcacagagatcaagagcaagagcattacttatttgagacagtcttgctctgtagcccaggctggagttcagtggtacaatcacagctcactgtagcctccatatcctgggcttgagtgatcctcccaccttagcctcctgagtagctggggctacaggtgcatgccaccacacctggctgagtagtagtatttttattctggtagagataaggtctcgctatgttgtcctggctggtcttgaactcctaggctcaaacaaccctccctccttggcctctgaaagtgttgggattataggcgtgagccattgcacctggccaaggggatgagctttaaagtcaaacctgaatttaaatctgagctcggccgccttttagttgtgagaccttgggcagatcttttcacctctgaccctcattttcctcatctgtaaaagtggggaaggaaacaatacctaccttacggggttgccaggagaatgaaatgattatgtatataaaacactcagcctcaggcttaatccatagtaaatacccaatagatggctgctgttctattctgtccttccctcctcctgcccaccacacatttacagccacagcttcactgtcctgtccctcaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattggtaagttgcttggatggaggcgggctggggctagggtgggagtggttggttagggcttctggtctcaccttatttttatccctgcagcctgtaggacagcctgttgggggagatccagaagtccgcaaacagatgccacctccaccaccctgtccaggtatgaagggagccgagataggcagagctggggagtgttggaggcagggctgggatcactgtagagcctccctttcctcagcaggcagagagctttttgatgatccctcctatgtcaacgtccagaacctagacaaggcccggcaagcagtgggtggtgctgggccccccaatcctgctatcaatggcagtgcaccccgggacctgtttgacatgagtgagtgctcgtctctctcctctctgcatccccacctttctacttggttctggcccttctcctgcctatctgctctttccttcctgacttcccttccctgaagtctgggtcttgggtgtgtgttgtgcctgctacttcccctcaccctccctctatacttccagagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagtaccctacagtgtatccctcttccttccctcattgctttgtagacattcccgctgggcagctgtctatgggcctctcttgctctttaaagtgtctggcatcttcctccagaggctcatcccttagcctgaactatgttctttatagtcctggcacagggccaggcgtggtggctcacacctgtaatcccagcgctttgggaggctgaggcaggtgaatcacctgaggtcaggagttcgagaccagcctgaccaatatggtgaaaccctgtctctactaaaaatacaaaaattagccgggtgtggtggcaggcacctgtagtcccagctactcaggaggctgaggcaggagaattgcttgaatctgggatgcagaggttgcaatgagctgagatcacaccactgcactccagcctgggtgacagagtgagactctgtctgaaaaaacaaaacaaaacaaatacagtcctggcccgtcctcaaatccccaagccttaagcttatcagagctagaaggcagtcatctcatctgtgcccctcttttgacaaataaggaaaccaccctgaagaggttgtgatgcccaatgtcagatggttagaggctagacactgcaagtttccttttgtaagaagatccaagggcttctccagctccccagactcaggactcagaccactgtgctttctcttatctgcactgcctcactgttcttcaaaactttccttgtttagccaggtgtggtggttcatgcctgtaatcccaacattttgcgaagctgaggtgggaggattgcttgaggccaggagttcaagaccagcctgggcaacatagcgagaccttgtctctagtcaggaatggtgacacatgcctgtagtcctacctacccaggaggctgaggcctgaggatcgcttgagcccaggagttcgaggttacagtgagccatgattgcgccactgtactctagcctgggtgacagagaccctgtctggaaacaaaaaaacttttgtttgttttctacagtaatctcagcttcctttctttttttttgagatagggttttgctttgtcactcaggctgcggtgtggtggcacacctggctaatttttgtattttttttttggtagagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtgagcgcgctgcgaggggcgggggctgaagaggcccaggacttgggaacctcagaggggagggatggtgggcggggggtgtttcacagtctgaaggcttgaagggaggctcaggtgaaaaggatgggtgggtgtaatcctccaggggttgggggcaggtgtcacacattgaggactctagggtttggagccacatggaattcagtactcacttggagcttgaggatatcgaaagatgggatatctttcatttaaaggaagacgtagctgagagtatgatcatcttcacaatctatttttcatattgcaccccttgttagcatttgttgaataaataagcaagtatgtattgacgttaaaggagttcctcagagcatggctgagagaaaagaggttggggaaacctcagggaaacttgtctgcgtcttccttttgccgctcttccaggtctgcaaatgaagagtccagaaaagaagcgaaggaagtcaaatactcaggtgaatggtggttggtggtgggtttggttcccagcagccccttggcggcacactgtctactctgccattccagtatctgtttgtatcttgtatcagctgcagggaggagagagaaaactgtctttcttgctttgcttcttgttctttcgctgaaccttataacaagtttaggggaaagtatcctctcctaagagatgattcgaccaaagttcttaccacgcagggttccagtctcctccatgtttcctgtcctggtttcctcctgatgataacgtaacacctaccacttactgatcctttttttagtgccagggattgcgctaacatgctttaacagtttggggagataggcattatccctattttacagatgagaaatctgggggttaaaaatgttaaatacatgctccacagtcttgaggttgtttttcagggtcagagctgggattccatcctagttctgcctgtttttaaaacatagttactgcactatgttggttccactctccaccctctttttcttgtctttttttttttcttttttcttttcttttcttttctttttttttttttgtagtaacagagacttgctgtgttactactcaaactcatgggctcaagggatcctcctgcctcggcttcccaaaatgttagcattacaggtgtgacccactgtgcctggcctgtggtccatttttttttttttttttttgagacggagtcttgctctgttgcccaggctggagtgcagtggtatggtcttggctcactgcaagctccgcctcctgggttcacgccattctcctgcttcagcctcccgagtagctgggactacaggcgcccaccaccacgcccggctaatttttttgtatttttagtagagacggggtttcaccgtgttagccaggatgatctcgatctcctgacctcgtgatctgcccgccttggcctcccaaagtgctgggattacaggcgtgagccaccgcacctggcctgtggtccatattgattttagacctgagctgcccacagtatcagcctccaaaatgtgtattgtgttggtagtgctctcttggtttagctctgtgtttccctccatgaccctctttccctcaactgtttctcactagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccagacaaggactccttgctgttgctgtgtgaaaaggctggaatgagccgctgtcactgctgggtagggtgcttaggggttgaggatatgtatgctccccagggtccctgggagtgggaatggcagatttggcccctgagctgaccctggtataagctgctgagccaagggaggcctgtgtttccccgcccatccccctgtgtctccactgtgagaaactgagtttcctttttgagcatattcctgggccaggcctggagccaggcggatttggcaccacagcctctggaagacaagtgcttgagctcttctgggtttagcaccccacccacctcccagttgtttgggttagggagcaagtgtcgctctaagggtgaggggaggggctgcttctgtcctagcaaatttcattttgggatgtttttcagatcgttcccgtcccccaaccgttttttaaagtagcaatggcatcttttaagcagtctgttttggagcagattggggagaatggcaggagggctatttccacaccctggatttgcgacctgtccctctcccttcccccatctcacagctgtctctgtctatcctggggccaacctggccccttgtcttcgtcatctcagaagacggcaccgtctgcttttctctcagtttgtgggggttccctctagaaactgtttagacactgggaaagaagggcaggaaactcaggattcggttagctgggaccccggtcgcccaccaggaggtaagcccaggtttagggccgtgtcgctagacctcccttcccctcccctggctctcaattcctgctcttattggccaaaagtttccgcccccttggggaagttgacttttcattggtcagtttctggtcacatgattttcttctcgggctgcaaacaaagggaagcctgcaacaagttaagctgaagaccgaagcaagagctggttcaggtaatgccttagctgggaaggggtccacagattcgctttgaagggggtggaataaggaaaagggaaggcggaactaatctagaaggaatgagctgcttttcatttctgggctgggggaggaaggccaggtgccgacgctaacacaacaggaacttgctctgggtaccccaggcaagtggccctagatcctttgctttagcggtttggaggagcaactgttagaggagtttaaattaactagaggcgagacttcctagctttatgctgagtgggagagctccccctttagctgttttttagaaatagcagaagtctctgtcataatccttacaggaggtgtttgttgaatcctgcctgaatgaaaagaagggggtggagggagggagtggaggtgggttttcttccagaaggtcgatgaaaagaaaaagatctggaaacacagcagggaagggtggagattagacagcagaaggaacttcctaataaggcagtgagatgctggcttgggagaagaggtgtttttttgaaccctgggttaacctaaccaagaaagaggtatcagggtttggaacccagagtataggagtttcagagtgtctcctatttgggtctcataagtatttgttttgttgacccaaatacctttgctggtttccatggagacagtgggtctgacatcactgtggttgccatggtgcctggttctagaggacctgagcaggctgcacacacagctagggataaacagggacttcagcccaagctgctgccacttccttcctgccaccacctgttaacagtcagcaactggggatggggagatgataacaagggcgggggtggagccacaagcggaaggctgaacagccatggctctatggatacttacagatgcatgccagggtgtcctgttggatttggtacagggaggtcattgcagccattctcctgtctccgtgtggaatgggtgcatgtgtctgggaggatgggcattgggaaagacctatccaggacttggatcttgactggcaggagccacaggaggttacttagggcaccacgcaggacttgaaaacagctcaaacagaaggggataatgtggttggtttcaaaggtagaactgccatactctcccagcctcacttcccttttcctgagttttcttataaagtgctcgggaagcagtcatttatcctgttctgagggatcacaatccagtactcttgagaggtcagctcatctatccttccacctttatgcctggtcccaacaggagctgcctgagggaactgttttagccttggatgaaggggcggatccctctcttcttaccctgctttgtgtcagtcaggctttggaaactggagtgattccctcccctatccctgtcaagtcagagcagattaaccgggtgcaggaccatagccctgatttttgtctattttttgcaagctataaagtgatgtatatatacatgatagttgccataaatccattttcccagtcaccttcaagttccctaagaccaaactctggcgattactaagaaggtaaacagaatttaggatgaagactgagagtgatgaggagacttataaaaggtgcatccaggtggatctaagctatgccagtggctcttaaccctggctgcgcatgagaatcatttgagtggttttttaaaagacccacagccgggcctaccccccaactcaattgaatcaaaatcttaggtgattccaatgtgcagccaagattgagaaccactgaactagaccataccaaggacttatgctgggcaagtggtgggacacttagggctgaaggaggccattgagtcttcccttccaggtcctgggggagaaggtagtgattgtgtaggtacctggtgttgtgaagggagggctgtgttgtttccctgctcttcttattaacaagtcttcttattggcaagttgagtctgtcaaccttgctgggcttcatcttccctgactcaaatgtcagggggctggactggaattccccagagcctttccagcctatgctactttgacctttcaaggtcagttcagttttccaaggccctgttggtccctggaagaggctggcttctctgtgggtgttggcagattctgatttgcaaggcaaatactgcttagaagagctggggtgtcagggagagaaggactggaaccaggcttggttctggaggctgctgcccagcacttgaaccttggaacccagccaaggctgctttctgcattctgcccctcctgaagggagctcccatccttaagagagctttcttctgcaggtggcagccacagcagcctcagggacctcagcaactatggcctcctgcccagactctgataatagctgggtgcttgctggctccgaggtaggaagagcgggcctgggaaccatgggggtggggttggggggtgtttctgcagtgctgggcttctttcttggtgggtccttttccttagtcctgatggtcacctacatcacttcctgctggctgttagaggaattccagtagcaggaagaagtagatcaggccccaggggtcaggtgttggcacttggaccatgccatgaaggaagggaccagttgggtaagctgagacaagtagggatggatttcgaatggagagaccaatgtgaacaaaggtcctgaggcgatagtggggaacgccatgctgggggagactgtgggacacccatgggtgatgtggagacgtgggttggagccagtgttggagtgaggttggggacagagcctgggaacccctggaagagaccggaagagcctggctgaggccttcaggcctcatcctgatgggaaatcagtgtggggctttgggttagagggatcaggacaatcattgtctcaggcagagggtgaagccactgtgcatgctgggtgggaacagggagagagtgtttcaaagaccccctgcagcagtccaggtagcagctggtggggcagaagcccactgaggagggagaagggggttggcaggatggggaactgagtggctagagaagggatggcaaaaatttgtcaaaggcatctctgagagttccaagacgtagcgactttgtatattagagccaccaggaggggaggaggagagaagctcagtttcaacatgttgagtttgaggtgcccttgaggaacccagctgggagtaaggagttgaccttggggatgacgctggagcaagataatggactggggctcactggcagagggaaggcaggtatgagcagacgggcaccaggctctcagagccctggcctcctgttgaggtgtctttgttgacagctgggggaccttgggcatgccatttcacctctctgtcctctcctgtaaaacgggcgtcatgatttttgccttgtaggggggaccatgagaataaaaatgttttgaaaatagcaaagacataactaaggtgaagcattactctcagagggatagttggagccacggggcgggtggcaggccagggccctatggaaggggagtaggcagagggaggaggccgaggctgtgtggccagggctggatgtccaggctgagagtgccctggagacaggctgtctgtggttggggtgggttgggcttctgtgagcagctgctgggagacgggtgtcgggggagtgtcaggggccagcgggaaaggccagaaaggcttgagagatgtaagtagttgtccagttgagagggcagctgcagggacaccctgggaggcataactgtgacccgtgggcacccaggggactttgttctcttgccttcttcccacccttaatattataatatctgggttgttcatctgtggggaaggaagtgctgctgatcttgatgggagggaaacgtaggctctagctcaccttctggaggcggggcaccaggtttgtactgcaaccagtgccttggtctggtggtgcggcgctgtgtagcggaaacctggcccctgaaagttcctcctcgcagtgagtgaggctggggaatgccgagcacttggtgctgccccgagcccctttttgggccagctcatgactgaatgtgtgtgtttctgggatgtgggctggggccccattcttgggtgcagcccttctccttgcacttctcctcccagagcctgccagtggagacactgggcccggcatccaggatggacccagaatctgagagagccctgcaggcccctcacagcccctccaagacagatgggaaagaattagctgggaccatggatggagaaggtactgggccctgcttaggacatagcttaccggacaaagctattctccatattttggggtttctcagtttcctcagagaaagggaggctggttcgttttagttcctccattaatctcagttgacaaactccttttctcattccatcctggctttttcctgcctcttccaacctggtaggggcccgtgggatggacagagggctgcaaaggaaattcagctggggcagtgggtttttctgcgccttttctcctaccgcagggacgctcttccagactgaaagccctcagtctggcagcattctaacagaggagactgaggtcaaggtgaggagatttgctgtgggaaggaagggaggcggggagggctagcagctgctcactgctgcatctgcattagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcaggtgagagtcttccttgcctctcctgtcactctccttctagaaggtatgggagagggatcagccatcactactgagcacatgctgtggtccaggccctagggctgagcagcttggtgctctcctttctcaccactacccctgggacgttgaggcccagaaaggttgaatgacttgaccaaggtcacactgctggtaaggggcagggcccacatctggttgactctttcctctctgccatggggacctcctcttttcttgcttccagaattcaaccctcatttctggagtcccttccttgtgctggccctgggcctgggcagagggaagatggttggttaccgcctatgtaagcggcagatcagactgagccaaggtgcatatcagacctaagagtggtacagaactgtaattaaggtactcccaaaggaaggagaggccattcagtcaggggactggttgagggcaagggagaggctgggacagtgagaggtgacatttgagtggagccctgagcacagagtaggcttttggtacgtagggcagggaaaagagaatgttttaggccaaggctgcagcatcagcaaaggagtggggaccacctgtcttgtgctaaggagctctgttccaggcttgtggcagaggagtgtaggaattggtccctgttgagtgacaggatggagggcctgggggccatttaggaggcaactgcagtggtcaggcaaagatgatgcagacctgggccaggcatggtggctcgtgcctataatcccagcactttgggaggctgaggtaggaggattgcttgagcccaggaattcaagactgcagtgagccatggtcatcccacttcactctagcctgggcaacagagggagaccctgtctctaaaggaaataaaaataggcggcagggtgcagtggctcacgcctgtagtcccagcactttgagaggccaaggtgggtggatcacctgaggtcagaagtttgagaccagcctgggcaacatggtgaaaccccgtctctattaaaaatacaaaaattagctcggtgtggtggtgcacgcctgtagtcccagctacttcccagctacctgggaagctgaggcaggagaatcgcttgaacctgggaggcggaggttgcagtgagccaagattgtgccactgcactccagcctgggttacagaggtagactctgcctcaaaaaataaaaataaataaaataaaataaaataaaataaaataaataaaaataaaaataggctgggtgtggtggctcacacctgtaatcctcacactttgggaggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgttccaggtatgggaggtggaaacaagactgtgagagccacacattggctatccttaggtgaatctaggaagtgtgtgcttatataaagatgtagatgccgaggctcaggatggaatttggggatccctgtgtctcattcatgatggagatggggtggaggatgaaaaccaaatcctctgggtgttccaggcaggtggatcacttgagctcaggagtttgagaccagcctgggaaacatggcaaaaccccgtctttacaaaaaaatacacacacacacacacaaattagccgggtgtaatgatgcatgcctatagtctcagctactcaggaggctgaggtgggaggatcgcttgagcctgggaggtggaggttacagtgagttgtgatcgtgccactgcactccagcctggacgacagagccagaccctgtctcaaaaaataaaaataaataaaaataaataaatattaaaaaaaaaagaaagaagatgcagacctgaactaaggcaggtacagtgtgggttgtgaacaggggtggactgtcaagatgtttaagtgtagaactgtgaaactgtctggatgtgaggtggagagggagggcttaggttagctagatggtggaagcagtgccttcccctgaattggggaaacaccagaaaagaaccagtttgcagagcagtgtgttgaatgtttggtcccagagggagtggccagcaggcagtcagacatacaggcttggagctctgggaggccaagtgaggagttacacactaaggactcattgctgaaggggggtgtcagtggtgtgggtcagagaattgtgactatgtgtacagtgagaagagcagagaacctgaaatggtgccagggagaccactgactttaggatcagggaagagccagggagggagaatgggaaggagtggccagagagtttggaggcaacccaggagggtggtaatagctgcagaagtttgatgcacagcgcacactgaggaaggaggatgctttcaggatgaaaatggcttttatagctcgtagattgacagcactggtctcctgcctccagactgggcagggacagtcatcaatgcccaggcagaagtgggcaagtgggcaaggtcttcatgtgcccctctctggggtcagggctgacgacctccctccctgtgccttcctctgattcccctctctccctgtgtctccccatctctccagtcacctcactgccctgtccctgtcctttcccctagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtgagtggtacctctgaggctggggctttgggcttccatgcctgcctgccttcctgccatgttctcaccttacctcacatcacccctccccgagggcctcatcagactcctctgtctctgtccttaggtggcctctcagagtctgagactggtgagtagggaggagcctgtcttgtgctggggagttgtatgtgttctctggttctgtgggtcaggagtaggggtgctgggggctcacatttatttctcagttagtggccttgtcagctgttcagggtgccccttggccctttatctcaccaaaccgctcagccacagggtgggtcctgagcaggagtggtggctgtgtgaatgggaaggtgtggggagaatgggctctgtgtgcctcaggaccagtttcagggtttccctttcccacagggcccatggaggaagtggagcggcaggtcctcccagaccccgaggtgctggaagctgtgggggacaggcaggtatgtgtgaatgtctccagaggcaggtggggcctggctggggagaacctgggctgtggggtagcatggcataacaggctcttctgccctcaggatgggctaagggaacagctgcaggccccagtgcctcctgacagtgtccccagcctgcaaaacatgggtcttctgctggacaagctggccaaggagaaccaggacatccggctgctgcaggcccagctgcaggtgggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgttccaggaaataagactgtgagagccacacattggctatccttaggtgaatctaggaagtgtgtgcttatataaagatgtagatgccgaggctcaggatggaatttggggatccctgtgtctcattcatgatggagatggggtggaggatgaaaaccaaatcctctgggtgttccaggctgtaaaacgggctcaggccacctgcccactataatagaatggaattggggtagaaggcattggggctatcctgacaagaactctttgtgacttcctttgtcccaaaccatattctaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtgggcagctgtgggggagttgggtcgggtgggacagaggcagtcgggaggatgtgaagagcaaggatcattagtttgagtatccttacttttggtccccagctggcttcccttagagaaggcattcaggtccgcttcctttcttcccttgagggtaggaagctgcctgtgcccaccccagagtggtcctgagcagtccccttttgggcagggggattctttctcctgagttgccctgccctacctctacctgcatggcccaggggacgagggagatccccatcttcctgtctccccgactggagcctttatcctgggagaccaggtttttcccacatatgcttggtggtgcctgctcaagtcagcttcattgggaggagcagggtcctctctccttggggaacccgttttcattgcatggtattgtcccctaaaggcctcttcctccccacaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaatgcctctcctgttttgggcactcaaaagttattgccttctttagggaagggtgtggaggagggaaaagaacccaggcccagaaggaagagcttctggggctggggaggtgagggaaccactaggtggcaccctggctccattttgctccagacctcgcctctcccactactcactgtccccaaaatctcagaccctaccccactgaccccagcgcctgctccactggccagctctcccaggatgaccagactccccttggctattctctaggaagtccttcctgagatctaaccttagtcccttcggcaatacactgggctttttgatgaccctggaaatgcccaggaagtacaggagacagaataatgtggtgtgactgctcaggcaggaggcgggggactacaggttctagaaggggctgtaactgatttctgtattatttagcaagcgaatatgtaactctgtttaagggcttaaaggtattagttcattgaattcatgtgtgggtggggcaggggttagggcaggctggggatggaacaaggaccactaattcagcaaacatttataaagtctactgtgtaccagaaacagagaggcactgggaatacagaggcaccttaagaagcctaaagttgggtcgggtgtcgtggcacacacctataatcccagcactttgggaggccgaggcggacggattgcctgagctcagcagtttgacaccagcctgggcaacacggtgaaactccgtctctactaaaatacaaaaaattagccaggcgtggtggtgggcgcctgtagtcgcagctactcgggaggctgaggtaggagaatcacttgaacctgggaggcggaggttgcagtgagctgggatcgtgccactgcactccagcctgggcgacagagcaagactctggctcaaaacaaaacaacaacgacaacaacaaaaaacagagaagcctatagtccagtggaaactttctacagcaggaggaactgcagttagatctaaggaagaacttcctttcaggtagaaggtcagtgatatgggctggggaggcttaggatttggtacccaggcctgtgaaccactgctccttgaagaagcctagttttaccctgttcacattgctcaccttctgtaggtgctcaaaattcttgctgcctgaacagctgactggtaaagttgggttgctgagagacagattcaggctagaaggtaggtaggattcagtgtcctggggcaggtggctgggcctgggaaaggggatacaaactggcctacctgagttcccagagggtggtgactctcactgtggccccttggggcttctcagtttcatttttagggctcatttccttcgtttgcataacgaacgctcagggaggctgccaggttcccctaagccccctcctgttccttacccactcaggaagtagatatgctgagctggaggtttctgaagctgctgaatcaggaagaaaaagccacgaacccaaggggtatgttggggagggctgggatgccagtgacattggctgctctgatcgccctctctctgggatgcccctgggaggcgatcctcgcactcatcacaggccacgaggcccctctctctaacacacccatgcagcactggtggtgaggaggagcccagggtccaggtcttcggatgatctcctgaccatgggcccagtgtgtagagatgagtccagggaggctagagccaagggacagcattccctccttcccacaggccttggggatagctctggcctgggcagggcttcggggagcttgtgggtagactcactggatttcaccacgtgtctgtttggcctcccagggtttgggctgggctcttccagtttcagcacttggcatttttagcacttggctttctgccttttccgctgggagctccccaagtttgcccaagtagggcctgcttccctgagagctgagctcaggggtccttgggaagaatcactagagttaggggtggccttcttgggccttctactctcaaatggaaaaattctatttcctttggccagtcccaaaaactcatttcctggtagtccccagtctgcattcccccctcccgtccttatctctcattcttcagcctcacctgcttcccaggctccttcagccaccctttccccagtgccctcagcccagcctctgccacccatgccctgtctggccctgtgcctcctccaggatctcccccgtctcctgctgcctccccaggtcccctaggccccaggctttccccattgcctggcattcacacccatcctggggtgacaggtggtggagacagatggggtgggtgggtcataggtggtagtgggtcacttcgcttcccagcctgaccacccctattggcttctggaaggtcagaggcacattgctccttttgagagtggctcccagcctcgtccggctgggcccaaggacacacactggactggctggctgttgccatgggaacctcccagggttaccctgacacaggaatgtctcctcatcctgcctggttctgggccacagatgttcctggccccttcacatgctcacagcaggggtctggtagggacagtgcaggttgcagggtaggggtgtggagggctgttgcctaaatcagacaacaggttcttcccctccccaactcagctgcctgagccacagaagccccttgttaagcacttatctgagttccctgtcccacctctcccaggtctcccttaaggtggccacccatctctttggtaacctttggcacccaggataggtgactgccgctcccaaatggagaacaacagtgaaccccttccccgctcacctgttcttctggctgggcctgttcctggctcacctgttcctgggccaggggggctcccagcccagatcttttctaaccagagctttgacctgagcgagatttgaagtcggaaaccccagagtggcggtctccaccgctgcccacctgtgggccttgggcaagagggctctccttgcttaagggctcagctttctcatcattgaagtggagaccacagactctgctctcagaggctgtcccgagggtgagatgagtcaatgtaagatacatgaaaaggctttgcaagctaaagggcactgaaacagagcagttatttttattgtacttaacctctaagggggaaactgggagccactgggagctactgatatgggaggaaagggtgttggttccccgatgtggcaggagctggcgggaaaagatgctaactagcattcaggtctcaatactgtgctagatgctgtggggccccccaatccttgccccgaggctaattggattagctgcatacaaagcagaattttaatagtactctcttaatggtgccaggagcagtctgccaactgggtgaagaggaagaaaggggtggcctttgagttggatcttgaaagataataggatttcagagatgggagaatgggggaaggtatttcaggctaggcaaaggtgaggcctgaggtaagggtgttatagcctatagctagatggttcacagagggggcaaattctgccactggcagcctgcaggtctgaggggatggctactgtaggaaatgggaggggtgccactaatcctcaccattccccccaccctccacttcctctccagagcagggcccctttgcaggagttctcaccagcatggggcacttaccttcgctcagccccaggggaggcattcagcagaggggagggtcatccattgaggtcatcactgagactctgttcaaaatcaaagggacaggtcatctggctagagcaggataggcagacacctgaagccacatgctgtggagaggaaagtgctagatagctccctttggaaggtccattgcccatgggtcaaacaggctggccatcaatgcttgctcatctggaatgacaggactagtccagaaatagtggcatgaggccagcaaaggaacaggctggctgggcgctgtggctcatgcctgtaattccagcactttgggaggctgagatgggaggttggcttgaggccaggagttcgagaccagcctgggaaacatagcaagaccttatctctactaaaaattaaaaaaaaaaaaaaaagtttaactcagcatggtggcacacacctgtagtcccagctactcagcaggctgaaggtggaaggattgcttgagcccaggacatcaaggctgcagtgagcttatgatccgccactgcacttccagcctgggcacagagtgagaccctgtctcaaaaaaagaaaagaaacaagccatggctgtcatctaggtggatcattaacttttctttcttttttttttttttttttgagatggagtctcgctctgttgttcaggctggagtgcagtggcgtgatctctgatctccgctcactgcaagctccacctcctgggttcacgccattctcctgcctcagcctcccgagtgtagctgggactacaggtgcctgccaccacgcttggctgttttgtttttttttttttgtatttttagtagaaatggggtttcaccgtgttacccaggatggtctcgatctcctgacctcgtgatctgcccgcctcggccttccaaagtgctgggattacaggcatgagccactgcaccgggccacatttaacttttttcccctgggttgtggaaggcaggcagagcatgttatataatgtaaccagttccaccagctagtggacttgggagggaagtgctactttggggagtatttgagcaagtgaccttggagggttgggtggatgagcatgtgagtttgcaggttgagcagcttctggtgatgacaaagcccagggtgtgtccataggagctggcctctgaggaggagaggggggaaaaggctttgaacagccagggccaagggattgagcagcggggtgttggatgggctggccatgaccgtgatgtcaccgaggatgatgacagcaactctgtagaaaaggagactgggagccagtggctgagtctcagaaaatgagaatgaggctgggtgcagtggcttacactggtaatcccggcacttttggaggctgaggccagagaggactgcttgagcccaggaattccagactagcctggccaacatagcaagaccccgtctgcataaagaaacaaaagaaaatgaaaatgaaccaccaggattgctgggctgccagtactgaggaaagcaggagggtagcgcaggcaggtggcatgagccttagaggaaccatagttttccaagaggcaggatgagtaatggtgtggaaattaaaatggggaggaagggaggccatagactcaaagcggatgctgagggatgagggctgggagactaaagcctccacttgagacaccagtaagggacagtggagttcagttgaggcatactaggaagcctagtatgggggaagtttttttttattttttgagacggagtctttttctgttgtccaggctggagcgcagtggtacaatcttggctcactgcaacctctgcctcccaggttcaagtgttctcatgcctcagcctcctgagtagctggattgcaggtgcccgccaccacgtccagctatccagctaatttttgtatttttagtagagatggggtttcaccatgctggccaggctggtctcgaactcctgccctcaggtgatccgccttggcctcccaaagtgcggagattacaggcgtgagcctgggggaagttttctgatcgctcactaggtattcagggagctggatctcagagtcagagagggaggtaaggggcgtgcattgggtcaggtgaggaaagagactccgggagtaagttctgactccttccatgtgactcaggtaaaacaggagatgtggactttccgtggaggcccaaatacatgtttattgaagatgagctggaaaatctgattctgtgttgaatgacgaagtgctaagaataaataacaaccccttacatctggatgatacttgagaacttacaaagtattttattgtaccttgtcatatattttcttcattcctttcttattataaccctgggaagtgggccttatcagtggtaaactcagagtgacttgctaagtgtccaagctgggactgaaaatccactctgtgctgccttctagggcgttgatgagtgcagtgttttctgggttgctgaaaaaaaacaaaaaaaaccccaaaaaacaaaaaaccacctccttaagtctgttctttttgcatctgaccactctcctgtgcctcttttcaacattcaggaaattaatggtttctccctaagtctccacactacactttttctctagtggaggcagtaatgagttgcaggctctgttctgacatgctcagaaaaatgcaggacggcaagtcatagccaaaaacaactcgacgtactcagctggggcaacccgtcacctactgcgggaagaggcagaaccggggatgcagggaaaggacagattattcttatcctgcctctcaaacttctggctgggagccagacttcggatgaaaccaggcaatctcatctagggattcaacgctcccttactattgatgtcacccacgccgtttgcttccgaaaacctttgggccggaggctgcggctagaaaagcaatcaaaggtttctcgccgggcttaaagggccacatcttagtgacgtctcgggttataaaatctgcttgacaatgaaatatcgtgtgcgcgattctgctcctcccccgacatgacgtggccagacacgccgctcgcgtcagggctgccttacgcccccaggaagacccattcccactctggggcgcgcgcagatttgctgtggcacatgtactataacgcacaggcaaaagggcagtttccaaaacgtctccaacgtgatctcactccagagattttttttcctaaagttttagggctgcgcggaagggaacatggggttcacctcaggaaatttcagacgtcacccccctcggaggaaggtagtcgcgtccggttcctccccgggtgtcagttaagcaggccaggctgtgagcgaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcaggtgtccgtgaggcgggaaaggtggaagggggagctctccgcatcacgtgacacgaggagtgcttttgggtgtcacggagtgagctttggagtacgggtcgtccgtttgcaaggcaggaggagcactgggctggggaaggtggaatgccaccattacataaaacagtagtctacacaggcgagcctcaaagaagcaggtgaccacctctccaaagaccttcagctgcaggtctctctgagaagcattaataatggttcctacgaaggcactttctatataccaggcgttggataccagcctgggcaacatggcgagaccccgcctctacgaaaaatccaaaaagtagctgggcgtggtgacgcgtgcctgtggtcccagctattcaggagcctgaggtagaagaatcgcttgagcccgggaggcggaggttgcagtgaggcgagattggccactgcactccagcctgggcgacagagcgagaccctgtcttaaaaaaacaaaacaaaaaaccctcttcacctctttgttaggtactgtgtgccattattagcatctccatttcacaggtgaagaaactgaggctcttaaaaagttaaacaggccgggtgtggtggtcatgtctgtcaccccagcactttgggagacagaggtgcgaggatggcttgagagcccagtagtggagaccagcctgggcaacacagtaagaccctagtctctacaaaaaaatggaaaagttagcctagtgcgatggcgagcacctctagtccaagctactcaggaggctgaggtgggaggatcgcttgaacctgggggctacagtgaattgtaatcatgctactgtcctccagtccttgcagcagagcctgagaccctgtctcgaagtaaaataaaataaaataacatacgaagttaacaacaaaaaacccttgctggtcacaaagtaagtggcaaatccaggattcaaattcagctttgtggttcatgatgggcatctcagcaattaatatataattgaaacaaaaagaaaaaaaacccaaacaaattcaactttatcttgcgccaaggactggtttctttctgttttatctggctgcctccccaaataataataccttttgcacagtgttttctgtcaaagcaagatcttctgtgcaggagcattttgctgagacctgggctaggagagcagaggttggggagaaagtggggctcctctcctcttgaaggccagtgtggtgggggtaccaggaagctgcttttgggtaccacgggggttctatgaaggtgtgggagagcccagagcagaggtcaccacctgaatttttcatcactaagtatctcaccaccttttcctaagttgcatttctcctcacctccaaaccctgacgtcaaatagtggtccgaagcacaggctctggaattagactgctgggatgcaaaccctggctcactgttgattagtgtgtgatcttgtacacatctgtcattcactctgtgcctcatgttttttttttttttttttttttttttttgagacggagtcttgctctgtcacccaggctggagcgcacccaggttgcggctcaccgcaacctctgtctcctgggttcaagcgattttcctgtctcagcctcccgagtagctgggattacaggtgtgtgccaccatgcccagctaacttttgtatttttagtagagacaggtttcaccatgttggccaggctggtctggaactcctgacctcaggtgatctgcctgcctcggcctcccagagtgctgggattacagacgtgaaccaccaccgcacctggcctgcgtctcagttttgtcatctgtaaaatggggatgataatagggtggttgtggggattaaatgagataatgtgtgtgaagggcttagaataattattggcacctagcagaggtgcaggaactaaatgttggctatatttattttaccaatcttggcttcactacttgcagtgttgctttgggggagtcaatcctcctttcacaacctcagcttcctcatctgaaacatgaaaataagaacacttacagccagggcaacatagtgagaccccctctctacaaaagataaaaaaaattagctgggtatggtggtgcatgccagtaatcccagatactcaggaggctgaggtgcgaggattgcctgagcccaggagttcaagattgtagtgagctgtgatcataccactgcactctagcctgggtgacagcaagaccctgactcttaaaaaaccaaaccaaaacaaaacaaagaacacttatcgttgggcgcagtggctcacgcctgtaatcctagcactttgagaggccgagaagggtggatcacttgagctcaggagttcgagaccagcctgaccaacatggtaaaacccttctctactaaaaatacaaaaattagtgggacgtggtggcgccggcctgtagtcccagttacttgggaggctgaggcaggagaatagcttaaacccaggaggtgcaggttgcagtgacctgagattgcaccactgcattccagcctgggctacagagtgagactcagtctcaaaaacagcacttatcttcctgtgcgttaagtgtattgtgagcatctcaaggctaggacaggaagcatgtatcattcacatttgtatcacctagatccaaatatggtacccaataaatggttggttaagccaggaggcagaggttgtggtgagacgagatggtgccactgtactccagcctggacgacagagtgagactctgtctcaaaaaagagaaaaaaagaagggccgtgtgcggtggctcacgtctgtaatcccagcactttgcgaggctgaggcgggcggatcacgagatcaggagtttgagaccagcctggccaacatggcaaaaccccgtctgtactaaaaatacaaaaattagccgggtgtagtggcgggcgcctgtaatcccagctacttgggaggccgaggcaggagaatcgctcaaacctgggaggcggagattgcagtgagccgagatcgcgccattgcactccagcctgggtggtggagcaagactccgtctcaaaaaaaaaaaaaaaaaaaaaggttggttaagtaaattaaataacgaatgagttatttttatttttattttcatttttgagatggattttcactcttgttgcccaggctggagtgcaatggggcgatctcggctcactgcaacttccacctcctgggttcaggtgattctcctgcctcagcctcccgagtagctgggattacaggcatgcgccatcatgtccggctaattttatgcttttagtagagacagggtttcaccgtgttggtcaggctggtctcaaactcctgacctcaggtgatctgctgcctcagccttccaaagtactgggattacaggcgtgagccaccacacctggcttttgtttcagttttttaaatttgcttttcttatttcatttttatgagacagggtctcactctgtctcccaggctggcatacagtggtacaatcatggctcactgtagcctggaactcctgggctcaggaatgctcccacctcagcctctggagtagctgggagtacaggcacatgctgccatgctcagctaatttttaaattttttggtggagatggtatctctgggtcttattgtgttgcccaggctggtcttgaactcctggcctcaagcactcctcctgccttggcctcccaaagtattgggattacaggtgtgagccaccatgcccaaccagtgaattaataaatgatatatgttatggtgaccaagtcagtggagacagatacctctggctatgagagaattagtttagggtctgggcaataacctaatccagctagaatattgtgcgcctgttcacactgtaattagcactttataggttttacctgttagtttcagggctcttttatattctttagagtttcataataatcctgtgtgggagacagaacagaaagtgttatccccattttctgatgaggaaacaggatcagggacattgagacctaccaaagttacataataccagtagtagaaatgggacttcaacacaggcctcttgactccctttctgggacatggaagctcctggaaattctaggctaactggattctgatctccctgtcctgcagacttggagctgatgtctgtgctgtcctccggctctctggtccactcaaggaacagtatgctcaggtaggtggtgctttgtggcatccggtgtgttgggcggggccggctccaggactttggagctgtggctgctgcctgagtcactggcatgattcccgtcaccactgctggcagggtggtggccagctcttggttttctgtgagtggacctttcgggggcattttcagcttatatttctttcctaatagcctccctcccttcagagtgagttcaggaaggtgtgcccaggaaaggctgtcgacactcgagttggcagctctgatgctgtgtgattagtaaggacctgcctgtgcctcctcacaccaccctctcactcagctggcctgacacagcccctagaactttgctcctagaaatttagtacaggccgagcacggtggcacatgcctgtaatcccagcactttgggaggccgaggcaggtagattgcttgagtccaggagttagagaccagcctggccaacatggtgaaaccccatctccgtttctttaaaaaaaattttttttaaagtaaacaacaacacacaaaaaagaaatttagtcccagaagttgtcaaaatatatcattaagtgaaaaaaaaaaaaagccaataccaagatatagaacagtgtgtagagaatgctacatttgtctaaaactgaagaggcactttgtgaccaagaattgtaaaagaattctaaatatatctgctcatatatttggctatttaacaaatatttacagggtgcctgtctcatgttcagcactgtttcaggtgcctgggatgtgttcctgcactgcatgggaaagacaggttagaaaccgtaccattggttgcccccagggaggggacagggtgagagagagattttcgactgtaaattaatgtgtatctttgaattttgaaccacatggattaaaaaaaatagaatcgttaaaatagaataaaaaaaataagtcaacaggaactctcagaatcttagacttcagaaagggaacttggaaggcaagatcagcctcccacatggtgaagagccctcttgtcgccacattttgcccttgacctctaggtgcacccttctgggacgtgtgctttggcccctcaattggccagagtgtggtttccggaaccacataaaatgaattgtccccccttctatatgccatctttgcctccatgggaagcattgggtcatctctcaccagctgaacagacctattcatagggtggcagcctgaggaattgtaagaataactaaattaagtggtttatttttttttctttttgagacaaggtcttgctctgtagcgcaggctggagtgcagtggcgcataatggctcactgcagccttgacctcctgggctcaagtgatcctcccacttgagcttcccaagtagctaggaatacaggtgcatgccactatgcctggctaagtttaaaatttttttttgtagagatgggagtctcattatgttgcccaggctggtctccaactcctgggctcaagtgatcctcccactatggcctcccaaagtgctaggatttgggcaggagctactttacctggcctggttttcaaaaattttaagcaggattctttcccaaatgaaactggatacagaatttctttgtatccaggagacagactgggagcgatgctgcagggtggtggggtggtggtggggggatgggaggaaggaaggggtgaaggggaaggcactgagccttccctagtggggcctaggcacttccaaaggcctcccaggagcactttcaaaactgatcttccaaagttcccagacaggtcttgcttctgtcctactgagtgagactggtggggttgggtggggggcgggaggaagaaggagcaggagtttgcatttttatttatttatttattttatttatatttgagacggagtctcgctctgtcgcccagcctagagtgcagtggcacgatcttggctcactgcaacctccacctcctggggttcaagcagttctactgccttagcctcctgagtagctgggattgcagccatgggtgaccacgcccgggtaattgttttgtatttttagtagagacatggtttcaccatattggtcaggctggtcttgaactcctgaccttgtgatctgcccgcctcggcctcccaaagtgctgggattacaggcgtgagccactgtgcctggccagtttgcatttttaaaagctccatggaagactctgataggccagactgcccttgctctgtgcaagtccagcaccactctatcccccactcccattaaaaaacaaaaccaaaatgaaatgttcatgcattgatttcctaagtcacaagaagaaatataaccaacaagtagaccacaacgctcctggagggaaactggttcaggagcaggaggtggctactgacctcctcttgcagcaaggggagcaggtgggtgatcaagaaattgagagcctgaggggagaaggtcttgttgcagtgagttcatggaggagccagaatctgaacgaggtgatgcttttcagacccctcctatcctggatccctttggatggacccctctgcttggaaaggggagaaaggagttccccagggtggtcagagtaacctctcctgccttgggggtcctctgggtgtgggaggccttgcaagtgcccagagccagatggagtgatgctgtttcagcaaaggcgccaggaatttggggatgggaaggggtaagggggagagaaaggagacacaatctccgtgggatttgggatgggggcaaacaatgctagtgggaggacatggagtgcaggattttttttcccccctcagatttcccactttagttgaaggctaagcctttgcccaggggatgcaaactaatttcagtattagtttaagccagaaataattgggaaggtaaaacttgcaaaagagaaaccacgccacatatttcaaagacaaattgaaacaatttctggattatccccagacctttcttctgtctaccagtgatcgggatttcttagttgctgagactcttgcccttgcagacctttgtcctggctgaaacctcattaatccttgcatcagccctgggggaggcaggtgagggtgagggatggctcttccgctgttttaggagagaccactgaggttgaaaggccggtgacgtagacataatgtcctttgggcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctgggtaagagggctccatggcagcatgaagaacacctgtttccctagctcttcgctgtgtccatctctctctgtctccactgccaccatcctggcccaagcccccaccatttctggcctggacagtcgcagtagcctccacactggtctctagctgtggctcttgccctctgtggtctattcattacacagtagccagactgaccttttattatttatttatttatttatttatttatttatttatttatttttgagatggagtctcacacttgtcgcctgggctggagtgcagtggcgcaatcttggctcactgcaacctctgcctcctgggtttaagtgattcttctgcctcagcctcccaagcagctgggactacaggtgtccaccaccacgcctggctaatttttgtatttttagtagagacgggttttcaccatgttggccaggctggtctcgaactcctgacctcaggtgatccacccaccttggcctcccaaaatagtgggattacaggtgtgagccactgcatgcggcccagactgaccttttaaaaacgtgaaccaggtgatgtcactcttctgtttagaatactttggtggcttcccattgtgctcatgaacaaaatgaaaatccttcacatgaacttctgggccttgtgtgatccagtttctgctacttttttagcctccttactccttaagctgtagcaacactggccttcttggtcctcaagtcagtcgaactccttctggaatcagggcctttgcacatgcccttccacctgtctggactgccctttctttctctttccctggttagcttcagctcagttgacatgacacctccacagggaagccttccctaatattcaggtcttaactggtgctccctggcaggtgctcctatagcaccctacccctttttttcctcattcattctggcagtgaatattgagtgtctacttctgccaggtgtggttgcatgttgtggggatatattggtgcaaaagcgcaatgaaatctcttccttcagggagcttacattacagctgagggtggcggggagataggcacagaataaatacagaatatatcaggcagtggtaaatactaaggagtaaaataaagtaggcctaggatatgaggagagatagggaagcgttgctgttttattaagggtgcctgggaaggctacactgatatgatgatgtttgagcaagacctgaaggaaataagggataactgaatggatatttggggaagtagctttccagagagagggaggaggaagtgcagaggcttgagtggtgagtgtgcctggtgtgtctgaggacaagccaggtggccagagtggtggaaggtcaggtcagacttcccagggcggacctttgggagagctgggattttattctgagtgagatggggagtcactacagcgttctaagcagaggagagacatgatctgatttcagattgagaagcctggccatagctgctgtggggaagatgggagcagaagcacaggggccgggtggaggactttcctgtgttttttttttttttttttttttttttttgagacagagtctcactcttgtcaccaaggctggagtgcggtggcgcgatctcagctcactctaccctctgccttgtgggtttaagcgattcttgtgcatcagcctcccgagtagctgggattacaggcatgtgccatcatgcccaactaattttttttgtatttttagtcgagacggtgttttaccatttggcaaaatttgaactcctgacctcaagtgaaccacccacctcggcctcccaaaatgctgggattacaggcatgagccaccatgcctggccaggacctttctgtaacagacaaaatgactatggttggggcgcagaggggagcaaacgtagagtggagagaaggggtcaattttgcgtgtattttgaagagaaaaccaacaggatttgcccttgggttggctgtggggtgtgagagactataccaaggattttgttctgagcaggtggacaaatatagaattatcattttctaagacagggaaggtggggaggaacaggattggagaggaaatcaggagttgagtttcagccgtgttgaggttgagacacttgttgacatacactgtaatcacatggttatttgattactgaatacttgttcagtgtctcccactagactgtaagctctgagagggcaggcacagggtctgttttgcttaccagtctagccttagcacctagcacagtgaccagcgtacagtaggtacttactataatacttgtttaattggattaatgaacttgtcagcagcactgcctgacatgtagtcagcactcagtggtgtatgttcaatgaatgaatgaatccgtgaatagtgagtctagctgctgacatgctcacgatgatgggggggtagagccacaccccacactgccctgggttctgtagtcctcccacctcccctcacttctatcatcctgtcctgttggtcacctgtctgtccctctcctgcagctggtgagtgacacacggagagtgtctgacatccagtggtttcgggaggcctatggggccgtgacgcagacggtccgcgttgtagcgttggagcagagccgacagcagcggggctgggtgttcacgccaggtgagccactctatgtgtagggcacaggaggacacaggctacccaccctgtggtttgtctaccgggcaggcctgggggaagtgaataagggatgataaaggagaatctgaggcctcctgattagggagtagcatggtggacagaatcctgagggtcaaggttcccttggcttaacctaggctatcttctcatggccagtgggctgctttggtggtctggctgggacccacccccatgattcttcacctttgctttccagcccagtaggggctgacagtggtcaggggcaaacctgacaaagctcacttctgtttaacacagtagtggagttagaagttagtagtggagaggaagttctgctgggagcttcagtggtgcaagcccaggacccgctctgtgggcttcagaagcacagctcaggcttccttcctgccctagatcactgtgacttagagcagcagttcagatccaatgggtatgaccactactaatgctgctcatttctggggcactcacatgtccaggcctgtgctaagcattttatatgcactgtctcactttaccatcaaaacagattcagcaggtagatgctgttattagtttacccatggttggatgaggccctggcctgaaaggttaagtctctttcccagggtcacaaagagtgagaggaggagctggcctcctgaccctctgcttctgactccagcacatgctgcctcctgaggggattgagtcagacagatttagggatagaaaaggacacaaccagcttgacagaaaatgaaaacacagtgcccttttgggttgtgtgtggttttagatgacccgattcaccctctgtaggcagtagcaagtgaaggattaagtcaggagggatcagctgagaggcccaggtggctatgggctactgaacctgccatcacagtgtttcaggggtagggaggtgccttctgggtgggtagcccttggctctagggtagcagaggagaggccgggagggcccactccagttggggttagcaggccttgatgcctgctgtctgtctggagggctgaggcctgacctcaccatgcttccttcataggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcacactctcagagctgcttgtctctcatttccttgatgccaagctggcctgggtggggtttagaaggcgttagggtgtcatggtggctggagggtccctgttccacctcccacctggctagaatgtattcttcagaggttgacctatgctgcaccccacaggcaactggcctgtttatgttggaggtgggattgggttgaggcccttaccctctggtatagcgccatgaaaggctgtgatccatagaaagtgccaccagcaagtgccccctccccccgctttttttttttctttgagacagggtcttattctgtcacccaggctggcatgcagtggtgtgatcatagctcattgcagcctgacctcctgggctcaagcaatcctgcctcagcctgccaagtagctgggtctacaggcacacaccactatatttggctaatttttttcatttttagtagagacagggtttcgctatgttgcccaggctggtcttgaactcctgaacttaagcaatgctcccaccttggcctcctaaagtgttgggattacaagtgcgagccattaccatgcctggccctgcccttgtaatttatatagccttttataatttccaaatttcttctagattcttcacagctaccccctgaaatgggcgaggataggattttcatcgcatttagcagatgccaagaactcaaagaagtgaaacaacttctccagggttagagggcttagtaagtgtcagtgctgtgtggaacccaggccacttgactcctgaccaggccccttctgcacattcctatggttgtggtacaaagtcccaaggctccttgctgtccccaggccaagcctaagccctccaactctggccctggcttcgtaatcctcccacaaattctgttctcacagataaggggacagccaaagaaattacactttcagtgtgacccagactgaatcttgtttctgcccagatctcctctgctctgctgccatcatccttgctgggtgccaggcactgggcacataaagatgaacaggtcacaggactgttccttaaggaactcttgacctcagtgagaaatagacaccctccaggtgcccaggaacctgaaggcagtgccaaagacaacttcagttctctgggaaggagggtgggcttccatgacacccaggcctgccgtgcctgggtgagcactgaccccttgtcccaggggcactgccattgctgcttggaaatccctctctggagctgggagcaaatgattgtgaacaatcccagtcatggaaatgtccaaaagtcactggggccaactctgatgaatgtgggaggcaaagtttttgggttacaaaccttaacgagtcataaggtttgtaaagaagtcgattaggggctggggtggggtggctcatgcctataatcccagcactttgggaggcagaggagggtggatcatttgaggtcaggagttcaagaccaacctggccaacatggcaaaaccccatctaccaaaaatacaaaaattagctgggcatggtggcaggtgcctgtaatcccagctactcaggaggctgaggcaggagaattgcttgaacctgggaggcagagatcttgccactgcactccagcctgggcgacagagcgagactatctctgagaaaaaaagaagggcaggaaggacacaatcaaaccagggagaacatagagtccacggggccagctaagaggcttctgcaagattccaagcaagaagtagcacaggctgaaggagagagggtcactggaaagcagatgggttggtggtggcattcaactttgtttctgacccagcccacctgataccgggcatattcccatcagtgaaactggctcactgcctgaaggggagcagaggttccgggcacaggagccctgtcagaacctccgggttggaggtgaggaaacacctactgcatgacatcattacctgcttgattccagcatgtcttctgtagtcctgtctcaccatgcattcaatcacatccacttcctgagcacctgctgtggctctaggagctagggacacagctacaagagagacatgggccctgccatcacggaatttacctttcagaaataatcctagacagggtaggttccacagaacttggggaccgattagccacagcagctggggagatggaggagttcaaacttgtgccagaaaccctgggttttatcgccttccctgaagggggtgtcttcagcatgtgggaatgtggtagtaccttctcagtttggaagccagtgaatccctgccttcgtaggcaatgagggtcaaagctccagatggatgtgaacctatcaagtgtggtactagagtaagagttgatgcagacaggggggtagggactggtgggtctcctgtgccctccgggaggggtgctgccctgctttcttggctctgggtatttagaggagacacaggattatgacttgggagccagtgggtctgtctacctggtgacaggttggtagtgatgccttttaaaataggaagcccagtgtctgccggattcgaagttcataatatttttttttttttttgagatggagtctcgctctgtcacccaggctggagtgcagtggcacaatctcagctcactgcaacctccacctcccaggttcaatgcttcagcctcccgagtagctgggattacaggctcccgccaccacgtccagctaagttttgtatttttggtagagacgaggtttcaccatgttggccaggctgttctcaaacttctgacctcaggtgatccacctgtctcggcctcccaaagtgctgggattacaggcgtgagccactgcgcccagcctcataatttttttttttaagcaaggtcttgcgctgtcatctgggctggagtgcagtggtgcaattacagctcactgcagtctcaacctcctgaccccaggtgatcttcctatctcagcttcttgagtagctgggaccacaggtgtgtaccaccatgccaagctaattaaaaaaattttttttttagtgatggggtctcgctgtgttgcccaggctggttttgaagtcttgggcccaagtgatcctcctgccttggcctctcaaagtgctaggattacaggcatgagccactgcgcccagctcataattttttttaactgatatttccctaaatataaaaaccaagaataaccctcacttttgacactatatgttatgatgagagccttagctgctttttatttcaagacattctccccacttcactgctacaggttgaccatcccgagtccaaaaatctgaaacctgaggtactccgaagtccaaaactttttgagggctgatatgacgcccaaaggaaatgatgagtggagcattttgtattttgtgtttttggatctgggatgcttaactggtaagtataatgcaaatattttaaaataaagatcagaaattcaaaacacttctggtccccagcattttggataagggatactcaacctatagtctttgctcactttgtctgtggttataatctcagagtataaagctacttatttatttttttctttaagacagggtctccctctgtcacccaggctggaatgcagtggcatgattatagcacactgcagcctcaaactcctggactcaagtgatcctcccacctcagcctctggagtagctaggactaaggtacgcgccaccatgcttggctaattttaaattttttttgtagagatgggggtctcactatgttgccagggctggtcttgaacttctagcttcaaacgaagcttccactttggcctcccaaagtgctgggattacaggcatgggccaccatgcctggccaagttatttttaatattatgtgtctgttattttactacttcttctttttttatttattacccacccatgaatgtatgtatatgttattttagtcatgatttgtaacactaacagcctctttaaaaatttattattatatttctaaacaactttattgagctataattaaaatataataactacatatatttaaaatgtacaatttaggtggggtacggtggctcacacttgtaatcccagcactttgggaggctgaggcgggtggatcacttgaggtcaggagttcgagaccagcctggctaacacggtgaaaccccgtctctactagaatacaaaaattagctgggcatggtggtacatgcctgtaatcccagctacttgggtggctgaggcaggagaatcacttgagtcaggaggtagaggttgcagtgagccaagatggcgccactgcactctagcctgggcaacagaataagactccatctcaaaaaaaaaaagtacagtttactgagttttgacatatgtatacatctgtgaaaccacagtacaatcactatggacatattcatcactctcaaacatttcctcatgtccccttgtaattcctcctctcgcctctccctgattccccaccctcacccccaagcaaccactggtctgctttctgtctctatggatgtttatattttcaaggattttgtataaagaataataaaatttggcgagatgcagtggcttacgcctgtaatcccagcactttgagagctcaagggagggcagatcacctgaggtcgggagttcaagactagcctggctaacatggtgaaactccatctctactaaaaattagccaggtgtggtggcgaatgcctgtagtcccagctacgtgggaggctgaggcaggagaatctcttgaaccagggaggcggaggttgcagtgggctgagatcgtgccactgcactccagcctgggtgacagagccagactccatctcaaaaaaaaaaaaagattaataaagttttatacaaagaacagtatatattctttattgtcttgtttcttttcattgagcataattattttgaggttcatccacattattggtggtatcagtagttcattcctttttttttattggtatgtggtatgaatataccacagttgtttaccagttcacctgttgatgaacatttaggttgttcctagtgtttggatatgacaaataaagcaactatatacattgatgtacaacatgtataagtctttgtgtggacatgtgctttcatttctctcaggtaaatatcttttcaacttttttttttaagacggagtttcgctgttgttgcccaggctggagtgcaatggcacaatctcggctcaccgcaacctctgcctcccgggttcacacgattctcctgcctcagtctcctgagtagcttggattacaggcatgtgccaccaagcccagctaattttgtatttttagtagagacagggtttctccatgttggtcaggctggtctcaaactcccaacctcaggtgatccacccgcctcagcctcccaaagtgctgggattacaggcgtgagccaccacacccggccgacttttgtttttgagacagagtcttgctctgtcgcccagactggaatgcagtgacaggatctcagctcactgcaacctccacctcctgggctcaagcgattcttctgcctcagcctcctgagtagctgggactacaggtgcctgccaccatgcccagctactttttgtgttttttcatagagactgggttttgccatgttgcccagggtgatctcgaactcctgggctcaagcaatctgcctgccttagcctcctaaagtgctgggaccacaggcatgagccaccgggcgtggcttaactttatttttggagactgtgtctcattctgttgcttgggatggagtgcagtggcatgatcacggctcactgcagcctcgacccccctgggctcaagtgatcctcccatctcagtctcccgagtagctggtactacaggcataaaccaccatgcctggctaaatttttttgtattttgtagacaaggtgtctccatgttgctcaggctggtctcaaactcttgggctcaagcattcctgagcccaggagtttggcaggctgaggcctgcctcatcctcccaaagtgctgggattataggcatgagccactatgcccagccacctttttaacattttttttttttgagacagagttttggtctggttgccgaggcaggagtgtgatggcgtgatcttggctcactgcagtctgtacctcccgggttcaaacgattctcctgcctcagcctcccgagtagctgggattataggcatgcaccaccatgccaggctaatttttgtatttttagtagagatggggttttgccatgttgtcaggctgatctcgaactcctggcctcaggtgatctgcccacctcggcctcccaaagtgctgggattacaggcgtgagccaccatgcctggtcttaacttttttttttgagacggagttttgctcttgttgcccaggctggagtcaatggtgcaacctcagctcactgcaacatctgcctcctgggttcaagtgattctcctgcctcagcctcctaagtagctgggattacaggcacctgctaccatgcctggctaattttgtatttttagtagagacagggtttcaccatgttggtcaagctggtctcaaactcctgacctcaggtgatccatctgccttggcctcccaaagtgttgcgattacaggcatgagccactgcacccggcctacctttttaacttcttcttttttttttctttgagtctgtgtttcacgcttgttgcccaggcagaagtgcaatggcacgatctcagctcactgcaacatccgcctcccaggttcaagcgattctcctgcctcagcctcccaagtagctgggattacaggcatgtgccaccatgcctggctaatttttgtatttttagtagagatggggtttaatcatgttggccaggctagtctcgtactcctgacctcaggcgatccacccgcctcagcctcccaaagtgctgggattacaggcgtgtgccactgctcctggcttacctttttaacttttaaagaaatccctgccaaattgttttccaaagtggttgtaccacagtcccaccaattgtgaatgagagttacagttggtgtgcattcttaccaatactttatatgatgagtcttttaccttttagccattatagtaagtatgtagtggtatgtcattgactttttttttttttttttttttttttttgagacagagtcttactctgttactctgtcgcccaggctggagtgcagtgccatgatctcggctcactgcaaccttcacctcctaggttcaagtgattctcctgcctcagcctcccgagtagctgggactacagatacatgccaccatgctgggctaatttttgtatttttagtagagacggggtcttaccatgttggccaggctggtctcgagctcctgacctcaagtgatctgcctgcctcagcctcccaaagtgctgggattgcaggcgtgagccactgcgcctggccctcattggtattttatttgcattttcctaatgactaatttggtacaaatcctgtattcacatttgatgaaatctgtcagcaagcttgaaataggatggtgatatagtttggatatttgtcctcacccaaatcgcatgttgaaatgtaatcccagtgttggagctggggcctagtgggaggtgtttggatcatgggggcagatcccttttgaatggcttaggccatcaactgagtcataagtgagcttttgttctgagttcacacgagatctgtttgtttaaaagtgtgtggcagaggccagggtaggaagatcacttgagcccaggagttcaagaccagcctagcctgggcaacatagtgagaccttgtctggattcattaaaaaaaaaaaaaaaagtgtatggcaccttccccataatctccctctctcttgctcctactcttgccatatgacatgcctgttcctcctttgccttctgccatgattgtaagcttcctgaagcctccccagaaactgagcagatgccagcaccatgcttcctgtaaagcctgcagaacagtgagccaattaaacctcttttctttataaattacccagtctcaagtatttatagcaatgcaaaaatggcttaatgtagatggaatatactcagcctcataaagaatatctgtaaaagccctactgctaacaacacacttagtggtgaaatactaaatgttttccccctaagactgggaataaggcaatgatgtttgttctcatcacctattcgacattctactggaggttctagccagtgcaataagagagagaaaaaaaaagccatctaaattgggaaggaagtaataaaactccttttattcatagatgacatgatcatctatgtagaaaattggatggattctccaaaaaagctattagaacttataagtgagttcaataaagttgcaaggtcaatatacaaaagtcaatatttctatttcttagcaatgagcaatcaaattgagataaataatgccaattacaataccatcaaaatatgaaatagggataaatctgatagaagacataacatctgtacattgaaaatgacaaaacattgctaagagaaattaaaagactaaataagcaaagagattatactacattcatatattggaagactcaatattgtttatttttttgagttggagtctcactctgttgcttgggctggagtgcagtggtgtgatctcggctcactgcaacctctgcctcccaggttcaactgattcttgtgcctcagcctcccatgtagctgggattacaggcacatgccaccacacccggctactttttgtatttttagtagagatggggtttcaccatgttggccaggctggtctcaaactcctgacctcaagtgatccgcccacctcagcctcccaaagtgctgagattacaggcatgagccaccgcacctggctcaatattgttaacatatttattttttaaattcaggtataatcacacacagtgaaatgtactgaccttaagaatacagtacaatgagttttgacaaatgtgcacacctgtataacacaaacccttatcatgatagaacacattttcattatttcagaaggtttccttttaactcatcctactcaatccctgctttcccagaaacaattgttttgaattctttcaccatagattagttttgcctgttctagaatttcacacaaatgactaacatccaactttaaaccaaatttacaacaatgatttataatttagacttcaccggtttattgctcattttcaatccttttatagtacctcaacttccccatttttgaattttgtattttgattcctctccagatagttaatgtgtcttgaaaaattttttgaaaatggtatgtagatgatttttttttttttttttgagacagagtcttgctctgtcgcccaggctgcagtgcagcagcatgatcttggctcactgcaacctctgcctcctgggttaaagtgattctcctgcctcagcctcctgagtagctgggattacaggcatgtgccaccacacccagctaatttttgtattttagtagagatgtggtttcaccatgttggccaggctggtctcgaacttctgacctcaagtgatcagcctgcctcggcctcctaaagtgctgggattagaggcatgagccactgcgcccggccatgatctattttctgaacctatatgtatgagagaatgacattctcttgcctctatatttggacaatgacttggttggcataagtttcatgacctggttccactgtctggagagtatgaggtcaccttgacttttgttcctttgaaggtaaccttctttttttgcctggatgcttttggatattttctttcttctttttgtcttcattttcgaaattcaaatcctggcattctccaaggcagagatatggacgtgtcttaacaggaaaaagttggcatcttattgttcctggtaaagcattattgaataatgagatgggaactgaaatggtcttgtgcatccaactgtctgctgtaacctaaagtagtcaccttgggcatttgggctgagacacttcagggctgttgcctttatcaaatggctttgggagctcctctttgctttgaggacctgccctcaactctgccaaattctcatccccaaaagtgcatttgggttttggaaacgaccaaagggaatttggtactaaactctggtgaaagagacatcttatggccaggaaaaatagtcctgtaatgtaataattctaaaacttaccaaagttaattctcagagaggaatttttaaaagttgccttagtaatcaagcctctgtatcttcgcatgtgccattcatgctgcctaaagtacccttcctagttgcttgggcttggacccctacaacttgagcagagcaaggggcactccacttccatttccagaatgctccacagtgtacactttctcactcctccaccatgctgtgagcaagtaaggaaaggtttttttcctttcgagtctttggtacattgcacatagtagaggtatattagtcggttttgcattgctataaaggagtacctgagactgagtaatttatgaagtaaagagttctacaggctatacaagcatggcaccagcatctgttctgcttctggtgagggctcaggaagcctccgctcatggctgaaggcaaagggggagcaggcgtgtcacatggtgagagagggaacaagagagacagcaggaggtgccaggctccttgaaacaaccagctgtcctgtgaagtaacagagagagaactcactcattaccactgggatggcaccaagccattcatgagggttctggccccatgacccaaacacctcccatcaggctgtacctccaacattggggatcacatttcaacatgagatttggaggggataaacatccaaaccatatcagtaggtctcaatacatgtttgtgacaatgaagaaagtttatgtgttagaaaacaatatgacctcctaagcttattgtcatgaagcagttagcagtcatttggatgtattaagttatggcgaatgtgtttgaagcaagaacaaattgcctcccgttgcattactcttactcattatagacagtcacatgctggcaaatgtttaacaatcagctccctggaaggggaaaaacagccctgatttgtagtgtttgaccatttctgtagtgtaaatattcccactgtggctgatttcaatctaccagtgggatgtcagctggctagcaaaatccctgaacatgcaaaatgttggctcttgcaagccagtagaaggtggctgaagctggttccaatgcaccattgtacacattctacacctcttttgtttttccatcatcacccagttcatttgcgtgctccttgtacagcacatgtctatgactatattttatcccttgcatcaatctgatactatttttatcttcattttacaggtagtaaaataaggcccagagacaaagggacttgtccaaggtggcaaagctttcctgtctattcctgggttcagtttctcactgtagctccctgcctggagcccgacactgcaagggactagagagatgtcttctttgcccagttttcttttctctgatgttgagggaaggacccaagcaccctgtgcttgccaccagctctcatgcccaggacattcctgctggcagctgagctgtgatgaatgctggcatttgtcttgttcacttgctacctgataaacaggtgacagggagtttaacaactttcattagacggggatcagctctcactctcatggcctaattcaggatctggacagtgtcatgttgtctgacagccaagtgaagtgatgggtccccctttacagtttaggattttaattattttcttccaggtgagtcccaggaacatccagccaaaggcaagttctttgggagcccaagctcatggcagtgacagctcccccaggagacgagaggtgaaactgatgcctgcttcctgctatgttattttgtctttaacacttgccagtttctgggcttgttgaaggcctatgttagggactgtgtgagactttctgagagatcaccacctagatatgtgatgtcacacaaagtgagtattgtaatggacctcagtgatctagctcgaaacctcttgcttacagacgaggaaactgaggctcagagaggggaagtggtttgctcaaggtcaagcggcaatgactggcaatgccaaaagttggccccaaggcttctgactccccactccgtgcccttccctcaccctaaatgtctcagagagcatgaacctgtgccctttatcggaggagggcagagacggctcagcctgagcccatgggagttcagcccagttccctgcttcctgggtttgtccagcctactctgaagaggccaggccacctgcctattccacctggcatgtcctgcttaggtgaatcaagctgtaccaggatgaggaagccacagagtcacttcccagaagggaataatgctgtgtgctagaggatgatggggtgggagagatgggaacagacttggacttgctgttcctagggtgctgaggctgagattcctgaggtgggggaggccctgcccttcactgtggctgttttccatctgggcattgactgtgtctgctaaatgggacatgcccagcaatgtccttctgccgtgacacctttggtgaatttccaggcatattagaactgagccagtggtagctttggctcctcagctcttctgctgcagtggctggctgtcctcaggacagctggattggattgggcattgttctagcagatctgggatgttccaggaaccgcactataaattctgttgagtattggctgagtgtgccaggaagggcagggggccaaggacttggatccatttggcaaagttactctcagcacctcttgaagaaagcactagagagagaggggctcagaaccttgcctgggcagggtcagtggggaagcagtgggtcaagggaagataacatgatggcatgcttcatgatttaccatgtgttttcccatatattatttcatctaatccttgcaatagccctattgtcatttccattttaaaactgaagaaatggggacacagaaagatgaaatgactttgcccagcacactttggagtcagatttgaatcccacctgtcactatccacctgtgggatcttgagcaagttaggttacctttctgagccttgattcctgcctgtacaaaggggataatgctgctcacatggaggtttgtttaggcagcacagcacttgcctggagcaagaggccagggactgactttttccttttcccctgacctcaaatcacacagcccaagacagtggagttgggcctgggattgaacttctattccatttttagtgtcttctcccccttactctttggtatatgtgagataaagctggcagttttggaaaaggaattcttattaagaaataaaggggaaacatggaaatagacatgaaggtgtgaagggcaaaatgctgacgccatgtctgtgtaatgtggagctcaggctggcgtgcccggggctctcccacctccacccctgctcttttgtctcctctcagcatgtctggctggcccagacttgcaatatgcccacaggctggtcctccagggttccaggggccctcccagaagcttcccccacctgctctgggtgtgggccctatgaatgggatcaacaatgaatggtctgagcctaccttgaactgggagtgtggccaaccaaaatcagccctgcacaggctcggtgtgtcctttggtggccctggggccccgagtgagtggctcctcagcacacctcaggactcgaaccccttcccaccatggccacaggtagttttttgtttgacaacagaggtgaatctggaaggtccacactcaggatgtataggccatgtaagcatgagtgaggtgcaacttaagccttggtcatacctggtttccttctgtcaatcattcttcatgggctccattttcatgacatctggtgggattgaacttgaccagctcaaaaattggtattgtcaattatggtcaacttccattaagccaaacctagtatggagcttggagcccattcattcattcatttaaccaaggagtatctatcacccattatacatgaatcaggacatataaggttgaacaaaacccagcccttgcctttggggagctcacagatcagtaggggtaacagacaagaaaatacaaccgtgtgataacagggatgataatactttcaggaggagggagggtgaagtgatgtgacagtgacttgcagagtctatggaattagatgagctgactcctgcaagccaagcaggccatcgtgacccttccctatgtagttgctgccattgggacttacccaggtgtgatgggagatggaaggagcttggggcacacagcagtgccacctcatgtatgccctcattcttccaccctctttctcggggtagtttgactcatctgagcctgggtttcctccacttacatctcagggaggggtttgaccttgcctagtgctggccggatggatggtcagctccatatcttggcgctgtgacttcctgggacccgcctttgcttccaggagtccatgtttcttctggtcactgatttagccactgcagtcacccctgccccaactcctggcaagggttatggattttattcagtacacaatgtacacagttttggtcttaggatatagtgacctatggctgtctgcccataattaggtccttatttcatgttatttggtactttttgctgaatagcctgggcaggcccttttactatggctttggtctcaccccttggatgaccattttggtgctgtgctctccattctgaacttttttttgagagggggtctgggtcttgctatgttgcccaggctggtctcaaactcctgggctcaggagtcctcccacctcagcctccgagtagcattctgaacattttgctcccagttcctagggcttgccaggctcctgctcacctttgcttacctttgtgtgtactgtttctctcctggaacgctcttgccccttctgctctcctggccaactcttcctcttgctttggttccgtgtcacttcattctctggctttgctactccttccccaaggtgaggtgtccttgctctggaattctacagcatgctctgtctagcctcaccatctcctgggaaagtctatgtaactgtcctccctgcaaccctctgagctctctggtccctcttactgatgcaactcctagcatttctcatgtggccggtgggcagtaaatgttgaaaaagtgaataagagagtgaatccaccactggtcaggaggccataattaggaccatgaaagagcctgggctctggggcacatggatccattagctcaggtcccagacacacagtggtggtgtggccacattgatgttgtctcttttccaggcatcaggaagctgagcaggtgatgaaagccagagcggctgagccctagcctgtgtccccgccttatctcctcaaccccattctcctcctcccatcccttcctcctgcctcggtggtgagtctttccgtgcttagctgctcactagtgcccacccccatctatggccctgccacattaactagcccctctctctcatgttttccaatttctccatcctcgcctgtcctgaaacagctttccttctgctgacccctccagtatcatctcagttattttgtcccctttactcctgaacactttgcaatttgacctctgctcctgtctctactgaaactgcttcttgaaggtcacccaccactgacagcgtctttagttctccctcatgaccagtctgcatcagccgaccaactcacccactccactccctctctcttgaattcacttttttggttctcctgcctttctgctcctgccttttctatttctgactcctcctcttgttggggtgatcagacccaacaccaggtcgtaggggtgacaaaatccggcaaattcaaaggattgagaaaaagagtttgagagagaaaggtgggatcagggggccatcgcgattgtggaggctgcaaaggccctgagctctgggaccctgtggtatttattagtaatccaacaaagaaacaggtggtgagaatgtggaggtcaaaagggcaggcacatgatctatagctgtgatggtttagcatttataaggaacattttctgctacttgagatagtgagagtaggttcttttaactcaagatacaattgatcctgggagagcaaggagccagcaagtctagacacattccagagccatgagccctggattctatccaagtcacgagggattttatgccctgggcttagattatggtgcgtcagggtagccttccaccctttagcacagagcttggtgttccaaaggccacaaggggttttagaccctggaccccggacatgttccaagactcttttacattgtgtcagacatgcaaaccctgcctcagcttctcctaacactcagcttttcccaacatcctctcttcttgtcctagaaatacaggtgttcctcaggccctgccttctgttctctcttttgcctccttccttggtgagatcaccttaatatggatgactctggagttttcctgtctttacatgggcgtcctatgcgctgtattcggagtggcttcatgttggctcttgaagcgtgcttcttccgtaacgggctcccttccatcactcacactggaacagggtacctggccgagacccaaccttcagatttttgaagacttggtaaactgaaaagggaaaaactgctatggaaaagttgcaaggaatttttatatttagaggtggtgagatcaattccctttaggatcagggagtctcttcgtttcagaaaaattgcccaaaggagccctttcattacgcacatatgaagtaagcacttacccagtgcttgggcagaatgcagtcccaggatacctgagtgcactagctttgatccatcattctgtttggcaacatcatctcttgtgcgtaactgagccggagctctgcctctgagccattcttacttttttttttttttttttttgggacagagtttgcccaggctggagtgcagtggcacgatcttggctcactgcaatctccacctcctgggttcgagcgattctcctgcctcagcctcctgagtagctgggattaccatgtgccaccaagcctggctaatttttttgtgttttttagagatggggtttccccatgttggccaggctggtctcaaactcctgtcctcaagtgatctgtccactttggcctcccaaagtgctgagattataagcgtgagccaccatgcccggcccatcctcacttttggggagttgggggaaggaaaactatttcttgaatctgtaggaatttagaggacgctgagctgcagactgctgtttgtcttgtgggattgagtgttcttgtaggccagtggtttgtggggtgtccagagctgaggtgacaagaactgctggtaggacccatggatgtgatgcgctcatactttgtcttggaggacagactaaagccagagctgtctggacccagtgcagtagcgcctgaatgggatgggccgcaggtggcctgtttgtggtcatgttgtctgtctcccactggactgtaggcagcatgagggcaagcaccatgcttctccagtgtctagctcacacagcacctggccaatccctgccgattgaatgaaagatgaatgaatattgtgggctgctgtacttggggccatagagcaagagcaccctctcttggtagggctggggtttctccggaaggatccataatcctgggaaaagaatgctcttcaatgggaaaggtgggctgtccctggctactggggaacctctttatttcctctgtgggctggctgggagctcatcgtggtggtgggcctggggccctgagagtagcgccatctctagtagctggagctgtttctcctcggccttgtgctttccttccgtgatccttagtaagagtctgaggtgtggcctatggaactgcccctcacatttgtggggctggaacaagaggcctacatactagatgtctaaacattcaaaaattataaataagccaggctcacgcctgtactcttacctactaggaaggctgaggtgggagggttgcttgagcctaggtgtttgagttcagcctgaagaacatagtgagaccctgtctcaaaaaaaaaaagttataaataaaactaacaaactgttaaataaataaaatgtggctgggcgcagtggctcacgcctgtaatcccagcactttgggaggccgaggcaggtggatcacctgagatcaggagttcgagaccagcccggccaacatagtaaaaccccatctttactgaaagtacaaaaattagctgggcgtggtggctcatgcctgtaatcccagctactcgggaggctgaggcaggagaatcacttgaaccggggaggtagaggtttgcagtgaaccaagattgcaacactgcagtccagtctgggcaacaaagtgagactctgtctcaaaaaaaaaaaaaaaaaaaaaaatatatatatatatatatatatatatattcacatatatattcatatgttcatatatatgtatatatattctaacctcctactttgacaaatatacctttataatgacaaagctgaaaaatatgtaactcaaagttgccaacatatcaaaattgattgaatttaattattgttgtatatgtctagatgttctattaatgtgccagagatgattgcataagtaatgaaggtaaatgtcacttataaattattctatttttccataacgtttatttttcttgcctttattttagaaaatcacaaattatattaatttgatgaagatcttcacctaatttgtgtgctgttgatagtaatgatctagataaaagtataaaagtcattttttctaaaaagtatagaatctgaatatttttcattaaaatatacattgcaataaatgtaaaacactaagaaattaaggctgggcgaggtagctttgggaggcttaattttgggaggccaaaattaagcactttgggaggctgaggcgggtggatcacctgaagtcaggagctcaagacaagcctggccaacaaggcaaaaccccgtctctaccaaaaatacaaaaatcagccgggcgtgatggcgcatgcctgtagtcccagctacttgggaggctgaggcatgagaatcgcttgaacctgggaggtggaggttgcagtgaaccgagatcgcgccactgcgctccagcctgggtgacagagcgagactccgtctcaaaaaaaaaaaaaaaaaaagaatgaataagatctagtatttgctagcacgacagggcgaatatagtaaaacaaaattgtacatttaaaaataacaaaacctaggcaacatggcaaaactctgtttctacgaaaaacacacaaaaattagcaaggtgtgccggtgtgtgtctgtaatcctagctactcagggggagctgagaggtggaaggatcacttgagcccaggaggttgaggctgcagtgagccaagattgctccactgcactccagcctgggtgaccctgtctcaaaaaaaaaaaaaaaaaaaaagaacaacaaaaaagcctagaacaatataattggattgtttgtaacacaaaggataaatgcttgaagtgatggataccccatttaccctgatgtgattattgtgtatggcacgcctgtatcactcagctcttatatctcatgtaacccacaaatatgtacacctactatgtacccagaaaaattaaaaattaaaaaaaaagattaaaaagagagaggaaaaaagagacctgagggagcttgttcccctcttccgccacgtgaggatgcatagaaggcaccagctatgaggaataggccctcatcagacactgaatctgctggtgtctcaatcttggacttctcagcctccagagctgtgagcaagaaatttctgttgtttataaattacctaatccaagataatttgttataacaatctgaatagccaaaggcatcaacttatctattaaaataaaaggcaaaatattggtttaaataaatgaatataaaaaattgaaagcaaattttttgaataaagacaattattctaaatttgattttacaaaaatttaaattttattacacgtttttacaaaaataaaactatttccaattctagtattcaatatctagtatttacctcacagccaatgtaataattgagctttatgcatttacatctaggcctacatatttactaatttaagagtaataagaattatttatttatttttaggtattttgctaagcaccatactctttattattattttaaaatttcatagagggtctcactaatcactatgcccaggctggtctcaaatttctggcctcaaatgatcctcccacctgagctcccaagtaggtgggattacaggcatgtgccagcatgcctggctccataatacaaattattcgatattgaaaatattcctcaactactgtgcacaacagttaagaatgctctggtagtcgacgaatacttccatagtcgtgtttgaaacaggaagggaaggaagaaaacgaacattcagcccttctggtgaaagatatgttgtgcttatataaaagggtttgacaaattaattcatttgtcttttcttttactgaaacaattctccactgaaatcttccctgtattctaaagcagagttcatcagcaacattggttgtgcggcaacccacacacctttacagcgttcggatttcgttgcctttgttttgaagacataaggtgagagatgtgcagaaatgttagtcacaaaagaagatgttaggattatgtggtgccctgtgccagcactgagttcagctcctgagagaatgaggtacctgcacgtgtgtgtgtgtgtgtgtgtgtttgagacaaggtctcactcactctgtcaccgaggctggagtgcagtggcatggtcacagctctctgcagcctcaacctccccagctcaaatgatcctctcaccttgacctcctaaagtgctggggttacaggcatgagccactgctcccagccatgtgtgtttgatttattgtaacattttcacataccataaaattcatccatttaaagagaatactttagtggtttctagtacaattcggagttgtgcaaccatcaccaccaattccagaatgttttcatcagtacaagagaaaccccgtactcattagcagtcacttcccattctcccctccccaaccccctggcagccactaatctacattctgcctctatagatttgcctattctggatgtttaatataaatggaattgtagaatatgtgtcctttgtgacttatgtctttcacttagcacaatattttcaaggctcccccatattgtagcagatgtcagtacttcatggctgaatgagattccagtgtatggatacaccacattttgtttatccattcatcagttgatggccattagggttctggctattatgaataatgctgccatgaacattcatgtacacgtttttgtgtgggcatgaattttcaatttttttttttttgagacagagtctcactgtgctgcccaggctggggagcagtggtgtgatcttggctctctgcaacctccactacctggattcaagtgattctcctctctcagcctcctgagtagctgggattataggcatgcacaactatgcctggctaattttttgttttttaattttgtgtttaactagagacagggtttcaccatgctggccaggctggtcttgaacttctgacctcaagtgatctggctgcctcggcctcccaaagtgctgggattacaggcatgagccaccgcgcctggccatattttcagttcttctggggatatacctaggagtggaatttccaagtcacctgcgttcattaacaatgtttgtgtgtatgtatgtgtgtgtgtgtgcatgtgtgtgggttcagggaagggtccttttgcttaagtttaagggtggtattggcagcccattctctgctgtcctgtggggaatgaaggaaagggcttttgtcacactgggctgagtggccagaaaagggtaaaaccagaatggtggctgtcacttgtgagagatgccaaattataatctgggcatttaactgaaaagtggctattctgtgctaacatgctggttatagggccatcaccttcccagtcacccagcctaaatttcatgacacacattttgtgtattaatttcatggtatacattttgtctgtgtcatcatcaataactctcgcatctgccccttccctccaccatcctagtttggcctcacgtggttcattacctcttgtttgctctttgtgttttctgatcacagaagtaatgcacagatacacaaacccaaaagattgcagaaatacaaaatgtagaaagcagagccatccccatactgactcccccagaaatagctatcatcaacaatttagtgccttctcttctgaaacttttatacatattctaacatattatctctgttttaaaacaaaaatagaactgtgtatactgttcatccttgtgttcccccccccatcaaaatatattagacatcttctcatgaaaatacatagaggctcgcatcattctttcaaatagtgatatgcagtctatagtgtggctatatggtggtttatgtaaccagccccatgtttgtggatatttgggttgtttccaagtttccaccattataaactatgctgcaacagtgtttctgtatacatatcctttctgcatttgtgggagtttttctgtagaataaactcccagaaatggaaatgctgggtcagaaaatataaacattaaatattttaaataaatactactacattttcctctgaaaactttatacagtttatattatcattaacagttcctgctgggcacggtggctcatgcctgtaatcctagcactttgggaggctgaggcggttggattgcctgagctcaggagttcgagaccagcctgggcaacaacggtgaaaccccgtctctactaaaatacaaaaaattagccgggcgtggcggtgtgcgcctgtagtcccagctactcgggaggctgaggcaggagaatcgcttgaacccgggaggcggaggttgcagcgagctgagatcgcgccaccgcactccagcctgggcatcagagcgagactccatctccaaaaaaaaaacaaacaaaaaaaacagttcacgagaatgctggtttccctgccttttgcagggctggatattattgatttttgtcatttttaccaatcttggcagtatgtctttttttttttcttttagacggtgtctcactctgtcgcccaggctagagtgcagtggcgcgatctgggctcatggcaacctctgcctcctgggttcaagcaattctcttacctcagcctcctgagtagctgggattacaggcacgtgccaccatgcctggctaatttttgtatttttagtagagacagggtttcactcaggctggtcttgaactcctgactttgtgacccgctcgccttggcctctcaaagttctgggattacaggcgtgagccactgcacctggcagcagtatgtcttcttacctcccttgacatatcatcccagcctcctaaaaggtccctctatgcccagttctttccttttgtttttgtctttgatttttgttttttgtttttagacggagttttgctctgttgcccaggctggagagtgcagtggtgccatcttggctcactgcagcctccacctcctgggttcaagctattctcctgcctcagcctcctgagtagctgggactacaggcacccaccaccatgcctcgctaatttttgtatttttagtagagacagggtttcaccatgttggccaggctggtcttgaactcctggcctcaagtgatccacccgcctcggcctcccaaagtgctgggattacaggcgtgagccactgcacccagccccagtgctctccttttgtaatctgcccaatacatggttctaattatgactttgccaactctaaaaacccttttgaaaaattgcaataggcctgtccaggacacttttcttcacgcaatcaacagatagttattgactatgaccgatgtgccaggcatcgtgctaagcactggaggcgcagcattgaacgggaatgataaggtctctgctgttgtggagtttaattgtcatggtgggagacaaatcacaaacactggagaagcaaaaattatcagactgttatacatgcaataatgagaattaatataggtaggtggtgatggttactgggaggttgggtggacaagaagaaagtttctgaggaggaaacacttaaactgagctctgaatgataagagcaaagatgcagggaatagcatgctaggcagaaggaacagaatgtgcaaaggccagaaaataggaaggaacttggcatggtgaggagttgaaagaagccagattggctagggtggggaggacatggtggtggaatgggatgtgatgagagtagaggcttagccagggtctggattggcacagttttttgaaccagggcaaggagattgaattttaagtgtgatgagaagccactgggcaattctatttttttttttttttttttttgagatggagtctcactctatcgcccaggctggagtgcagtgacatgatctcggcttactgcaacctccgcctcctggatcaagtgattctcctgcctcagcctccaatgtagctgggattacaggcacagaccaccatgcctggctaatttttttgtatttttagtagagatggagggggcctccctatgttgcccaggctggtcttgaactcctggcctcaagtgatcctcttgcctcagcctcccaaagtgctgggattacaggcatgagccaccacgcctggccacaacaattcgaattttgaatctggcctgatctgagttatgttttcagaagatcactctcactgggtgtggaacatagatggtaaatgggcaagaggatcagcagggagaccctgtaggagagactgtggtggcctgggcatggggaaggcagtgcagacagaagtgaacagaatttggatggagtaactaggtagacagtgatgttatttactgagaaggggacgactaagggaaggctaatcctgttctgtccaggagtaaatttgagatacttattaaacatttccatggagatgtcatgtaggcagttggatattttatttatttatttatttatttatttatttatttatttatttattagagacagggtcttgctctgtcacgcgggctggagtgtggtggtacaatcacagctccctgcagccttgacctcctgggttcaagcaatcttcccacctcagcctcccgagtagctgggattacagtggtgtgccaccacgcctggctaatttcgaaatattctgtagagacggagtctcattatgttggccaggctggtctcgaactcctgggctcaagtgattttcccaccttggcctcccaaagtgctgggattgcaggcgtgagccacctagtctggccttctacagaagttttgctgtgggctgggcgcggtggctcacgcttgtaatcccagcactttgggaggccaaggcaggtggattacctgaggtcaggagttcaagaccagcctggtcaacatggtgaaaccccatctttacaaaaatacaaaaattagccagacatggtggcatgtgcctataatcccaggtattcgggaggctgagggggaagaatcgcttgaacccgggaggtggaggttgcagggagcggaggtcgtgccattgcaatccagcctgggtgacagagtgcgactctatctcaaaaaaaaaaaaaaaaaaaagaagaagaagaaggttttgctgtggatgaggaggaaaggaatggaggagcagagggaggggagatgagattgagggaggatttaaaaaaacgattccaggttaagttcacaagacggaggattttaaaataagagatactaggacactatattgtacacaccgcagggtggatttggtagaaaggcagaaattaacgtgcaggagagagaaaatgggcagaagtctgtccttgagacgggagagagaaggggtccaacacaggaatgggtgcagggctgcagggacactgtctgtcctcacaggggaggagcagagagagtgggctttttttttttttaaaacttaactattctaaatacatatgtaagagagaggggtcttgacacaggtgggctgtaagttttgtggtatgcagggatgaggtggttcctgccaggtagcatcaggttttccccaaggaatgccaatgcaaggttactggcatagtggtgtgggagttgtggggaggaggatgcaggccatctggggactgaggagaaggaatgaactcatcatgttggagactggggaaatattcattccaaggaagtgtggtaggattactgggtactcattttattttattctttgagacagtcttgctatgttgcccaggctggcctcgagctcctgggctcaagtgatcctcctgcctcagcctcttgaggaactgggattacaggcaggagccactgcgtccagctttgggtgctcattttagattgacttataaatatccccagctttttcctcagagggaagccttctgtgcttcctggcccagctttcccgcccccatacctgtgctcattcatttcttcattggggtttactaggtggaatctgagccagagggaggaaaggaggaggctggcaaagagagaggccacacagagttccctgtgtgctgctcagggggtcccaccacaaccccaggcagcccagctcagggggtcccactacaatcccgggcagccaagctcagggggtcccaccacaatcctgggcagcccagctcaggaggtcccatcacaaccctgggcagcttagctcacaaggtcccatcacaatctagggcaacccagctcaggaggtcccatcacaaccctgggcagctcagctcagctcacgaggtcccaccacaatctggggcaacccagctcaggaggtcccatcacaaccctgggcagctcagctcacaaggtcccatcacaactgtgggcagctcagctcaggaggtcccaccgcaaccctgggtgctggcagaagacctagcccgcctgcccaggcagggttggaggcagactgactaattttaggaggcctcctggttctattgttctgggtgaggctgggcggtaggggaggtggtttcaggcggggataccagtgtgggaaaggaagcgtggccgctgttgccatgcgagaaggatggaaactgtgagcctggtgtgcaggtttcggccccagggaggttctgctccggttcctatggagcaggtaggaagttgcccttcccctcaccccttcctctgtgagtggcttttccattgtcccagcaaagtgtggggttggctggacccctcagctcccacgccagcgccagcactgccctagcagtgctgggggcagttttcccccacacagctctccagctggacaaagagtgaatgccagcctgtcataggaacacggtgaacttgtttgattctttcaactgccagcaaggctgctaattgccattttgtgtgcagggattggagactcacttgctgaatgccttgcccaaagcctccctttggtagctgagttctctcatgatcccccggtgggttcttaggcttccagaaggacagaatactttgtgcttctggtgaggtttgctcctgttcacatggcagcctgggtgggcacaacaaagatttttttcttagaattgttgtataagaacagagctagcatgggggtctagaaatgggccccaaaggcctgtgttcaaatcttgacccctctaggtgttagccctgtgacctttgagcaagccactgaatctcctggagcctctgggtcctcatctgctccctggggccggtcacccctgcctggttcttggggctgctgtgagctcccatgagataatgcgtaggaaaagtcttgcacgggagaagggactcccactggtgtgaagctaacagtctacagcaagggctggattttatcttggctcaagagggaaaggattgctttacaaaaggaaagagggctcatggtagttatttaggagtttcatggtggtggattttgttgttaaagtcttgtggccaagttacaggaaggcacacagggagacggatgaggtgttgcccaggctggtaaaattccgaaccccactggtctccaaggccctgttgaagaggagagcactaggctgggaaagccactctgaaggcaacttgtatgatttaaaattccaaagatgtctcggcagctgggtatgttctttgttgcttaataggttttctccagctaattctcctgggttctttccatttcctggccagacggagtagctttaatatctctcctcactagcaataagctgctgtctggcgaatggagatgagaacctgcagatccatgggggagggaggaccagagtgatgggatctcagcaatagtgctggagggaagtcaggccgccctcaaggtcacctgagggtcgtggagggccacgcagctgcctgacagaagcagtgctgatcatttttacttctcttatttcctgatgaactcttactcgtcctataagtcaaagctcaagtgatttcccctgtgggaagacttctccaacatcaccagacaaaattaatcggcccttttttgtgctcctatatcattaaggaagatttggttgcaaggaacaggggaaaatcaatttaaatggttttaaacaattaaagataatttattatcttacacagctgtacctttcagaagtaatgttagcttcaggcatggtttgatcaggatgctggctctgtttcttgttagttctctagaccccaccctcctctgatgtgttggctttgtcctctgctagcctctcctatggaggtgatatgactgtcaacagcaatggagactaaattgcttgcttatttataggcagaaggaaagaatgtcttctttcccagccatagaccaaaagccctaagacttactgggtttagacctgaactggccaagaaaatccatacaccaactgacttaggtcagcattatctcctcttcctgaattagtcagtgtgtggtagaaaagatgaaattatgccaggcaggggccaccttggatctgggatggaattaatctcactcaaacgtgtggctgctataaaatacatgtgggtagttcctaaaagaaaatattttatggagaagagggcaattgttgctggtggtgcaaccagcaattgccctctgtactcttgtggtatttggtatactaaactcatgggcacttatgtttgccactccaattcttcttaattttggtgaagtccaatgtattatgttttcttttatggattgtgcttttagtatcatatctaagatatctttgcctaacataaagtcacaaagatttttctcttatgttcttttctagaagttttacagatttaagttttacatttaagtcattgatccattttgaattaatttctgtatatgatattaggtatggattaaagttacatttttgcatatgtatattcaattgttttggcatcatttgttgaaaaggttgtcctttctccactgaattgcctttgcacctttgttgaaaatcagttgccaatacgtgtaggtctatttctggactctattctgttccactaatatttttctctttttgatgccaataccacactcttattattgtagcttgatcatgtcttgaaattaggtagtgtaaaccctctaactttctttttcaaaattattttgacttttttttaggtcatttgcatttccacataagctttatttatttatttatttattgagacgaaatcttgctctgttgcccaagctggagtgcagtggcgtgatgtcagctcagtgcaacttctgcctcccaggttcaagcaattctcctgcctcagcctcccgactagctgggactacaagtatgctaccatgcccagctaatttttgtattttcagtacagatggggtttcaccatgttggccaggctgatcttgaacccctggccttaagtgacctgcctgcctaccttggactcccagagtgctgggattacaggcatgagccactgcacccagcctaaataaactttagaatcagcttataactctacagaaaaagcctgatgtgattttgattgagattgcactgaatctataaatttggggagaactggcaacttaatgatattgagtgtctaacccatgaacatggtatatacttctctgttggtttaaattttctttaatttatctcagcagtgttttgtagttttcagtgtacaggtctaacattaggtcttttattaggtttatccctatttaaattttttttaaaaatttgagacgagtgtcactctgtcgcccaggctggagtgcagtggtgtgatcttggctcactgcaacctctgcctttctggttcaagtgattctcatgcctcagcctcctaagtagctgggactacaggcatgcaccaccacgcccagctaattttgtgtgtgtgtgtgtgtgtgtgtgtgtttagtagaggcagggttttgccatgttgcccaggctggtctcgaactcctgagctcagacaatccacctgcctcagcctcccaaagtgctgggattacaggtgtgcagcaccagacccggctaatatttgtatttttagtagagagggggtttcatcatgttggccagactggtctcaaactcctggcctcaagtgatccacccaccttagcctcccaaagtgctgggattacaggcgtgagccaccgtgcctgccccctacttcaaaattttgatgctattgtataacacatagcattgtttatttcagttttggattgtttattgctaagtaatagaaatacagtggatttttgtacattaatcttgtatcctgtaaccatgctgtgctcatatatcagtgctagtagcttttttggagattccatcaaattttctatgtagatgatcacgtcatctctgaataaaaacattttgtttcttctttttcaatttgtttgctttttatttctttttcttatcctattgcactagctagaacctccagtataatgttgactaggtggtgagagaggacatgccttgttcccagtcttagggggaaatcacttagtatgctgttcaccatcaagtatgctgttagttgtagattttttaagtagacgctttttatcaggttgagggtgatgctggcctcatataatgatttgggaacattttctcctcttcaattttctggaagggtttgtataaaactattattatttcttcattaaatgcttggtagaattgaccagtgaaacaatttgaggctggggctttctttatgagaaatttttgagctacaaatttaatttttttaacatatataggactagtcatgttatttatttcctcttgtgtgaaccttggtagtttgtgtctttcaaggaatttgttcatttcatataagttgtcaaatttattggcatagagttgtttataatattttcttataatccttttaatatttaagaattggtagggatattacctctctcattcctgattattgattaatttttgacttctttcttttttcctgataagcctggttagagatttattgatgttattgatcttttcaaagtgcagcttttggcttacagattttttcttctgtttttctgttttatatctcattgatttccactatgatctttattatttcttttctttagtttacttaagatttaattgctctcttcctaatttcttacggtaccagctgaagtcatttacttgagaagtttcttcttttctaatataggtatttggtgctataagttcctcctaagtactgcttttgtggcttctctcaaatatgttatgttttatttttcattcaacttagaatacttcctgttttcccctttgatttcttctctgaaccatgggttatttggaagtgtgttattgtgttcctaaatgtttgaggattttgtaaagctcttttggttattggtttctaatttaattccattatgttcaaagaacatactttgtatggcctgaaactttaaaaattctttgagacttgttttatggccctgaatatggccattttggtaaacatgttccatgtgcacatgtaaataacgtgtattctattgttgttaggtggagggttttataagcgtcagttaggtcaacttggctgattgtgtcgcttaaagcttctatggccttgtttttttgtttgtcccctctattcttttttcctctccccctctttttctgcatacttttgaattaattgaatattttaaataattccatttaatttatccttttcttatccacatagttgccaatgttgatgattttccttcctttgtgtagatttatatatctgttatccttttctttctgcttcaaggatcttctttaacatttgttgtatctcaggtgataaattattttagcttttgcatggctgaaaaagtcttatcttaccttcagtctcaaaatatattttcaaagatataatatacatctaagatatattcaaaagatataattcaaagttggcagtgtttttttcttttagtatttagagatattcttccattattttccggtatgcattatttatgacaggaagctttttgtcatgcttatctttgtttctcttcatgtaatgtccctagttgcttttaaaatttttctctttatcataggctttgagccatctgattgttctgtgccttagtacagttttatgtttcttgtgcttagggtttattgaggttcttggttctgtgagtttatagcttcataaaattttgaataattttgaccattatttcttcaagtactttttctgttcccctctcccacccagcttcctttattccctgggattccaattacacatatgttaggttatttgaagctcactgatgctctgagaaaagtatattggatgggtttaacagcagatagacattgtggaagaacatactggtaaacttgaaaacatataaatagaaatacccaacatgaaacagagagaaaaaagactaaaaaaatgaacccagctgacattttcactgcaactccatgagagactatgagtcagaatcacccagctatgctgcaccctaattcctgacccaaaaaagctttgaggcaatacatgtttgttaatcccagcactttggggggccaaggtgggcaaattgcttgagcctaggagttcaagaccagcctgggcaacatggtgaaacaccatctctacaacaaatacaaacattagccaggcatggtgatgcgcacctgtagtcccagctattgggggtggtggggggctgagattggaggattgcttgagccctggaggtcaaggctgcagtgagccatggtggcaccactgtactctggcctgggtggcagagcgagaacctgtctctaaataaataaataaataaataaataaatgtttgtggtgtaagctgctaagttttggtgtagtttgttgtggagccatagataactaatccatcctctttgaattttcctctaacttctccatgcgtaagtctttcctctttagcaactgagttataagaagagaatcatgaataccctattaactgtactttcttttaaaacttttcatgattattttttgtttttatactttttcttttttagagatagggtctcaccatgttgtccaggctggtcttgaactcctgggctcagggaatcttcccctaccttggcctcccaaagtgctgggattatagtcatgagacactgcgcccggactgttttatcgtatggcttccattcttgtagtctaggttgattatgatgatttcggcagtacacaatagaaaaccaattcaagtcggcttcaacatatggagtcacatattaagaaggttgcataggccgggcgcggtggctcacgcctgtaatcccagcactttgggaggttgagatgggcggatcacaaggtcaggagatcgagaccatcctggctaacatggtgaaaccccatctctactaaaaatacaaaaaattagccgggcatggtggcaggcccctgtagtcccagctactcaggaggctgaggcaggagaatggcgtgaatccgggaggcagagcttgcagtgagccaagatcgcgccactgcactccagcctgggggatggagggagactccgccttgaaaaaaaaagaaaaagaaaaagaaaagaaggttgcataataaaacaggctggaagactccagtgttggttgattccacaactcagtaaagttatctagcacctggcttatttttatctttctgctctgccatcctcattgagttctcttcaagctaactcccctcctggtcccgaggtagctgccataggttcaggcaacacatatagacccaatgacatccagaatcagaagccttttacagacttttcccttctcatttaattggccattgcttgcctgtgcctaaaccagacactgtggaggggaatgggactacaatggtagtcttaaaccagttatgattcaacccctgggactggagctgtggccttccttttccaagatacatggccacatgggcaataaagtacctaaacagatcttgggttcttttacaagaaagaaggggggcagtggctactgaggaggcaactgtgcctgtttccttctgtttgactctgtcttccagtgtggtcagatgtctgaccgtgtcaatgctttgattacatcctgcaatggcttctgattaataacttttgattaaatcccaagttcctaccatggcggtccaggtgtccatgacctgacttttatctacctctccagtcttatcttccactgctcccaccttgcacattcatactgcatcaacccaagatagtccatgtttcccacccatgccaggccacaccattaaccttcaaggctcagcccgggcattgtttcctccagaaggcttccaagaacttccaggtgatccaagtacctttctttgggtccccatagcaccctgtgcatccatccctttctcttagtcctctgtgatattgacatttctaagcaccacctgctgaataaaccttttctgaacagaactgcacccctgccaacctctctcctgaggctccaggcctacttgacatgtgtacttggtttgtcctacagtcacctgaatcgcaacatgcccaataagtgtcatatccttatctggccccgatcgtttcttccccatgcattccttatcttggagaatgtacttccgtcgagctgtcaagacaggaattgggaactaccctttccctctcttaacctcatatccattttgtcaccaagccctgtccctcttatcttcaaatgcctcccttatttctctcgtttctcttctcattgccttaattcaactcctgatcgtctccctgggtcactgcaactggctccaaactgatgtccttgtctctatcctatgctgtcctttctccactctgtggccagagtgtactttttaagaaggtcactctagtgtttaaatccttcgatgctctctatttccttatcaaagtacttttcttggttgtaagacccttccagtctggctcctatttaattctttagccatatctcttatcatgctctcacactcaggtgaactcaagccatatgggattatttccaatttctccaaagtaattccctaaagtattttttctctgcctgagtgcgaatctcctcacttctctctatcattgactcatgagtcctcgtccttcaggactcagcggtagctttactgctctgggaagctcccccattcccagctgctttcccaggttgatcccttgttgccgccaccatcactgctcctagctcgcagccaggttttaataggagtcagggtggtggggctctgacactaaacacacactcttggattacagccaagacagtgccagggaagagcagtgcaggggactcgtggagtaggtaacgggggcctgctctagcggaggagtcaggatggctttcccgaggaattgatgcttatatgaggactctagggatgaggaggagttggtggccagctgaagaagatggcaggagcgggtgttggtggttttccaggcagaggaacatcacaaggaaggctctgagtggtgggatacatggctctgagaaactggagggagttggtgtggctggcatgcagaagcagctgggagtagggaaggatgacacggggctgtgcaaggttcagggttggggtcagcccctgtggggtcatggagccacataaaggagcgacataaaggaggacttcgggttttatcctgagagctctgggaagccattatggggttttaagcagagaaccaatgtgatcagatttgctttttttttttttttttgacagagtctaactctgtcgcccaggctggagtgcagtggtataatctcggcttactgcaatctccacctcctgggttcaagccattctcctgcctcaaccaccccagtagctgggattaaaggtgcatgtcaccacgcctggctaatttttgtattttcagtagagacgaggttttaccatgttgatcaggctggtctctacctcctgacctcaaatgatccgcccaccttggcctcccaaagtgctgggattggaggcgtgaaccactgcgcctggccagatttgcattttcaaaagacttttctgttgccctgtggaagatggatttgagggctggaggggtgggagtgggaccagttaggaaggtgttgggttaagtctgaacagggaggtggagagagaaggaaagcgatgctgagagctaccttcaaggctgggtccacaggattgggtgccaaggacggctcccatcttctgggggatgctggggatctgcctgagctggggagacgctggaccaggagatgattttggaggcacagccgaatctatttggcacataagggtgaactcctcaaggatggacacacatattattcatctctaattctctggttgggcacagcagaagcccaagaagtgtttgtggaataaatgactggaaagccactcttgggcttgctggtctgtcttgttggccagcatgtagtgctgctcctcagatgacaaagtgaagtgtctattatgttgtttctaacttggtgggttatctgcccaaatagacgctctgaaggtgaccccagatgatagcagagagaggcacatgtgggcagcaagtgggtatgtgtgggcatgtgggaggggggcactgggagttgggggagcattgtccttagcatctcatcaccgttcattcacatttactgctcagctgggagcatgctctggctgcagggcggtgcttttagcccagaggctcagagcactttcctatcactaacatggaacattcccagaattccccagaggcctggggttccagacagtacaacatacagaaggctgaggctccagtcacactgctgaggtgtctgagcataacagtgcattcgtctgtccaagcatgcaccatttgttcattcactcgtcatgtgccaggcactgtgctgggcttggggaatccaagggcaacaagacaggcctgtcccagcctccttgagctcacatgctttatgcacatccagatacaggggtgccactgtcactagagccacctctggagtcagctagcaagatctggagcacattatcctcacttccatctcagctggttgagctgcagtacttgagagtctgtggatgatgatgttattgggagttttatctctaaccacatgtacctacttcctggaagttcagagcaatgatccttaaaatggccagaaactaaaactgaaaaccacccaactgcctaagaagagtgaatggctaagcaaattctagacatatgatgggggaggagcatgacattatctaataaaaacgtggggttatgttgatatgttaatgagatgggatttactgtcactatgagactgtctttaatgaaacaagaacataaaatatcaggtacacactaattacagcacaactgctctaaaacctatatacacacattgtcatctcaattgtataaggaaaacacaatgcatagcaaaagactgaaatatgccacatcttaacaatacctactttggtagaggaattttacgtgacctttctgcttctttattgttttctattttttcccaaacttttaataatcagcaagcatttaccgtgaaaattcagaaaagtaaatacattaagactctcctatgtttacacattggcataggtcagaaaagtatttccagggatgttagctgggcgtggtggtgcatgcctgtaatcccagctacttgggaggctgaggtgggagaatcgcttgaacccaggaggcagaggttgcagtgagccgagatcgtgccattgtgctccagcctgggcgacagagcaagagtccgtctcaaaaaaaaaaaaaaaaaaaaagaagcatttccagggatgtcagaagagcttggtgagcgctagattcagttgtttgtatttgtaatgaaccacacactgatcattgagagctgaactaggtagacactaagtgcgcctttgttctgaagtgctgggattcaacttaattccatacaagttgaacagcttacaatcctgtcagggaggcagacttatttatttactcaaccgtttattcaacgagtgtttatggagttcctcctttgttcctggcattgtcccagatgctggagaacataaacacataatcacaatgtgatgtgagaagggcctcagcagaggtcccgacagagtattaggggaatacagcatggctaaccctgtttgaggatgttggggatcagcgaaggcctcctaaagcaggatcatttgaacaaggccttgaggggtgaataagagttctctaggcaacaaatagagggaaatggagcctaagctactttgggaattatttttagagatgcctacatgtgctatgagggaagatagaatatgtggattgtttatagactgttgtcctcattccagccaggagaccagaatgaggagttgagttcaaaggtctgaactcacaaaattagaataactcatttgtgtcctggctgttttcttaccccatgtttaactaaacatcatgtgtgttcaaggcctctttgaataatgaccctctcaacgctggatcttgacccaagttcaggaactggaaacatctggatcctgctgggctagaaaaacatgtgtgacccctagatctctatcctcacacagaaagcaaggacagctttcagaaggggactcacaactggaaattctaacaggtaaatattagtatcattaagaaatcttgcaaaggtgattattagccatctcttgtctgtcgagttctgttgcttttctttcttctctccttttctcagtttttctctctcccctgtgtctttctcctcctttgccacatctgtctgcctctttccttctcgtctgtttttctattctctggtctcttgttctcgctctttgtctctttctgtctcttggagcatttctctgtctctcttgctttgctacctttctctctctgtctttctctttcttgtatctcttgctgaccttggggtcactcccttggttttctccatttaatggagccccaacttgcctttgatggcatttggggagggcaaagttagtcggactctctgaacttgattggcctcccgtgacaaggatctcttttcacagggtctggatttaaagtgtgaaaatataaagagctttttcattctgactcgcacatatccctacttgagctgaagcatttccagacagataatcatcaggtttcctacaggaaattaaagacctcagtaccgtgtagttgtttaaatcacccgtattgcccattaggtttcatgaaaggctttgcttccctggtatgtgatagaacaaatctttaataagatttttcccccaatttttctaatgaagtcggtcgtgtgtgtcctctagataagctcacaataaggccagcaggttcccattttggtatgagccggtgcctcaccccttcttatctaagccacaaggacacggagctggcacatgtcctcagagtccacactgggagctgccccggggacaagaacccctacaagtaggagcattcagacctctggctggattggcggatgtggccatgcagtgccttctgtccaggagccaatggcacccccacttctgccttaagccccccgtgtgcccacactcctctggttaccatctgcttcagaggaagtcaggccccagtctagccaagatggtactcctccttccttttcttggtggttggtttaggtctgagcatttaaccccccctttttcatttttattttttttgagactgagtcttgctctgtcacccaggctggagtgcagtggtgcgatctcagctcactgcaaactccgcctcctgggttcaagtggttctcctccctcagcctcccgagagtagctgggattacaggtgcccaccaccatacccagctaatttttgtatttttagtagagacggggtttcaacatgttggccatgctggtctcgaactcctgacctcaggcaatctgcccgccttggccttccaaaatgctgggattacaggcatgaggcaccatgccccagcctaacccattctttgaccagtgagatgcaaaggaaagtctagggacttctgggacaaatgttctcattattaaagagatccacagcagggggcttcccttcattgctgttgcacttgaaggttggcaatgggatgcctcagtgtgccctggctaccttgtgatcaacctgctgaggatggcagagcagaaagtcaggaagagccagtgctcatggtgacatgtgctgccaagttaatgaccccgggactgttctacctcttgagtttttagtgtgtgaaataacaaatttccttgtttttaaactctcttgaggtttttttttttttttgactggcaattgaaagcatattagtagacacagacaggaccacagaggtccaagatgggcccccatgtcttctgagagaggtctgagctcactgagagaagggtagggtggggacaagccttgggatcgaaggccctgccttggagcagtttgtcgttccatgctatgacaaaccatgggcaagaaaacctctctgagctgaagtttccttggctcaaaatgagtattgagtgcatcacagatgctcaataatcatcagctctcttctcttcaggtatgcttatcttccagttattattattattattttttgagacagagtctcactctgtcgcccaggctggagtgcagtggcatgatctcggctcactgcaaattccacctcacaggttcaagcagttctcctgcctcagcctcctgagtagctgggattacaggcgcctaccaccatgcccggctaatttttgtatttttagtagagatggggttttaccacgttggccaggctggtctggaagtcctgacctcaggtgatccacctgccttggcctcccaaagtgctgggattacaggcatgaaccgccacaacaggcctcttccagttacttttaatgggaccaagaggtgccaggtacggagagctatttaatgacatttcagtgctggggaaattttacacagagaccattctaagtcctttacccacagttgctccaagtacaaatcacgtctctaatgccagcaccagtgttgagggggaggcaaatacacccaattctcaattctccatggtgatgaagaatgtggataattgaaaacagcagataatccccgaacctgctttgagtcactgacttccaccgcctcccccatcatcacttttctggtgcagctgacaaaatgccacatgcacgcacgtttcttctctctcttctggtggatcacttggcaaagctgcttatccacttcaaaaccgccaagtctggggtgacaggagaagccagggggctgaacaccacctccccagccaagaacagcctggaagctataccactgggcttggccttggagtgggttctgtccatcccttaggttagtttgactttaatccctccaagctcttcaggaggtcaaagacaagaaggcgcaggatcctgcaggtgatagtgagcaccagagacactgggctcctgtcctcagatgggccctgcccaggccagccagggcgcagctaacttcacgtgagcccagagctccttcctacatgccacacattcctggaaaccagggtgcctccctctccctttcctgagcaatggctggactaaggttaattgtattcctcgaatttaaagcttttagagttctgatccaagaccccttctcggtccgtgaaaccccttcatatgagagggatgaaaagtgaggagagaaggaaatgaaccttcatcaggcacctgcctagcaccatgccaacctcttcacaactacacttcacagggagagcagatcttttcagctagaacttgtctaatctggagtaggagatactggctgcctgcttgtctctggcaatctgttcttctggacaatttctgccttggtaccagtactacacaaatcaacttcctgcagtctcagacccagggttcaggtctctcaggatttcttgctatcttgtcctttctctctacggccagaagctcgttcgatcagctgagatccttgggtctgaggacactggatgacccaaaacttctccattgggcaagggggagttgacagcttacttggccctagtcaggagatgcagaagtgtgcgccctgctgatcacagttaaagctcacactgctaggaactgcggtagtaagatgttaggggctgcgagggcgggctcccaccctttttccttttccttctctagccctcctggtgggctcagaagcttctataatggaagtagcaagaagtaagtaggaagccactggcctttcttactctctgaggctcacatgtgccagttcctggggctaccaggaggcttaatcactgggtttgccggaggagaagatagtgtgctaagaaaggaggattagcactcgccaggtctcccaggagttcctgtgttgggccacagggattgccacagcagcactctgtcataaaatcggccctgggaacacaatttcggaaataatcagaggaggcgaggtttcttaaattgtaggaaaaagctccctggttagaataatggcttctatttggcatccattctctctcagatgtgcagcctcatccattcccattctgaggcgtgactttcaaacaccagatgggaagagagccaagacgagggtgctgggccttggaatctgaaactcagttatttcatcctgggcaagtccctaggcctctctgggtcagtttttctttgtaaattgggatgataaaaactgcctcactgagagagacagtggtagattgaaggatttagagaagccttccatcctgccctccatctctccctttctctttatgtataaatatatatatatgtgtccacatggatatacacatatacgtgtgtgtaggtatctatatgtatgtgtatgtatgtgtgtctatatatacgtgtgtgtgtgtgtctatatctatcccaaggatctctgggatggaggtgggcttccctagttcattcacatttcctccagggttgatgcacgtggcaggggggattctctgctggtggtcagggtggagcaaatctaactttgtcctcctcatggctatgccccaatgtcaccaggcgttagggtctgcgtgagacaagcacagcctccagaaggcaaacccagtggccacagacatgtggggtgaattgcagggcctagcgcacttccctctgtgccctctctataaaggtttgtgtggccctgcgggctctggaggtgagaccaactttgctctgcccagtagcatgtgatctttggtttggatgctccacattggacctatgtctgtggctgtgtaaagtcttgtggccttggtgacttggtctgatgtgtaggtgggtaggtggggtgtcacatgaatagaggtgacaatgctctgatttcaaggtggggagcccaacagtgaaggaaaagttctggtctaatggtggggacagaacagcagtgacagtgtcctgatcccctggagaggctgctcatggaggtggtatgccctggtctcatggcagagaccctggtaaggagcatgctctgttttcatggtggggagactagcagtggtgataatgatctggtttcccagtcgggacaaacaagggggcctgtgtggcagtggggagccagggtgcttctgcctcaaggcagcagagtggccaggaatccagctcagaaaagtcctggacctgtggttctcaaattagagcaaaatggctgtcaaggtctttcctgcagtcactgcccatgtacacagctgtggcgcctctcctctccctccttttccactcagcatcccacctgagagacgctggccacagtgattaggtgtccgatttgatggggggcctgttaagacgctattgcttttctaattctggctaaatcgacattggttttgtcaatctacctacataggtcaagcttgttgcttccaatttcaggtgatttccatcttgtcactctctctttcccttctcagcccatctaatccttgggttctccagctgcccagtacttcctgtgcggcagcatcactgcctctgaggctcggcaattagagacttggactccagcagggagggcatcttcggattattactgcggagggagagcccgactgcggtgtccatagcaaccctccggctgccacctttcccaggagcgaagggaggcaaaacaagggcgggaggcaggagaggggcctggccttctgcaggattcctgtcagagggctgggcacccaggttgcagctcctgactgtgcctggtggctgtgctgaggggagagggggcttcttccctcgtttcacagcagcaaccgggagtggagctgtgttggtggatgccccatagcaaccgagagatgatggaccagttgaaggggaccatcgcggaggccgggctcgagtcccggctttgtgcctgactcacgaatgagtacaggcaagtcccctcccatctccggaggtcttctcttgctaatagggtggtgggcctggaggcgcctctggcatcctgtccagccctctcattcaaaggctttatggtgccctcacccgggacagacaacagatggtttcttcttccccaatggtgaaaaaacccaaggaagcctgggaaataagagcgacttttgcaaaatattcacagaagttgattctggcaccagatccagtccctgggcctccatggaaggaagcagaaagctgaggccggggttcagatgctgtctgggggctccctcgcatctcccaaggtgcctggagtgcgaagctatgtgcatacgccaccagcagaggccgccacactcctcacaaacccgccacaggttgctctgcccccatccccatgggtgagcactgaccagctcggaccgcaatctcagagccagggcggggcggggatctgctactggccacctggggtccagggaggggctggctcagggggctgtggcctcaactgccagccggccctgctcgtccctcactgccctccctgtgggagagacatccatccaggcccacgagacactggccgccttcttccctgctaggaatccatggctgctccggtctgggccctcccttgggctgctgctcaggtgcctgttctgcatttgggaaactgttagagtttttttttttttaaattattattatactttaagttttagggtacatgtgtacaacgtgcaggtttgttacatatgtatacatgtgccatgttggtgtgctgcacccattaattcgtcatttagcattaggtatatctcctaatggtatctctcccctctccccggaaactgttagagtttttattttctgtgagtcgtttgagactggggccaggaagctgatttattcagcaaatctgaattgagaacatgctctatgacaggccctgttttgggcactggggttatagcagtgaataaaatagacgcaaatcccaccctgtggagccaagtctccagtgggggtgggtgtcatcacctacaccacagtgtggggctgggcaggacacacgcacccaggatggcaagtgatggctctctctaccgagtcggccccatgcagacagtggacctacccagactctggggccgaggcttccatgctgagcccttgtcagtcaggggtctgcacagacccctctcttgtactggccagtgcacgtcggcagcacttcaccgtgtgcaaagtatgcacctccactggctccctgtgagcccggcaggcatcttggtgacagaatgttggcaacctgtgcccatttcccatgccttctttccagacacggtatcagcaccttccattcgacctttgactccctcaagtaaataaacgttcccatccggactgactcatctggttagaacaacaagttcctacaccaaagcctcagagaaggggtcaggagacacattttaaaatgtatctcagttttcacaagacaactgtgcaggaggtgtgaacgatcccagtttcacaggctcagaggggcgcaccttgctcgtcatggtccctggcaggaaaatggcaactcggaatcagatggaccgattcccagcccaagactgctctggtgcctggcctggcctggccactccactgtcttctctccatgttagggccatcctggcctctgcagagttttagaagcagaatcaccaacctttgtccagacagatctccatggagctgctcttttgaaaccttttcccactcctgttgttagagggggtttcatggaggacctgggtgggagtggtgggcaggagggatactttctctggaaagcaatgaagttcagtagcagaggctgagtggagaggttgtgacctctcagagcgcatagacctgtgtggctcatggcttggactctcccctcccactgtgaacaagagcaggccagttaaccttctctgaaatttgactcagtttcttcatctatagaatgggcatactaactttactccctggcgtgttggaaccatgaatgcccacagttggccctcagtaaatgctccaagtgtagggagtcaggccgtatgtcccctttaccttgacactcagatgatgcaaaagagctccagtttttctttagcaaagcagagtatggggaggagcctgtgtgaagctgaagactccttggcacccataggtggctgagagttgttggtgcgtggccaggggacaggtgacatgctgtagtcctaccttgctcctcagatcatggcttgcaggggcaggggttaggtgggcattcattataagaggcttcacccagggtctagacatccagggactctcaggaaagaagtgtggacagaaggcctacacttaccagttggcattcctggtggccagccgggcaagtaaggggcaagtaatgtgtcctgggtcaaagtgcccaaactctcagtcaggctaaactcactcaccctcttacctgcttatgtattcaacacacaatttgggtgcagcgtgaagtgcagtgttttgtgtgtgtgtgtgttttccaatttataccataagctcctgtcaccaaggagcttatggtgtcaattaaaatcagggaaattagccaggcgtggtggcgggcgcctgcaatcccagctgcccgggaggctgaggcatgagaatcgcttgaacctgggaggcggaggttgcagtgagccaagactgagatcgcgtcactgcactccagcctgggcaacagattctctctctctctctctgtatatatatatgataaaatcaggggagagaagacatatatctatagacaacaccagtacaaagcaagaggtgaacagtgtccccagagagatacaataaagtgccaagggaattcggaagagggagataatgtcaaattgagggaggagaggaggggaggtcagggaaagctctgggcaggggtggcacttgtgctgctccctaaattctcacaggacaggacacagagcaagaggtgggctggaagggctttccaggcagaatggatgggaaagagcacagacagacccaggttcaaatccatgcctaactggtgaccttgagcaaactactgaaacctttctaaactctagttcatgggagtaagagtggcaacgatgaggcaatagaacctccccagccagccttccagggctgccaagagttgcaaatgaaatattttacataaaagcagttggaaaactataaagtgctctgcaaacacaggatttgtttttattattggagcattaattaatccagtaatgaagctcctagataagaacacagtaatgactgaacccacatgggctaatgagctgttcagcctaaagctgtccaaccattcagagtctgagaaagggggtggttaatctttatgaccctatccttaccaggttaagggtatccctccaacaccactggcttttctagaaaacctgccattatctgtcatttgtgtctaaactccctccatccatccatccatcatccatacatccatacatccacccatctatcctcccattcatccgtccgttcatccatccatccatccacccacctatccacccatccacacgtccatctgtccatccatcctactatccatctgtctaataaatctttttttttttttgtgatggagtcttgctctgttgcctaggctggagtgcagtggtatggtcttggctcattgcaacctccgcctcctgggttcaagcaattctcctgcctcagcctcctgagtagctgggattacaggcgctcgccaccacgcccagctaatttttgtatgtttttttttagtagagacggggtttcaccatgttggccaggctggtcttgaactcttgaccttgtgatcggcctcccaaagtgctgggattacaggcgtgagccaccaggtccgaccaataaatctttaatgagtaattcatagccaggcaccgtgatcagtgttggggatactgaaaaaatttagagcccttttatgcaggtcacagcctgtgggaaagacagccatataaaccatgaaccactacttttcttaaacctattttcagttagttctaccttttggggataacaaggtctacagacaatagattatggaattttaaagctgagtgatcttagaaatcatcttttttatctcactattttacggatgaggaaattgtgtttatgatttgttgtgaaaagtactgtgactttcccttacttgccttcaaatgacctcatccaggtttcaagtttagtcagttcgattaatctttactaagcatctattgtaagcggctcttcggaagagctgcagtacagctgtgaagaagacatcatccctgccctcaaggaggtcatggtctatgggcaaaggacacatatggagataacagctgtgttgctccgtagaggccctgttagcacagggcactgaaaatacagaaggagctcctgatttgggtttggggagttcaggggaagcttctcagaaagaagacctttgagccatgtcttgaaaggcaaagagaaatgtgttagatggaaatctgggggaagggcatgccaggcagagggcatggagatgtgaaatagcatgacttacgggagagctacaataggtcggtgatgctggggcttaaggaggaaggtggtgaggaatgagcctggaaaggagggcagaaaccgagtgccagtacacttgatgtggagccagtatggccaaaggccacccctactttccttgtctgctcttcctgtctctctgaggtaagaagctcctccacacccccgtttgcagactaaagaggcctaatttgtcagcctgtcatcttagggcagcataaggagttgctccccattccttaaggtgtggcttaagtcccaccacctccaggaagccacccttgacaaccctctgccttcaatgaactctactgtctcgcccacactttgggatctgcattgctgttttttgtcaccccatgtaagtataacttgtctctacagtgagactttaagttcctgagggttgggtgtgtgagtcacatggtaatgtttaataaacaccagtaagaatgaatcctttaaatttgggtttcaggacatatggcgagggtttgtcaaaaggttggacaggcctgggtttgattccagctttatggctagttactaattagtaactctgggcaagttttaaaatctttttaatgcctcagttttttcatctataaaatgggtgatggcctcaactcacaggctgctgtgaagacatggttgtggctgggggccaagggaagcattgggggcttttcaacagtggggctttggacaggcagcaacagcgggaagacgcctgagtgcggtgcatctggagggcaacgtggaaaacctgacatgatcaggccctgtggttgagagctcccagctgattcactaacctgtcggtgcttgacagttacaaagtacttggccggtgctctcattggactaaggaaattgaaggcctgagaacataagcaactggtcacaaagtgggcgagtggcaaagcttgtgctggtgagaaggaaggcagagggtggagcgcacagcctgtatgtaatgatataggaggcagtaatatgctgataaatgttgaacagccaggaaagatttagcaagcggcttccaggaaaacataagctctaatttacagtgttagccgatttctgtggtgtaaatactctgatcatggctgatttcaagctgctaatgtgacatcactgtggagttaggaagagatgtgtatggatgatcagaaggtcatcttgcctgtggtcacacagccatccctgcagcagagaacggttccagcctgggcagtctgacacttgagcccaagctctaaacatgacattgtcctcctcctcctgttcatgacaggatagctgtaacaaggggcatgagctggctccgtggcatcagctgtcaagttccagcccatttccagataaccactgatctttggtgctggcatagttagggctctacccaagctatctttcatccttatccatgatggcaggacgtgctctgataggccccatttggatcccattggcacagccagaagaactggaggcaagaggctggccagaaaggttagctgaggcagaaggcagctcatgggggtagagtgagcataggaatacccaggcctggagcctgttctccaaaattgatttttcacagcccagaaaactgtatccaacactaaaaaaccaacacgaacagcacatttttgctactaacaacatattcatgataatttattagaggatcattaaacctaagtatgcgatctggagccttgaaccaagcaggtggctctgtctgcggatggaggagagggagggaaatcaagaatacagaagggaagggcagggaaggcagaggatgctgaaggggttgggggtgggttctagagggcttggtcatgggaaaacacatgagaccccaggcttgcatctgaggcctggtactgtgacttctagtgtgtgtgtgtgtgtgtgtgtgtgtgtgtgtgtgtgtgtgtgtgtgtgtgttggcaggggtaggggaaatgattatgtcattgatatcaagattattattttatatatatatatatttagagacagggtaacactctgtcgcccaggttgaagtgcagtggcgctatcacagctcactgcagcctcaaactcttgggctcaagcagtcctcctccctcagcctcctgggtagctggactacaggcactcgccaccatgtccagctaatttaaaaaattttgtagagtctgggtcttgctatgttgtccaggctggtctcgaactcctgacttcaatcaaccctcctgccttgggctcccaaagtgctgggattataggcatgagccaccatgcctggccagaatcaagattattgtgcaagagtaattgtcacgtatctggggtcgtggcttgtattacaagtaatatttagctctcaatcatcagggttaatgggggattggagaggtgagaactgatatacagaggggactctgggctcattttgggggggctctgtccctccctgatctggacacttgctgcttaccagtcaggaatgctgttttaggagcttcctatgtgtatatgtgtgcatgtgtgcatgcatgggctagtgtgtgcacacaaccatgtacacatgtgcacatatgtccacctgcttacatgttttctggatgtgtgtctgtgtatgtgtgcatggatctcctaccctttcctcttcccatcgagggagggagctggacagaggccaaagggtgatggggaatcaagagccagagaggaagaggcctgccttttaaaaccccaggtgttctggggaattccctcatggtgacttcctttctgattcctaaggctgctgtggttagaaatgaaaatgaattcagctctggtcccatcctttggaaccccctctgcacacagtgggggcttaataaatacttgatgatgatggttctgaacctgggaagccagcagctgttcctagttctgactctcagagccccatggggcaaatcaggcagggaatgaccatgggggaatcttcagtcttcctgccagatccccctgtgactacacacccagctgttagggaaggggctggagccatggtccacttcacacaccctgctttggagaggccagttcttcctcagcagcttctcttttgttttccccaactaacatttgaacaatatttattgaacaaccactttgtactgaatatcatagtggaaatgcatcctgggagaaagtatctgatctgtggggtcagactgactaagttcaaatcccagcatctttaattacaagcgggatgacatctgacaagttacatatctatgtttgagcgtttgagtgttttttccactttcctttctctccttcttctccttctccttcttcttcttcttcttccaattttcatctgtaaaaggagagtgatgacatcatttttgtggggttgatgtgagggttggaaataacagagaggaccctgaacacgaggcgtaggcactcagtcaatggtaggtgagtttatccaccgggtgttagaaggtgtggatcccccctgcttctgtgaccttgacgttgttactcaacacctctaagcatcaggctttgtaaatgagaccatactgcccacctccttgggtgtttggagactgtatccggataatatatgtgaaacaacctatcgtaaaccctggtggttaataaatgtttgccttcccctccgtctgccccctcatcagggtgcacacctcccctccttcggaggccctctgtccctcctccccatcgcccagcgtgagcgaacatcccttatcgccgtgggcttaagggttgtggccatacctgtcagaggaaagaggacagcggctcagctccggggtgggggagcaaaaactacagttcccagtcctcgctgcgccgccactggggccggagcccaggacgccaggcccctcctctggggaggagcctatgcggggggcggagctaggaggaggttggagagttaagccaagccaatgagaccagctgctaataagtgggcttggcttacaatgtaacagtggcaggaggaggcgagcgaagctattgagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggtaggggctgtggtttctctttataccttgaacaaaaggaatatgtaggtagcaagagagggattgagagagggggattgtgagagagagagattgagagagagagagagagagagagagagagagagagattgagagattgggagggagactgggagagagaggtggtggtggtggtgagaggcgcttgctcagttatattcaacactctaacttcccgtggttttccttcttgatcccgggagaattcattcctagcttcctctggggggtaggggacatccccacacactgtgtctaatttgcagactctctgttagggaggattcaataatcccttctgagaaatcgcttttcctcctggctcactcgtactaaagcataacccagcagcttaacgcaccaattaattacactccgccttcatgtgtttgccagttcctgcgacttccccttctttcctcccctccctgctccactccattttcctgaggataaaaaagaaataaatgtctgggtggggggtggggattccgtaccattgcccaagtcccttctctccctgtcttctccatctcttcccaagtttctgtttccctcctcttctcagagagtctcgggcaaaatagaaaaccatccatgacctgggtctcctgagggcatggggtaaaaatataggtggaggaaatcagtggtcctttccctcaggagagaggactcagaataaacctgctgctgcttcgtaaacatctcctgataaaaatggctacaggtgttacctgggcagagcagctgggcgccgccttggaatcagctgggggagcacctctccttgggacgggatgacagggcttcccaggcggtccccacaagcccgcgccccagctcagccccagttctcccctcccacctcaactcctccttgggataaataaagatgagtgtgtgtgtgagtgcgcgcccggatggagaacagcaggcactggctttagcggggagctggccccactgctccagcctctcagtccagccccaagacggaggagggggtttccctcccagagggagtggagatggaggaaggtgggtttctgccgatgctctgcttgccggggagctctcctgctgtgggctggaaggcttggagacctgggaatcggtggacaagtggctccacgatacccccacccccaatttgttggtgtgtgtgtgtgtatgtgcgtaatgtttgtacgtatgcatgcgcctgcttgttgcttgggtttttctatttatttgtcatttggggcagggggtggcttggtgggggggtggctgggcgggctggccatcgggtagctgggaggggttcagctgttggaggtttcaaatagagcttgtttcaggcagggcacagctgctgcgagactgtcacattccttattgaaatccagccgcaaaaacctaggaggtgctgatcggatttcccccattcccagcatctcactttaatcggtgatgggcagactttcccgccctggaaacgggtggggcagacctgtcagacgacctgaatagccaggaccaagacttccaggcagagggtcctccagcaacccggctgctctctcagtgggctgccccagcggagggcagcacctggaagccgccttagtcaaaatagctcaaggatgagcgtctcagcgagcagaagcgagtggggtttcccttggaagcgcagctcacttagtcattccctgtaatgagcctctgcgtctgcgggtccttctgctcgctgccttctcagaaccgcctctcctgctgggcgctccaggatatggggctggcagcctcgctaggactggcagctgccctggtcacagccctggctctctccagtcctcccttggagaccaggggccctcactggggaaaactgatgaaggcccaaatgcaaggggggtgtggggaaggggcaatcccagcaccttctctttcagtgacacccgtagtcagagttcttaaggaaacggctattcccagagacagtggctgtgcacagatcccagtgtgggatctatgcacatttgtcttaacgcgacgggagagtcaccactctgcaggatcaggccctcttccctgcctggggcaggtgccacccctgagggggagctcagggaaaggggctttcccagagatgcggaaggcagattttaggtgaatgaaaggggaggccacctgaggtgcttggctccccgcatttctgaatcacagaccctcatagcagcagtggcgtgcaccgagggggcagtagctgagaggtccttcttgcctcagcggccacttcctgtgtgccttggggctggtcttgagataagcagagctcatttaacttgctcactcattcacccatccctgcactgtccatccatgttttgagtcatttatgaaacaagtattttctgggtgtctcctatgtaccaggccttgtacacactgcagggccaagatagatatccctctctcctggaggcaaatgggaacatttcaaggaactgggccagagttggaatcccagctctgccactactatttgtgtgatcttggataagtcatggagctttagcgagcctgtttccccagctgtcgagtagggagaattaaattagagacgtgtaaggcacgtatctgcctgctcaacaaatgggacctattgtgattgttactgatgatgacaatgatgagaggaaaggagatatctttttcctgttatctaactctggctgtaaaattagttggagctttaacagattgggatctaagacttgtcaacggagtgagaagttgtatctgggagggaagaagtcctgagaagggactgggtctgactagagaccacctttaagcatggtttattcttggggggaggtgaatatctgtgtcccagtttcatggaggaagtggtctctactcctccatggtctgggttagtcacagcccaggagagctcagggacattcagtggaccctggggagggatgggtgacactcttttgctggagagctttgtgtgcctggttggccctgctgaccagtctggaggcaggcggatggacaaggcaacctcaggggtaccaggcagattaggtaattctgcccatccagtggcagctcccactcaaaggcccttgggaggtgacaaactttttttttccccaggtgattgaagattaactaaccttgtgcctgagctgctgctttctgaagttctctgcttttttttccgtggggttgtggccttgctgttcacctatgtttggcgggtggctgctgctggggaagtaacttgtcatgcaggcctgggtcttttgaaaaggagggtggcatgtgccctgagcatgttcagttaatgcaaatgggagccaatgtgagggggttgagcaaccgggacagaacatccccagctcctgcctcacaggcctgtaggtgctgatgatggaagtaagctctgctaggaggcatcagcctggagcagggaggtggggcttgattcctgggtgagctcagataagaggagagcttctcattattatgcctgggacatgagatcaaacggcagagatgcctgagatggccccagtgggctcctaaaggtaccaggtgacccttgaaccaaatgaggagtcctttttttttttttaataggcaggtttactctctgaagtcttagacattgtgacgaggcctggtctagagattctgttgagaatcttaatcacatcatctgtactgatcggtgccacctgggtagaccagcaaggacctggggagtccttcttagtgttctttattttcttttagagctggtttggggcacacccactccattgcattaaattacctgtatgctctcttccctgggttcagaaagaattagggaagggaaaggcctggctgccctcccctttccccaggctgtgacttcaccaccctgaccctgccatcatgttggtggctgagctggtacctctgtgtggctggcaaggcacccaggggccttgtttctcgggatctcaggcgttgggctgtgggatcttctcaggggaggctggagagtgctggtgtggcagcatggctcttcttttccaccaatctgtacaacctcaagccacttccccatgcccggccttgaaactggtctgcatctctcctcccaggcagaaccagtcctctgcccactcccccaccatgctcctgtctcgcctgccccactgatttcctgcccctctgctcctctctgtggcccctgcctggcctcgttgctggggtaacccaggtggcagagaggagttggtgtgaagatgcttatccaggctgccctgtctgctcccacagtgtcttcttttcccacttctagttactctttcttcagacaacctcatgggaggccgcttctccgtatgcccaggggagcctggtcgtctggccattcactctttaaacagaatggccaaggccaacttgtctgtctctttgcagacctcacagaggtccctgagtccatccccagcctctagaccaaatgattgagtagtatcactggaaccagttctgatcctctgctctccctggtcacggaagccttgtctgcagaagggcagagcagcagtgcaggcttggctagccaagtggctctgcaccttctgtttggacccaggtgctgctttgggataggttgttggctgtcacagtgtcctggtatttttgagaagatgcctctgggtactggtgcctgtgtttcaggccatggtggaaaagtaggagtaggatagaccctttccagccctttccatggaccctccctgtggggtgacctgcaggaccaggatgcagaaggcaggagactggctgagagcctgcgagcccactgccgagggccctaggcacacattttgtcttcacaggtcacactgagtgtgtcggcccacaggagggcaagcgtgaaaatggccttttgacagcgtgaaaatggccttctccgccacccgccccagggtggtggtgactttatttataatctttgtggacagtctgtaaatgagtcaaacatctgtaacccacagggggacagctaactttttatatatgcttctcctttgcgtgtcatcacactatttataactgtcctggggaaagacttcatcacacatccggacttcccttccccacaggcggcattacccaggtgctccgccaggggcatcctggctggggcacttatctcctgcacagcctaagtagaaaggcggctgatgcctcgtatttctcttattgtgcttttaggaagagggatttgtaaggccatggtcaaaagatctgctttaaaaaaatataaggtaaagaaagtcaaaatgaaaagaaatttgagtaacctctgtagagaatctggggcctggatggaaatgtaagatcagaatagagcgcttcagctctgttgcagttatttgtgaagcacatttgggggagaaaatgagtgtgtgcgggggttgtgaggggcggctgtatattgatgaaataccactttactcagctcagtgacaggcaggccagcacattcatttgtagttctttttcttctctttctttcaaaaccccaaaaggagagcaagaaagcaaggcacctattcctctttaaataatgagggtggggaattctgagactgtgcttttcccaggagctgtagggaggaaaattctagtgccttttcttcgggtgaggaaagtccggaggaggcgaatgggtttttaagtgccccctcccccgaccctgtcattccacccccaggagctcagctgggatctgagggaaaggaggggaggagcagctgggggcagggaccacgctactttctggtcacccagcacttcgctgggctggccgggatgttgctgagtgacaggagaggggaaggcaaggaccatttgctgagtgctgggctggctttacattacacccgggagtacaaggagcaggtcgtgctcaccgccccctgtgtagatgaagtcaccgggccacactgacactgccagcggtggtggcactgagataagaacccaagcccgtttagctcccaagttcatgccctttcccttgcctgctgctgcccatatccttaaaagagaaaaattgagtttatggcactgagacccgtgatgcaaaatgttggaacaggaggaactttaccacgagctgggcaggaagggcttgatggagggcgggagatgctggcgcaggtcctggagaagacagtgctggaggggtggccagggcaagtgtgggcaccccaggttggcctgggatcagggtgagattgtggactggcccaaggtcagttcttgatgcctcctctctggggtctggtgctgctgccctcagggtgataccgggcaggttgtgaggagggtaggtgtggagaatacagggaaaatgaaagcccttcctgcaaaagctccttccacagcccctagcacccccaccttccacccctggagggccagcaggacccctagacctgactggacatgtccatacataactctctcacccctcacctccaccttgctcttctcttaggctgcctttctcctccagcactggctgtgtggctgtttatcgggggacagtcacatgagctcagcatcttacatcttacaaggcattttcacccctgggtccctcatgaccctcacggtggctggcccagggctcatgatgaccaactatctcagggatgagaaaactcggctgcacaggggttcccagggttgagtgcctcactccaggtgcccatctcaggaaagagagggttctagaatgagagctcaggtctcagtacacttctgatttccctattccaaaccccaccacaaactt

SEQ ID NO: 36949 - DNA, 17966 bp, Homo sapiens
atcgccggttcagcgcagcccggagtcgcccaggcctgaactcctacccaggtccccggcccccgccccgggcccgcgaggacaccggaggccaccccccgggggtggggagcggagccgcgggccagctctgcgagcgccccgcgctggcctgtccggccccgcccccgccccgggccatggcccagcccttgtcccggcccctcgtcctatcccaatccccgccttggcccccagccccgccctcgccccgcttcccacatcggccccagcccctgcctgggtccccatccaggacccccttccagtctctgcccctggcctggcccccatcccggcctcggccctcgttccaccccctgtcacaaatcccagcccaggccctgtcccagccccattcccagtgtttgcttaaggccctggctcaaccccgtcccttgctgcagtccccatcacagcccttccttccatcccactccctgcccttgttcaagccccagtgtccagcccagcccaacccattatctcagcctttgccctcatctctgtgtttacccaagtctctccctctagtcccccctatctctcatactctgcccctctcccagcctagactcaagtctgggtttcagctgccgccagccctattgctgctgttgctgttctctgtccttggcccaggggctggtgagtgcagaagcagggaagattgaggcaggaatggggttccggcagggaggggtgggctggagagattcaggagaggtgggacctggggaactagatcattggggagcaagtgggagaaatagagagtagagaggtcttacacaacagggattggcagggtcaaaagagtggtaattaattgggtttgaggctcagcaggtggcttacagtttctagcacagagactccaagattttttctggtgtctgtcctgaccccactttgactcttgcttttccagggaaatgttgtgggctttgctcctgctcacaaagtttgatgggggagagacagtcccacaccagaagcccctagtgtagtgtgggaatatatagcccaaacctttgagatattgggcatgcattcaaacggcatgaagaagagttttaaagataatatgtagcaaatagatgaatatggattagttgccattataatgagttttcttcttgtaatgattcttgttccaaagaagattgatttgcctaggaataattcctgatacttttagagcagggctgaaactcggaggctattttacagatggggaaactgaggctcagggagggagcaatttgtccaaagtcagagagcttgtgaatggcagtgtgctggggctagaaaaaaggtttcctaattcctatttcatactagtgtgtttttttttatccactgcaatgtatacttaatagaaaaatagacccaagtggggaaaggctcaaagcataacctcccttctccccggtctgcccacaagggtgctttatccacaaactgttccttatttgccaggcgtcagccaagggccaccctccggtggggaagtgacttggacagaagagagagaggtccaattttttaatggttggaatgtgggaggaggagggggtgtcctggtctaggggatgtgccatgaagatggctccatcatggagtgactgtagtcttcatggcccaagtctgtagccacctctggtgggtgtcactctagataggatggagatgtgcctgatggagtctttggaaataacagccaacagaacagctggggggtggagaatgggtatcagtgagctctgggggcctggttcagtgtacaaacttaaggagacgaatgcacgtgaaaggtcacaacccctgcagagatgtctggtcacttatgtgtatgtgtgtaactgagggattgtggggaggctggcagcatgtgtacatgcttgtgtgttgttaagtgtagacacgtgcatgtgtgtggggtgcatgtgagccagtgtatcttctgagcgcctgtgttatggtatgaaggggaggggacatgttgtggcccatgtacattcctcttcagctctgcctcctcctcatatggacagatcactgaagctgtgaatggggctggagaccctttctcagcagttccaagggtgagggcagtgttgcatgcctcccataacgaatataagttatccatccatccccagccagtgcctttgaaggaaggagctgtggaggcactctgtgttgattactgctgctggcaaattggacactgggcagaggcagtagccagtcaggttttcagttttggtaaggggaagtttatgctgttgggccaagttcctagcttccatcctctgccatcatggcttcttcatgtgcccattgagcaagcattgggctggtgaggggagcagggtgaccgacagccacagagcatatacagctgaaagttgtggataaaaacactgttgcccagaagcaggttcaggtgctttggggagaattgtaatgaagttggaaaagagtaccaatacacccaaatggaggcagggctgcctttagtgctgttaataatgaatgccttggcaattttggaccaaagtacagggtgctctgtgacctaatggtggtgatgggttttgtctgaggagaggctggcagtgtcataggaccatcatggcacagggctgcacagtgcttattggttgcttcggtttcatttcaggaatggaagttatctcttgggtctagtggtcccactcctgatccttggatcttttccttgggcttagttgaggactcacacgtgccttgctattcaaaaaaaaatgggcttttattctacctagtgctattactagcagggccagcctcagcctatgtgtgtaggtgtaggggtgtgtgtgtgtgtgtgtgtgtgtgtgtgtgtatgtgtatgtgtgtatggggtgggtgatggtcggaattaccctagcttcatcatagaaatattggggaacctggaataagttcatctgaactcggtaagggccttactcatgcttcttctggacacagctctggtaggccctgttcaaaccgcaaaccaaagtttggagtgaatggggctgtggaccctttctcaagcatctgccctcagaacttcttccaagttcctcctagcattcccagctgctgctcactcctttatctcactggcctattctgtgacctctgtagcccctggccactgtggggatggcttagctagttccccagttccccaggccatactgtgatcctttgaattacaaggatctttgtgcttgtctgtccatgtttcccaaaggtcattaaactgcttttcaccactagccctcatctgagggtctgcaccgagggactgaccaacatttctcctaacggtagcaatggttgatcagatgacccatccctggtaccagctttgaggaggatcagcccttccctaaccccagcagaaggtgcgctagagttctgatttcttctaacaatagtatccaggctgttcacctcttagccttctgcctcctacttagcacagctagggttcctaggaaacccgtctcttccatcagtcggtcccatttccctttatccctctcggctgcatctctatcactctctgaatgctgcactggtagcctctctgggttcctaggcagtgctcagcttgcaaggtgacaggttttccttcctgacagttgagactgatcatgtggtctgaactggacagactagtccttgagtgtaaccgtggcctccaatggcccccacctatgtagggcagctctctggggtgactcctggggttgctctggttcagtgttcgtccttcagcagcctccccttccctttctttgttatttcaaaaacacctcatttttggagttaatctctcccatctccagagagggagatgattggactaggttagccctgagggtatttcctgcttggctgaaaatgcccctccagagtagtccttattccagccccgggtctgtcctgaagctgctgagttccccaccttctcacctgtcctggaggtgtcatcttgggcttcttttctggctggtccgaagtctccagagcagtcagattccctagaggtttactttgagagaccttgcctgccatttgggaccctcttcccctgtctgctactggttgcctccactgtgacagctattctagtcccttgcctggctagctgctgacacaacttctgctcaccttggctctgctcctgacaatcatgatcaggtatcttggcattttaatgagggatgaccacttcctccccacctcccaactcggcctgctctgaatattcccaaggggcttgaaatccactgggtcactaactcactgcctcactgggcttccctttgggggaacattcccccggcccccacctactagctgtgcattctgacctgggaggcctgatgactctcctttcctggggactctcatggtggcctgccagctcctgtccttgcttttgccacccaagcaggcccctggcagccgtaccacactttcccctcccctctcctgccctgagccagtatacaggcagcgcttgtgaggctgctgagggtttttactgctcctaaccacaggggaacagaaaggggaagaaaatcaacaaggaagttacacagttccatgctgactcccaagccccacaggtggagtttcagcctgctcagtggcttaagacgccatgccaaaatacacacacacacacacacacacacacacacacacacacaccttccacacatctgttttttttaggtttggtaagtggagaaaatggctcctaagtgaggaggcagctgtgaagtcaaagggtcttagttttggatttagagagagctaggtttgcatcctcagtttggtctaggtttgagcctcagtttccttatctgtaaaaggagggtttttttgtttttgtttttgtttttttttaaataagattaacgtaaggattaaaccagatgatggctaggtttcagatctgcagcctgaaacccagttcctggctcagaggagagcatttgtggagttgatgctattggtgaggaagactggcatgcctgttgcttaatggaaatgccctctgtcctgccctgctcctttctctctctcctgcttcccaggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtgagtgtctgagttaatttcccaaccccacttccaatccctgaccactttccagactaaagtgtgactttaactgacctcccgaccctgaccccaacccgcgtccagattgaagtgtgactgagtgagggccatgacctctgtcacatgaccacttccggactactgtatgactgtgcaagtgcttgagctgatctctcacctgtggcccctgacctggaaccactttgttgaatgtgtcagtatagggaatctatttgttttatcggtgaagagtgacagttcttttctttctttctttcatttcctgcctcccaccccattgtctgctttcctcctctcctaattctggtcccccaggtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaaggtgggttgatgttgcccaggctcgggggtccagaactgcccttccatctctgctgaattccccccacaggctctctggcacaccagccttgtgtcagggtgggcagcagcacaagggtggctggggcggggcatggctaaaggccagcaggtcacccagtgggtcagaggccatgatctggaggaggcaacttggcagccccaggaggacatgctgggtccaggtaagctgaagggaaagttgagaatctggagtcagaggctctggcacaggggagtagtgccgcctcctagtggaaggcacaaatgttaatcaaggtgaacagaagccagctatgggctggtccaatctgctgcacacacccaggactggttttattttacatcttgattgacaatagccctgaagactctcttaggccacggcccagtatttagtccatctgggagaatgtattcctcttgcatcataatttcagacagcttcctacacctttcagaagaccacaagagaagctctttcctgctaaaaggaggctttgggcagctagtgtccatcctggcctttgcctcacttttctccaaatatcagccaccccaagcacttatttcacagaggttgttaaagactgaagggcaggttcaaaggtcagatgtctctctggtttggagtggaaggaaatgctgcaatgttttcctgccactctcatggattaggccagacaggtctcctattcctgttcactggaggagaagcagggggtgtgctgagctggctgttgtcagagtgggatggccacgtgcatggggcctgtggtgagggtgaagaaacgagcaagaacagagtgaggatttaaagaagaggactcttagcactcagaaatggggtgaatagtgcctttgaatgagctgagactcacataaggacaagggtgctggcactgctattgtcagagatgggaagtagggctgaggtagtgtctctaggcctcagtgacagggccgtttttcctgagagtgatgtggatgtgcaagagaactccctatcaaggcctgtgagcctgctgaaggacagcatgttgggagctagcttggaaagggccctaggttctaggtaggccttgactctcatcagaactgagggttcttctgttagaaggaatgccttcgtaggtctttggcaaaatcccaacagggatgttctttatcccaactctgatccttgacccactttgtaagaactgacagggaaaatcctcctgaagcctggctctagttatccaaaaacctttctaggtgagcaggaacctagggcctaggcctgggctgggattgtgggagctgaggcccagttagaagtggtcaggattgcttatggctaccagattgggacaatggggaatagagatagtagtgcagagaaaagctgctcagaccctaaagggtgattcaagtgcccagaccaagggggagctgggcagtgaggaaataactaggtctgacatgtgcatttgcatctagacatgggaagcggggcctggggaacttggtaccaaactggaaccctggtcagagcttccccaggtgtgtggtgaggctagacagaagaggaccatcccaccgtgcccacgagtggcagtgggtctggacgccgtgagagatgtagtgcttccatcagccctgtttgagaggttgatggggcaaggatcttgggtctggtccttctaagaattagattaacttctgtagtcttatatggtcctcaaagggttcttcagctctccagatcctggttaatttccaggattccagcctgtgggttaattgtctagagcattcctccatcttctcaacttgtttccttcccctactatggcatgcttcctgtaaggcttgaacacaggaatttatgtgggtttagggttatcctttggtgggaactgaagagtcccagcgataagaaggcagtgtgtttctagggtccttctcagctttggggatgagctcagatctccctttagccttagtcctttagtacctgctttgtgccaggccttgggttgtgtgctggggacacagagaaaaataagatgcatgtcggatataggaaatgttttaggaggataaaggggagatggctaactcagcttgctagcgtggtggaggtggtattggaaactgttaagcggtgaggtctgaggttgagaaggcagggaagggcattccaggtggtgggagtagcatggcccaaagtttagaaggaactgaagtggctcagtgtgggctggtgttggggtggtgaggaaggtagagggttgagcagaggccagatcacgaagggccttgacatttgaactgtatcctgagcgtgatagggagccctgaaaggttgtaaaaaagaagtgacttacctggtccgggccaccctcgtgaactctagtcccacacttctgccagaccctgtgtctgtgttatttactacgtattcctagcctccagtgcagagtctggcacatgatgccttttcacgtcctttccttgtccctttcttcctatcagccactctgtcttgtccccggcctccatctccttgcctttcctgttttggatcgtgtgttcattctaaggtgcccagttgccagtctgctctggggggctggcctttgggttgtggataccatttggcacccaaatggctcatgaggggaaagtactcccaaatgtctagagtgcaggttctcatccttcctcttcctgtgtctaagatttgaaaaagtaggtaaaataatgaaagcaactacgaggaaagtgaagaagtcgactgtacaggagaaaggattctgttgaatccaccgactaggaccacacgtgactcaatatctcagctgaggtggttagaatctgctaatagtgcagctgcttttcctcctcctacattagtttatttattttttgaataggcaatccatgcacctggtacaacattcaaaaggtacaaaagatatacagtggaaagtaagttttcctcttccattcttccagtctccaattccccgccccagagttaactagtaactagctgttaactagtcccctatattactcttttctttttgaaacaccttcccttcttggcctctgtgactttacagaactgtcctggttttcccactgcccactcctctgtctcctttcctggcctctcctctgcttgatctccaggttgtagtggcccaatgcttggtcctcgaacaattcctttttcacttttctattctcttgcttggtgttccagcacaataatttaaaataccatctatatgttaatgcttccacgagtattcagccagtcctaatttctttgaatctcagactatatcccactgcttacttgacatctccaactggatgtctaagaaatgtctcatacagtatttagtaaaatcaaatcaaagtgaagctaaaagtataaaactctttaatttccatttcactgctcccagtccatgcttctttctctagtcattgtgatcttcctcaggaaattgtactgtcatccacccattgctcaagccccaaattaaatgccccaaatccttgatttttcttgtctccttattcctcacaagcaatcgtaaagaaaaagtcttgttgacgctacttctgaggcatgccctgaaggcttctccagctcttcatttccacttctagcacagcttctctgctttctccagggctaccacagtagcctcataagtggtcttcctgctttcacccttgccccctgaaatctgtccagcactcgtttgcttctacactgattggtgctttctgcctctgggcatgggctcagctgtgcacttgctattcccgcagagaaggctaagtgtctttgggcatcttcagtctgcaagccccacccagagcctggcactggccagcccactcaggcctttctgaagaaacccagcccatacatacgaggacattgtaggaatctatctaccatgccttagactccaggatctttcagcctgtagcccatccacatctcacttttgcctctcctagtttcttgagcttccttgcctgtgccctgggcctccccgactgctgatgttcttctggcctcttggctcagctgggactctctcacctggtgtctgccctggcagctcttgaggacctgacttccggtgctctttctctggtcccatcactgggtgacggttccctgcatcttccctggtctccactgactaaacactccctctgcatgaagaggggggactggctgtgcacgttacacagttgaaggaaggagcacgtcttaaccaaacaggtcatgtccactgatctttcattgaatcaaacgcaagtaaaactccaaaacgtggagcaaagtgttccttccctggactgtctagcaaggaaatgggccaccactggagcatgagcccccacccttgggactcattcactacaagattattgtggtggtgattcttgccataggaggtggggtcagtgcagtgacttatgagagtcttttggttcttcgggtttgacaccaaacctgagcatctaggttggttcaggagctctctgaagggaccccctttttgacacccattctttaacagctattttagcacctagtgtgtgccaggtggtgtgctagacactggggatgcaaaaggcacagaccttccagccttttggagctttgctggaagtcagtgccttggctggcttgttctgagccatggaactcagtgggatgtcagggcctggaacttttgtcccagaacagagtttgaaggtatgtcctaattaggagcccccacctccccttaactgtgaggtctgtagggctcatatagctgcacgtgctgcagaagaggaactgcgacaaatgggactgagcttactggagagtgatgaggctctgcgagccatggggtgtcaacagagaaggagctggggattttctccagaagagaagctgggggagacgtggttgatctcctttagcagcagaagaaacacagtctgaggctgagggaccagacggatcagtgggtcccttgaaggcagagttggggcaggggcatcaaagatgacaggatttggctttagcaaggtcagcgcttcccccaggtgggatgatccatttactgattgattaattcagcaaacattcatctgtgaggtatgcactctatgtgaggccctgtgtctggaggaacaaacatcaaataggacagggttcctgttctcaagctgcttatagtctggaggttgcctgggaagtaatgagtggccctgcactcattacctgtgtagggccgctcattacctgggtgtaatgagtgtgaaagcagaggctggacaagcacgtgggagcggggcagggtgaggactaaaggaaattaaaggttgagattggtggcggggagagtgagggggctggattggaggccttgaaagagctttccactccaccccactttgcctaaaagagccagtgttctaagttcctgagcctgctcagggaatgggctggttggagatcacagtgctgctgggctggcccagaatgctcagggggaggggttagattgggagaaggggcaagccaggcctgattgtcaggagggcctgggtttgaatcccaaaacctcagccagtgctgaggatcccagcagaccttgcagactgaggtgggacagagatgaccagaaatgactgctcaggcaggaaggacctggaatttagagagacctgggttagaggcctgggagtggtggccggggcgggggtttctccccagcccgcccagcaggttctgtttgccttggtttagtcacacccctgctgtctctccctctcctgccacccctgcttttgtcccagggtctccaggatgagtgtcagtacctccttcagccgcagctgattgtccggcgtttgctggacgtcgctgtgctggttcctggccggccctcagagcaaaccctctccccacacaatcgctcagccctgtacaagtaagtcaaagactccccacacctggtcctttccctcttctgtggcctcatacaggctgcagggttctctcttggcttctccacctacctgcctggtccctgggtgggatccctgcctccctccctcccagcacagagcgggagacctgaacaggcctccttcccaccctatgccccctccttcctagtgcttcccttgccctgtgttcctctcgcctctgtttgtgccttcttacccccaacctctcctctgcccagggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaaggtcagaacccctgcatttgccccagtctgtgtagacatctgtggttgggaagtgacttgggtggctgtgttcagtggccctctgccatatccctacaacctcccctccccatcccaagctccttcatgctccctgaagccatcacacttggagctccaagttattggaaggcctttagataattttttttttgcatctgacttgagacaactaaaggacctcattactttctttgatttaatctctcagtttcctggggtaggcagggacatccaggacctctgggacactgtccttgccaaagcccttgcaagtcagtgagacagcctctcatacttagtatctgtttcaatagtgtcttcaatgcctttagggagggatagatgacctcagttccctccagtgtggtattgcattagctgtcaccattaggaaacccctataaacctggatgccccacactcccaagggacatcgcattctagttctcatccttccccactctttgcgaaatcctgtctagctcagatgtgtttatgagtaagttcaggactgtaaaggctgcaggcccaagctctggtttcctctgccccacagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcggtactctttatggagagtggggaggttgctctgccagggagcttgaaggggaaggtgtcaggggtgttggggtgtttacctcctccaggaagcctgtccaggttgctcccacccatcctgacaattagggaccatggctcagcccaattctggtcaacaaacatgtcctgagtattcactctgctacagatgggcgggtcaaccaggtcaactcagtgtctggggtttcccagttttgtaggctcacttcctgctcattactggcctttcactacggtagttgttaaccttttcttgcaaatctcctttgatggggagtttaccacctcttgaggccacacagttcatgtttggatagcgctgattgccaaaggcattcctgacatcccatcaaaatctgtctccatgaattttttacccactcatctttgattcagtgggtaaaagccatatccagaagccatttccagtaaatctatctctgtcctgttcttttttaaagcaacagacttaattttttttagagcagttttaggttgagcagaaagcacaaagttctcatatacccactctctcacgttttcccctattattaatatcttacattagtatgatatatttattacatcccagtcctatttttacagcccttcagatgttacctgcaaccacccaaaagctgaagaacctcagtgtcttaggggtcttggtatttggatctctccccttccttcactatctcacctggtcatacttctagtggtcactgtgtctctgaaataagtgatctgaggtggtcggaccggggtaccaggtaacaagacttgcatttgtgctgcctgagattgagttgcctttttcagcagctgcattacactgtgggatcacctagggcttgtggtgaactgagatccctgggtcttttccctttacttcctttgtattttcttcaaaccagttgtatacatttacttttttattataagagtaataggatcacataaaaactttggaaaataggggaaaatatctccctaatgcaactgtttaaccctttttttttgagacggagtctcactctgttgcccaggctggagtgtaggggtgtgatctcggctcactgcaacctccacttcgcaggttcaagtgattcttgtgcctcagcctccagagtagctgggattacaggagtgcaccaccacacccagctaattttttgtatttttagtagagactgggtttcaccatgttgcccaggctggtctcaaactcctggactcaactgatccgcctgcctcggccgcccaacatgttgggtttacaagtgtgagccactgtgcctggcccacagctgtttttggtttatgtcctcccatgtcttttccacattaattactttgtttatctagttgtaatcaaggggcatatacattttggtgccaattcgcatcttgcatttttgcagtgaatttttgaacctgaatggaagaatttatgtccctccttgaggtattgcctaatactggtttggaactcgggccttctccactttgtgtaattcacacacttgcaaagccaactttttgtacttcttagtcattactgtcagcgttaagactgagatgagggcggagccctatgttggcccattagagaatatcttcagcttagctgttccctgagccagggatccttttaactctactatcctccagccctgagagcagggaccgctttcccatcagccaacctgaggcctggtctgtggcttcatgtggtcttttatgggacacggcttagaactttctagtcgtcctgttagagccatttattcaacctgaagatatttcttatttacataatcaaattctctctttgttctagctaagactgtatgtattttgtgtttgcttattgccatgcctctgggcaatgacagtgagatcttgattcgaccttgaaaccgtagaccctgaattagaggacagccttacgcatacttgttctttcttcctcagtaccctgagaatagaagcctagccctcctgcagcccctcaccctttccctctctgcattcccatccattcactttaatgagcatctgtttacattccatccatctgcattctatgacgcgtgctaagcacctcagcctgttctgtttattctgaaaggtatttcctccaaatattttgatttttttttctccccttggatcaagaactggacatttggatcagagaactgcatatacttttttctttggctccctcctagaaagactttcactgagtaatactttggcatattgccccgggcttgcattgaaggaagttatataaggaagttgtatgaaactcactcttgtggctgaggacaggatgcatgacaacacacagtgccgctttgatgagaatttatctcagaacttcccctttggatgctgtgattctccagagactctgattagcttttatattatgtagttgcaaatctggtaactcatgatacttcctttgctttggttgcttggaaggcagtatcaaatatatggcctaccttagggacagactttattttcctgtcctgatttttaagtttccctcaggcatttattatattctattttatgtaagctgcctcaaatccttcttgaatgaggtgagcttatggcatcctgttgcctttattcttgtagacaacaccttacatttactcttgcagatatctggtttcttttaatcccagccaggttgctacatttaatctcttgggcattctgttaccactgttcagtacctaggatcatttcacctgagttggagtgagtgtcttcatgctccacctgtcttggggtccaggtgaagatgatgggaaaccttacaattgcctttgtccacaattagtttctataactggcaacagccctccttctccttaatgagctagataggactgaaaaagagggtgttctctcttgcttggacagaattgaaacacttctgcccaaagaacagattcaaaattgggccttgccgtctcatcagtccttgaaagatttctgctgtggaggatctgttgtttttcagtttttctgttctgagaatggaggtgagagagcagctttggcgtggagagcgccgggaggaatgggctgtccttggaaggtgtgggttaacaggggtgggagtctgagggtggcggtgggtggagatggaggatgtggcggcctcacttccatacctgccctccccagagctccgtgcgccaggaaaacgtgacggtgtttggatgcttgactcacgaggtgcccttgagcctgggggatgcagcagtgacctgttccaaaggtgaggtgaggaatgggggaggagaggaagctgcagtgtgggggtggtggtggcgggcagaggtgaaggtggggagggatggaatggaggaatgataggctagggttccgggaagtgggagcaggtgggtgagggttcttgggttctgacccctcctccctctcactgactccttccttctcccttcagagtccctggccggcttcctcctctctgtcagtgccaccaccagggttgccaggctgcgaatcccattcccgcagacggggacctggttcctggccctccgctccctgtgcggggtggggcctcggtgagcggtgcggggcggggccagggctgggaccgggacttggcgggggtggcccggggccccaggtgactgcgagtttgtgcgcaggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccggtgagcaggctggcgagggagcgggctgcggtggactggaggtggacctgctgggcctgtgggcaggcggcgggagtaggggagtgcgcagcctgaattggggacgggtttggcagagccggggtgagaccaccctccacaagctgtggcgtaggcccatagctgccgtctgttctcttccattctgtgccttccccacccgcagggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcc

SEQ ID NO: 36950 - DNA, 303956 bp, Homo sapiens
gccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggaggtggggctccctccacccggtccccaggcctctccctctgcccgagcttcccggtcctgcctccttcgcctcgccctgccctgcccgactctgaaccctgctcctcttctaactaaaagtcagtgttttatttcctccgcagtccaatgcccgcgttttaccttattcaataagaagggcttcatttatggcaagacaggacagccaggtaataagggcctctgcacacgcgggcccattggaggggccggaactgcgaagctcttcccggaagagcttcctggagagaaggggaacgagccagcgtttattgagcatctattatactaagcatctgcttggcagttcacgacggtcgcattttttcatccttacagcgatccctattgtgtcgccttgctttaaagccttacagctcacaaagggctgggatttattccagatctctctctcagatgccatctcacttccaggtgtctctgctgctttgcaacgcgggaaacccacgcaaaggagtgatttccaaggccttctgtttggaatatctttaatcctccccttattaactggaaaaactcccacgcatccttcagggctcagctcaaatgtcctttatctctgcagtgaaactttcccaaggaaaattagttacacagctaattttagataaattgagccagttgatagaatttgtcatgtttagactccttctgtgtttgagttctctccccgacccccaaccaaattgtaggacgttgtctttatgagcctggcattcagtaggctttaaaattaatatctttctgggttgcagtgattccaagcataccatcgttctgtccaccaaaccagaaacaagaagtaatcacacatcttcctaatatgcccagataggcttaattattgttcccaatggagaaaatttacagttaaacatcaggtttcccttagggtgatcatgatcatctatctttctttctttctttccttccttccttctttttttttttttttttttttgacagtctcactctgtcacccaggctggagtgcaatggcacaatcttggctcactggaacctccgcctcctgggttcaagagattctcctgcctcagcctccctagtggctgggattacaggcgtgcgccaccacgcctggctaatttctgtatttttagtagagacagggtttcaccatgttggccaggctggtctcgaacttctgacctcaggtgatccgcacgtcttagcctcccaaagtgctgggattacaggcatgagccacagcaccagccaatcttttttttttttttttttttttaaagacagcatctcgctccattgcccaggctggagtgcagtggtgtgatctcgggtcgctgcaacctccgcctcctggattcaagcaattcttctgcctcagcctcccaagtggctgggattacaggggcccaccaccatgcctggcaaatttttttgtatttttagtagagatggggtttcaccacgttggtcaggctggtattgaactcctgagctaggtgacccacccaccttggcctcccaaagtgctgggattacaggcatgagccaccgctcccagctgatcatctttagaatagttatgctgaagtctttttctgaactttctttgagagggagtcttgctctgttgcccaggtgggagtgcagtggtgcactctcggctcactgcagcctctgcctcccgggttcaagcaagtctcctccctcagcctcccgggtagctgggattataggcccacattaccacgccaagctaagttttgtatttttagtagagagggggttttgccgttttcttcaggctggtctcaaactcctggactcaagcgatccgctccctcggccttccaaaatgctgggattacaggcgtgagccaccgtgcccaggccttttctgaacttttaattgcttccaccaaccctccaaaaaattatgatttgagtgagttctgaatctgtacattaaaatgaactttaaatatatcatgtgtatttttataaacaaaagtgtaatatggaaaaatatcatgactcgtgactaacagtgtagagttttaaaaaacttactatgagaagcaaaaaggacttcagacgagcgttctaaatgttatatattgatttttaaaatagtgaaatccaacaagaactaattcgtgtcttcagcacaaaatggtaggagtatatttcttaatttaattttgctatataatgtagttatacattattttatttcatcacagacaaaatatatgtagagttacatcaaaatagtccagtccttatctgtatggattttaagctttctaaaaaagaaatagtggaccccacctacttatggattgggcctaatgaaaagacgttaacaggtaaatttgattttaatatgtacttttttaatgatgtgaacatatttttagaaaatcactgttacttattggaaagaacaaattgaaatttaattttaatggcagtttctcttgctccctacttagaaaaatcatgttatattttggccacttccttattttctccttatgcaaaaactgaagcagtaatttttgtgccctgcttctcagagctgtattaattcaaaggtctttataaaacctaaaatttatcattgtagtaccagtaataggagatgaaataactaatatataatttttcatcatgttagagtgccttggaacataagtattattaattagtttcttgtctgaagaaattgtatagtagtacagagcagtgcaatctctttttctgaattactgggatgaaccaattgaaactagatgccaagaaacaaagaaaaccaaaatatatttcaaaagtgtacttatctcatgtagtcttccacagagtaatatgacagaattaagattttgtgggatccttaaagttgagatagttcattaatttttaaaatttttgtatctatttgtaactccaagtgtactaaataatgcttgatatgttatatgttaaataagtaatttactattctgtttaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttggtaagaatttaggcacattttaacttatacatttagtttggatcgtaattaagtgtatggtttcttcatttaatgaaaatgagtctgtaataggtgactgtcaccaattatgacttacaaaatattttgggatgtatttgactaagcaaactcttaagttgacatcaagatagtttatcctaaataatcttctttcagctccctacttgcctctatctagatatgtaagcgcatctactttatcacaatttagcaggtaatttaaaaactgatctttaattctataaaagcaagttaatgatcctttcactgggttgtgctgacagcaatgacaatttctgtgaattaaggccctccccaaaaagtctttctttttcttgatactgttatctgtatagccaacccacagaagccatttctcttgttgtaccaagtagataatgtatcagatgaaaataacatttttcattaaagttaatagttttatgtatttttgtgaggactaactgataaaacgttatgtttctatgctgactgcaagattgatgggatttagtattacatagtatttgaaaattgtttggtagaggaaattaatgctaggtacgattgttttcactctcatctttcttttttttttaaagcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaaggtaaaatttttaaaatttctttaattttgaatttagtcctgaaccataatagattacaaaattaccatattaatataagatattttaaaagtaataggtcttacatgtttgttaagcactaaagtatgtagttgaccttagcctgtttatggttttaaaacttaacacactaattaattactttcaaatatgacatattgttgcttcttaaaaatcaatattttattaatacagcctttatgcagctaatatttcacttataacttcttacagaattttaaattgtatttttgaaaacttagtaaaagtgaataatcaaaccaaatttatttctattcattttaaagccttgtagttacttacattagcccccagatgcagtgaaaccatcaagtataaattattcaaattgtgcaccttgttttattactaggattagatagctggactaaacatgtgcctgcatgcacatggaattcagcacttggacctttattgaaatgtttggaacttttcagaatccctttgtgagtctatcattttttttctcttcagttaatccttttgcgccggggtggaaaggtgcttgcaatggatctgttgactgtgaagataccactaatcataatatcctccaggtgagaatttcatggtaaggaagaagtatttgtctttttctttttttagagacagggtgtcacccaggctggagtgcagtggtgcgaccatagctcactgcagcctcaaactcctgggctcaagtgatcttcctccctcagccaaggaggaagtatttgaaaatcaataaagctatttaaaacatttttgtaaatacttcgttatattgaaacgtttctttaaaaacctatttctccatcttgtgaatatttatcaataataaaatcatttctaaggaggaaaaattattttttaaaaaacgaatataaagtattaataatattgattttttaagtattattgatttttggtttcagttttttaaactgagattatgagattcttagttatttcaagatgtgatttttttttctttctcaaaagagagctggagtatcaagatgtgttattttggagtagcacatctgtaatattagatagttcccaaggttagtattatgtattttatctatgacagaaggatagatccctggtctttgttccccaaatgatgattaaatagtggcttaaagaacaacttcacaaacatgtcaccctacgttaagccaatggtgcttccaaaattatatctatattggtcatactagttgctctcccctctaccatcctcagaggcaaaggacatagtcttaaaaatcccttcactctctggtctagttcctgagctcatgtccttaattgttattgtgcatggcttatgagaagcacttagttaaaattagttattattaaattctgtgctcaaaaacccaaaatttacatcatcggtttataatgctgattaaagaaaagtctttttttttttttttttttttgagacggagtcttgctctgttgcccaggctggagtgcagtggtggccatctcagctcactgcaacctccacctcccaggttcaagcaattctcctgcctcagcctcccaagtaactgggactaaaggtgcacaccaccacacccacacccggctaattttttgtgtttttatcagagacggggtttcaccatgttggctaggttggtctcaaactcctgacctcaagtcatctgcacatatctgcctcccaaagtgctgggatcacaggtgtgagccaccacgcccagccaagaaaagtcttgctttccattttgcttggctctttttctttgatgatcatggaaattagatataatgaacgcccaattatctacatatgggatagacattgcaaataattcaaaacaagttttttaatcttattttttcttttcattttattttgttttgtttttgagatggagtctcattctgtcacccaggctgctgtgcaatctcagctcactgcaacctctgcctctggattcaagtgattcttgtgcctcagcttcccgagtagctgggattacaggtgcctgccactacccctggctaagttttgtattttttattagagacgaggtttcaccatgttggccaggctagtctcgaactcgtggcctcaagtgatccgcccacctctgcctcccaaagtgctgggatcacaggcgtgagccaccacgcccagcctaatcttaattttaatttttatttatttattttttctgagacggggtctcgctctgtcgccaggctggagtgcagtggcacgatctcggctcactgcaacctccgcctccgaggttcaagcaattctcctgcctcagcctcctgagtagctgagactacaggcacatgccaccacacctagctaatttttgtatttttaatagagatggagttttaccatgttggccaggatggtctcgaactcttgacctcgcgatctgcccgccttggcctcccaaagtgctgggtttacaggcatgagccaccgctcccagccaatttttcttaaccattgcacatattaattgacaacagttgataaggtcaaagctaactaattttggtgttaacacacaccttttcaggaatttatctacgttaagtatggcatgcttacagtacattattgcctgtgatactggaggataaatttggttcatggtttagtaattgtacctttctctggtatttttcaaccttaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtggtaactataaaatataaatatctaaacatttaggttatagagtcagaagaatatataagtaattcacttggcataactgaatagaatctttacagtgattctcttaccaaaaaatatatatatatttagctaaaaggaagtaaaaattcaaagccccaattttttttttttttgttttttttgagatagagtctcactctttcacccatgctggagtgcagtggcgtcatctgagctcaccacaaccttcgtctccagggttcaagtgattcttctgcctcagcctccccagtagctaccacagctggctaatttttgtaaaaagtagagacagagtttcaccatgttggccaggctggtctcgactgaactcctgacctcaaaggatccgtctgccttggcttccgaaagtgctgggattataggtgtgggctaccatgcttggcccctttttttttttttttttttttttttttttttgagatggagtctggctctgttacccaggctgcagtgcagtgtgcagtgtggcgcagtctcagcttatggcaactctgcctcccaagctcaaaccatccttcaacctcagcctcctgagtagccaggattacaggtgtgcaatctgtaatttttgtatttttactgactaatttttgtatttttagtagagacagagtttcgccctgttgcccagactggtcttggaattcctgggctcaagcaatctgcccgccttggcctcccaaagtgctgggattacaggcatgagccactgcgcccagccaaagcccaaatttctaaatatagttattttaatgtatattaactcttcctgatgtactctcttgtattataaacatttctataatgttctgtcttaagctactgtacaatgaaggaaaacagaatggtcctacctggaaagcagagaactaggaaataggaactagaaaactagaaataggaactcataaatggggcactgcagaagatactgtaaaatgctgatagtaaaagaaaaaataggattctcactttctcctatctttaagatcatcaaattataaagtttgaaactcacataatcttccacaacttaaatgggctgaacattacctggtataatataggtactgaaatggtatgatattaaaggcagatttatattgttggtatagaatacctccaagtagtagaggcataaaatatctctaaattataattactccctgtgttttcctctgcagtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccatatatttatttgtttggaatcactcttgtgtgatataaaggcgtgtatattatctttgtattagaaccaaaaaagttatttattttggtccctatgattttattttttaagataaattaatatactgtattttttaaagtataggtttaggtttacagaataatagagcagataatatatagagttccatacacccactgcaccccataccctcattcctccttacacaatttctcctattattaagatggtgcattagtgtggcacatttgttacaaatgatgaaccaatattaatttattattaattatagcccatagttcacattaagattcattgtgttgtaaggttatgtgggttttgacaaattcataatggcatgtgtgcaccattgcagtctcatacagaatagtttcaccaccctcaaaatcctgtgcttcacttatttatccctcccgccgtgccctggcaaccactgatctttttactgtctctacagttttgccttttccaaaatgtcatgtagttggttggagttatgcagtatgtagactttttagactggcttctttcacttagcaatatgcatttaaggttcctccatgtctttttgtgacttgatagctcattttttattgctgaataatgttcattgtatggatatagcatagtatgtttatccattcgcccattaaaggaaatcttgattgcttccagttttcagtgattaaaaataaagccgctataaacatttgtgtgcaggtttttgtatgaacataagttttcaacccaattgtgtaaataacctaggaatatgactgccggagtgtgactatgtgtagttttatgagaaactgccatactgtctcccaaagtggcttaccgttttgcattcaccagaaatgaaaaagtattcctgttatccttatctttcccagcatttggtattgttagtttttttttattttgaccattctaataggtgtatggtggtattttattgttttaatttgcaattccctaatggcatctgatgttgaacatcttttcatatggttatttgccatctgtgtatctttttggtgaggtgtctgttcatatcctttgcccattatttaattgggttcttaattctcttattgttgaattctaagagttctttgcatatatatatatatagttgttgttgttgttgttcttgttgttgttgttgttgtttttgaaacagagtcttgctccatcgcccaggctggacttcgtatattttggatacaaatttttttttagttaatcttccgatttattttcttagtaattttaaaagacattaagttcattaacacaataaattaaagactatattaatagattgcaacatatatgcgtgtaatatatatgataataaaattacaaaagacaagaaagaaagtgaagcaatgttgaaggcaaggttctgtattttcctagaactaagttttacgtattattctgaagtagactgtgataggataatacgcatattgcaatcactggcactaccacttagaaaacaactgaaataatacaactcaaaaacagaaaaactgaaaatctacactggaaaacattatttaacaaaaaagccagttaaagataaaataaagaacaacaacaacaacaaaaagacagaagaaatacagaaaacaattagcaaaatggtaaatttaagtacaaccatgtcaacaattgtattaaatgttatagttctaatgcaatcaaaaggcagaaattgtcagacagactgagtaaaaagaaaaattcaaccatcactacctgcaaaagaaatgcatcagattcaaagacactaatagtcccaaagtaaaaataaaaaatatagacactatataagcagtaaccataatataggtcaaatgaatatatctatatcaggcaaaatagatgttaaagcaagtactactcagcatgaaaggggtatttcataatgaacacaggttaaatacatcaagaagaaataatgtatctgcacctaacagagcttcaaaatattcaagtcaaaatgtaaagaattaaaaaaaggaaaatagataacttgataacaataattgaatatttcaataatgtactctcaataattgatagaacagctggtacaaaaaccaaaaggatgtagaagacatagacaacattatcaaccagcttgagctgactgacatctgacaaggtgacatctttttttttctttttttccaaatttttaattaaatacaagtttgcaaagattttttcacattctttgtgaaaatttgcgaaaaaaattctttcgctttattccttcagcttttcattccttcaacaatgcctttcacagagaagaagtttttaattttaataaaatccaacttgataatttttctttcatggcatgcctttgttgtcatatctgaaaactcattgccaaacctaaggtaactagatattcctgttatcttctagaagttatatagttttatgttttatatgtaagtctaagatccatttggagttaatttttatgaaaagtataaattgtatgtctagattcatttttttgcatattgatatccaattgttccagcaccatttgttgaacagactgttctttctccattgaataacatttgctcctttgctcctttgtcaaagattagttgactacatttgtaagggtctatgtgtgggctctttattctgctccattatcattttgtctattattttgtcaataccacactgtcttgattactgtatagtaagtctcacatttgagtagcgtcagtcctctgactttgctctttagtttggtgttattctgagtcttttgctgctccatgtaaaccttagaatcattttgttgataaccacaaaataacttgcttggagcttgtttaggattacagtgaatctatacgtcaagttggggagaattaacatgataacaatactaggtcttcccatctatgaatggaatatctctccatttgtttagatattctttgatttattggagttttgtggttttcctcatatacatcctgtacatttattattatatttatgccttaatatttaattttttcatgctaatataaatgatactgtgcttttaatttcaaagtccaaatgttcattgctgttatatagaaaggcaatagacttttgtatattaaccttatatcctgtgactttactataattacttagttccaggaattttttgcctattctttgggattttctacattgacaatcatatcatctgtgaacaaagacagttttatttcttcttttccaatctgtataccttttattttccttcttatcttatcgcatcagctaggactttgagtataatgtcgaataagagtggtgagaggggatatccttgcctcatgcccagtctaaaagaaagggaaaacatctagtttctcaccattaagtgtgatgttagttatagactttttgtagactttctttgttaagttaaaaaatcccctctattcctagtttgctgagaatttttatcacaaatgggtagtagattttgtcaaatgcattttctgcatttattgatatggtcatatgatttttctttagcctgttaatgttatggattacattaattaatttttaaatgttggaccagcattgcatatttggaataaatccttctcggctatgtgaataaatatttttatacattgttggatttaatttgctaatattctgttagggatttttgcatttatgttcatgagatatattagtctggagttttactttttgtaatatctttatctggttttagtattagagtaatgctggcctcataggatatgagttaggaagtattccctttgcttcagtttttatggaagagattatagagaatacgtatcatttatttcttaaatgtttggtggaattcaccagtaaagctgtctgggcctctaacaaatactagaatgtacttaaaaatcatagtgaaggggctggaatagtgtagcaggcagaataagggcctctcaaggatgtccacatcttcatccacaaaacctgtgaatatgttaaattacatgtaaaggtgaattaaataaagttacgcagaattaaggtggctaaacattaaaatagggagattatatttgattatcttggtgggtacaatgtaaacacaagggtctttatgaaacaggaagaaggaaacaaatgagaaagagaaagaggtggggatggcagaagcagagtcagagagatgttatgttgttggctttgaacacagaggaagacagccatgagccaaggagtgcaggtggcctctagaagctggaaaaggcaaggaaatggtttctgtagaacctccaaacaggaacaaagtcctgcaaacaccttgtgtttagcccagtgcgactcatattgtatttctggcctacacaattgtaagatggcaaatttttgtgattttgttttgttttgttttttagagacagggtctcactatattgcccaggctgatcttgaactcctggggaatttgtgttgttttaagccactaaaaaccaaaacaacaacaacaacaacaacaaaactatctgggcctgatgctttctgtcttggaaggttattaattattgattcaatttctggctggacatggtggtgcacacctgtaatcccagtactttgggaggccgaggctggcagatcacttgagctcagttgttggagaccagcctggccaacacggtgaaaccccgtctctactaaaaatacaaaaattagccatgcgtggtggagggcacctgtaatcccagccactcaggaggctgaggcacgagaattgcttgaacccaggaggcagaggttgcagtgagccgagatcacgccactgcactccagcctgggcaacagagcaagactctgtctcaaaaaaaataaataaaaataaaaaattaaaaaaaaaattcaatttctttaatagatctagacctattcagagtatctgtttcttcttgtatacattttggtaggttttgtcctttaagtaatttgttcatttcatctcaattatcaaattatagaattatttataatattcctttattatctttttaatgtcattaatgacattaatgtttagtagtgataatccctcttttatttctgatattagtaatttgtgtcttccccttttttttcttggttagcctggccagagttttatcaattttactgatgttttctaagaaccagcttttggtttccttgattttctctgttgattccctgctttcaatttaattgattgttgctctaattcttattagttctttttttctgcctgctttaggtttatgttgctcttcttcctgtagtttccagaaacttgtacctctaatctaaggcacatgcttagattattgattttatatttttcctattttctgatatgtgcattcaatgctatcaatttccctctaaacatttgctgaatcctacaagtttttataagttgtattttcatttttgtttagtttaaaatattttaaaatttcttttgagatttctttgacccatgtgttatttagatgcctattgtttaatctccaaatatcttttaattttccagctatctttccattattgatttttagtctaattccattgtggtcttcaggcttactgtgtatggatttttttttttttttttttttgagacggagtctcactctgtcgcccacagggagtgcagtggtgcaatctcagctcactgcaacctctgcctcccgggttcaagcgagtctcctgcctcagcctcccaagtagctaggactacaggcgcccgccatcatgcctggctaatatttttatgtatttttagtagagacagggtttcaccatactggccaggctggtcttgaactcctgaccttgcaatccgcccgcctcggcctcccaaaatgctgggattacaggcatgagccaccaggcccggcttgcttttattgttttaaatgtgatcagtactcgggaggctgaggtaggaggatcgcttaaggccaggagtttgagaccagcctgggcaacataagcatctcttaaaaattttttgctcaggtactctgttaacaatgtccagaatgttgtttatcttggtgaatgtttcatgtgagctttaggagaatatgtattctgctattggtggatggagattctgtaaatgtcaattagatccagttgattgatgatgccataattcaactatatctttaccgattttctgcctgctgcatttgtccgtcactgatagaagagtgttgatgtttccaaggataataatgggtttgtctatttctctttgcagttctgttagtttttaacccacctattttgatgctctgttgttaggcacctataaacgactgttatgtcttcctggagaattgacccctttatcattatgtaataccattcttcatccctgataattttccttgttcagaaatctactttgtccaaaattaatatagctactcgagctttcctttgatcagtgttagcatggtatacttttttttcttcctttaacctaatgataaccagttgctgataggtagctattctgaaatgaggactttctgtcaagatagtgatgttttattttcactgtgagctggctttgtttcctgcataactataacagattgctaattaacattgataaatatatctcattactttttccaatcaccatacaggttgagtatcccttattcaaaatacttggggccaagcatggtggctaacatctgtagtcccagcacttcaggaggctgaagcaggaggatcacttgaggccaggagtttgagacctgcctgagcaacatagtgagaccccgtctctacaaaaaaaaaaaaattaaatagctaggtatggtggcatgtacctgtagtctcagctactcacaggctgagctatgattatgccacttcacttcatcctcagtgacagagcaagaccctctttaaaaaaaaaagacaaaaaaccttggggccagcagtgtttcagatttcagattttggaatatttgcattatatctactggttgagcatccctaatgcaaaaatcaaaaatgcatccctaatccgaaatcaaaagtgctccaatgagtatttcctttgaacatcatgttgacacttagaaaagtttcaaatcttagattttcaaattagggatactcaaactgtatctttccaaaataaagcagttctaattccaccgcatattgggggctaaattttaccagtactgcttatgtatcctgccgtggttttctaagtgtgttatatatttacagttttgtctcttgaaatagacaattttactctggcatagagctatttattacttctaatgacatgttgatgctacttttaggcattttattttaattttattgcaataggtttaggggtacaagtggttttggtttcatggttgaattgtatagtggtgaagtctgaaattttagggcacccctcacccaagtagtgtacattgtacccaatatgtagttttttatccctcatcccccttccactttcccctcttctgagtctccaatactcatacgcattataccactctgtatgcctttgcatactcattatttagctcatacttatgagaacatatggtattttgttttgttttgttttgttttttttgtttcgagacagggtcttgctctgttacccaggccagagtgcagtggtacgatctcggctcactgcagccttcacctcctgggctcaagcaatcgtcttacctcagcctcctgagtagctgagaccacaggcatgcaccatcacacccagctaattttttttttctttggtagagccaggttttgccatgttgcccaggctggtctcgaacttctgagctctagtgatccacctacattgggctcccagatttctgggattacaggtgtgagccaccacactcagccagtatttgggtttttttttttttttttggttttggttttttaagacagagtctcacttgcccaggctggagtgcagtagtgcaatatcggctcactgcaacctctgcctctctggttcaagtgattctcgtgcctcagcctcccaagtagctgggattacaggcatgcgccaccatgcccagttaatttttgtagttttagtagagacagtgttctgccatgttggccaggctggtctcaaactcctgacctcaagtgatctgcctgccttcgcctcccaaagtgctgggattacaaccatgatccactgtgtccagcctggttttttacttctgagttacttcacttagaatagtgacctccaattccatccaagttactgcaaaatacattattttgttctttcctatagctgagtagtattctatggtgtatacatgccacattttatttatctacttgtcagttgaggggcacttaggttggttccatatctttgcaactgtgaattgtgctgcaataaacatatgcatgctggctggatgcagtggctcaccctgtaatcccagcactttgggagaccaaggctggtggattgcttgagctcaggagttcaagaccagcctgggcaatgtggcaaacccccgtctctaccaaaaatacaaaaaattatccaggcttggtggcttacacctgtagtcccagctccttctagggggctgaggtgggaggatcacttgagtctgggaggcagaggctgaagtgagccatgatcatgccactgcactccagtctggatgacagagtgagaccccatctccaaacaaacaaacaaacaacatatgcgtgcaggtgtctttttcatataatgacttcttttcctttgggtagatacccagtagtgggattgctggattgaatggttggtctacttttagttctttgagaaatctgctattgttttccatagaggttgtactaatttacattcccaccagcggtgtataagtgttcccttttcaacacatccacactgacatctattgtcttttgactttctaataatgaccattctggctggggtaaggtgttatctcattgtggttttaatttgcatttccctgatgattagtgacgttgagcattttttcatatgtttgtggctcttcaaagggtcacacgagtctggacacaatggctcatgcctgtaatcagagcactttgggaggccaaggcgggcagatcacctgagatcaggagtttgagactagcctggccaacgtggtgaaaccctgtctctactaaaaatacaaaaactagctgggcttggtggcgcacacctgtaatcccagctacttgggaggctgaggcaagagagtcacttgaactcggcaggtggaggttgcagtgagccaagattgtgccactgcactccagcctggtcaacagggagactctgtcacacacacaaaaaaaggatcacacgttacacaagcagatacacagtttatctgtggtattaaaatttcatgggaaggcaattgtggggggaagtcttaaaaaaaaagcttcctaaaggaggggaaaagaggctggcaacccctggcataaaagattaaacccaaaattggcatccaaagccttctacggtctggtttccattgacctttccaccttgattcctatcattctacactgggggacagattggactaaatctcttaagttctcttccagctctaagaatgtaaaggtcttttcagtttgaacccttttctgtaacaagactcatcttgctttctcctagacagactacacttattcctcatatgtagaatgcccttccatctttgtttccacgttattcacaacacttctacccacactgatcagtttcttccataaatgtattgtctgctactgctaattttagcatggaaccacatttttgttacaatttactttttttcttttttctttttctttttctttttttttttttttttgagacaggatcttgctgccttgcccaggctggagtgcagtggtgtgatcacagcccactgcagccttgacctcctgggctcaagcaatccacctgcctcagcttctggagtagctgggactataggcatgtgccactacacctggctgattaaaaaaattttttttgtagagatgaggcctcactatgttgcccagactggtcatttaacatttttaagcctctttcattatttgtaaaatgaaaggattatattaaatccataatatctcttccagcactgaatctaggtttaatgtcttttctatcttctgtatcctttccccaccatcccctactagaataaactcctgtgagcaggaacttcctcatactaacctttgaatgccccccacatttctatgcattatagctgtaataagtaattgaactgattaaattgaatctgcattcagaggtaaacttgtggttatatcctacttgctacttattttgaatcttgagaatatttgcagccaggcatggtggctcatgcttgtactcccagcacttttggaggctgaggcaggcagattgtttgaacccaggagttcagaaccagcctgggcaacatgatgaaaccctgtctctacaaaaaaattcaaaaattagctgggtgtgatagcacacacctgtagtcccagctacttgggaggctaaggtaggaggatcgcttgagcccaggaggcagaggttgcgatgagccaagccaagatcacaccactgcactccagcctgggcgacagagtgagaccctgtctcaaaaaaaaaaaaaaaaaagccagacatggtgcctcacgcttgtaatcttagcactttgggaggccaaggtgggcggatcacatgaggccaggagtttgagactagcctggccaacatggcgaagccccatctctactaaaaaaaaaaaaaaaaaaaaaaaaaaattagctagatgtggtggcacacacctgtaatcccagctacttgggaggctaagtcatgagaattgcttgaacctgggaggctgaggttgcagtgaactgacatcctcgcaccgctgcactccagcctgggtgacaaaatgaaactctgtctcaaaaaagagagagagagagagataatatttgccccttgatacattgattcacactttttccatcccctaaccccgatccatagtaaactatttaaatattataacacagtagaattaaaagcttgtgttgaattaatattttgcaaatgttaacccattaacaacaaaattaaatgaatgtaatattctttatctcattagcagagacacaaagccctaaaatggcaacaaagttattatatcttctgacttattcaatggaaacagaagttgtaacagcattcctacaatttgctgctgaaaaaaatcccaccctttcccttttttttttttttttttgagatggagtctccctctgttgcccaggctgaagtgcagtggcacaatctcggctcactgcaacctccacctcccgggttcaagcgattctcctgtctcagcctcccgagtagctgggattacaggcgcacgccgccatgcctggctaattttttgtattttagtagagttggggtttcaccgtgttgcccaggctggtctcaaactcctgagctcaggcaatccacccacgttggcctcccaaattgctgggattacaggcatgagccaccgcacctggcctccctctttttcatcttgattctgtatgtgtacatttgtagtacttagaagtcacatttcacaggattgtacctaccaaaagagtcagtattgagaattttgtattttgtacttctgcaagagtattttccaacactagtgtattattaataaactaatgaacatttggttttcatttgcttgtttcaacaaccattttggcatgtatgtggtgttaatagcttaatgctttgaactgcaggtgccatatcttcatgtattgtaaatgtttctgtctgaagcagttagaaaaactaatggatctacttagttcagatttagtaaaattttctggtcgtatgtgaaagcattagtttattgaagtataagaaaatcactgattacaaactttcaagagcacaaacatttagcctctatggacatattagctagcctatcagaggtattattggggaataaaaggctaacagtttatgtacctttctaatcaatgattaataaaatctcttgtaagagcctgtgtgttgtcaccggacatttttatcttaccttaggctttcttatcagctgcaaagcagactatcctgaaattcttaccaagatatgtgttcttaggttacctgtgtattaacctgctcagaatatccagaagagaagatgtccaaatgtaatctaggctgacctttttctgccaaattgtttcagttgcagattatggactcttgcctttcattttcattatattcttacagttttttgtttacttcacatctttaaaaacaaaacattacaggttcatttaaagcctctttatacttttcttctaccactattctcttatcccccccaagaattaatcaccactctgaaattggtaggtatccctcccatgtaagttttttgttgttgttgggtgggggttgtctttgtttttgtttttgttttttctgagactgagttttgctcttgttgcccaggttggagtgcagtggtatgatttcagttcactgcagcctccgcctcccaagttcaagcgattctcctgcctcagcctcctgagtagctgggattacagggggcgcaccaccatgcccagccaatttttgtattgcccaggctggtctcgaactcctgacctcaggtgatctgccacctcggcctctcaaagtgctggggattatagacatgagccaccacgcccggccttaagttttgtaatcatttaatttttacatcaaaggtgtaatgcgtatgctttgcaactttctttacccatattttaaaaaattctgttaacacatgaagatttgattccattcctcctctattccactacattaatatggcaatatgtattattttccatctattaactgtatgtgcatcagtcagggtccaatctcgagacagaaaatacacagtaatttgattagaggaagtttaatatgaggaattattaaatgtaacaagggattggaataataaggaattgcctagtaagatgtaaggagaactctaaagaatagaggaataacagatatacatatatttttaaggcaataccactaggactgagagtgtctaagaaaatccaccatcccctagggctgaggtccagcttgttaaaatgagcataaccatgggtcaccagatggaagaaaagtcattgtcgtgctaaaaatacactctctagaacttgtcagagacccaccctctgcggtgccaggaaaagctgtacatagggaagtttctcactagagacactctgctataaaaccacagaaggaggccaggcgtggtggctcatgcctgtaatcctagcactttgggaggccaaagtgggcagatcacttgaggtcaggagttcgagaccagcctggccaacatagtgaaaccctgtctctactaaaaatacaaaaattagctgggtgtggtggtgggtgcctgtaatcccagctacttgggaggctgaggcaggagaatcgcttgaacccaggagacagagatggcagtgagccagattgtgcctctgcactccagggcaacagtgacacatcatctctaaataaataaataaatccacagaaggaggaggagttgtcagtggtgctgctagccaccaggcactgcagggtatggacaatggagaagttgaacatgctaccagagcctgccaaagcaagaactcagaacctacagtgtctctccagcacccctttctgacagttcattgttgtgccagctggcaaaggaaaaatattatcagagcccagattcattttcatagagcaggcaaaaaggatgaatttggagctgagagacaataagttgctaactgtcacagtctaaccttttggctatttgacgtccacatgcacctttctatacacatttgaactcttgttcatggacaaaacaatttttattttttgagacaaggtctctgttgctcccgctaaagtgcggtggcacaatcatagcttactgcaggctttgaactcctgggctcaagcgatcctcctgcctcagcctcacaagtatctgggactacaggcacgtgccaccacacccagttaatttttaaaatttttttgtggagacaagttctctctctagaactcaggctgatctcaaactcctgggctcaagtgatcctcccgcctcagcctctgaaagtgctgggattacaggcgtgagccacctcacctggccacaattttatattctaagaagatacatctatccatcttaaaagtacttgctgtttccccaaaatgtaaagatatgtagtcccaacagtcattgtttctattgctattttaaatacttctcaaattcagtcacagttccactgaatattcttacctaaagactaaactgtaaaattatctaccaacaatctgtatattaaaaactggaaaggagagagaagaaggatagcatattaaaataaaggtattggctgggcacagtggctcacacctgtaatcccagcacttcaggaggctaaggcgggtggatcacctgaggtcaggagttagagaccagcctggccaacatggtgaaatcccgtctctactaataatacaaaaattagccaggtgtggtggcacacacctgtaatcccagctactcaggaggctgaggcagaagaatcgcttgagcccaggaggcagaggttgcagtgtgctgagattgtgccactgtgctccagcctgggcgacagagcaagactttgtctcaaaataaataaataaataaataaaggtgtgaatacaagaagcaaagagaaaatatgcaaagctactttgtttctgtgattggtcattaaggttgtagtttatacctatggcttccttctgcgggaagccaattccgtgttattcttgccctcagtcagaacttcagttgctgtgggttctttatgtggtggaatgactgaaattttattgccaaagtgtctgaatctttattgttcttaccccttctcctccccacacctgttttttggttgctacgtagttttccatcaacctttactattgaagatggaagaactagaggtacctcagagaatctgggttccagacatagtcctcctttctacccttgtgtagcaactcagtttcccattggtcatcaggatcattctctccagccagattaactctcctttctcacctcatccccttttttccctgcttagttcaacaacatatggagcccaaaatgtccaggtgacagtctcatcttccaaaccagggaagaaccattgtggtgtctccttgtggaagcatccccctcttgggaacaaagatctccaaaccatcaaagctcaaagttaccaggatagagagcgaacattcttctagtgggttattgggtggaatagtgagaggagccactcctacacccactctttgattcctggactatcctggctatgagggagacagcactagatagtggcctctgattcaaaacctaaactgcatcctgtaaagcagaacccatttctttcagggtgttgtctcccagttgacactgtaacagattttagtgagccatttcacctttccgttaagctaattgcttctaggtgatggggagtggagtaagaccagcgaattctacggccatgagcccactgcttcacttcctttgcagtgaagtgagttccctgatcagacacaatgcagtgtggaatgccatgatggtcgataaggcattctgtgagttcacaggtggcagcgctggctgaagcattatgagcagggaaggcaaacccacatccagaatatgtgtctattccagtgaggatgaatctctgttgtttggatagttttattctgtcggcataaaaaaaactgggcacacaggttaatgactaggttaccctgaaataggctaatgcattattcttttccataatagcacatctcattttgaaacagtagaacttcataaaagtgagaaagagagtatgaacattttagtggtaggattctaaagtgattatgtccccctaagaaggaaatgtttccctcttgaaggtagaactaccaccccaaccatcctaaagagacagatgcctggccggacacagtggctcacgcctgtaatcccagcactttgggaggctgaggcaggtggatcatctgaggtcaggagtttaagaccagcctggctaacatggtgaaaccctgtttctactaaaaatacaaaaaaaaattagctgggcctggtggcaggcacctgtaatcccagctactcaggaggcttaggcaagagaatcacttgaacccgggaggtggagattgcagtgagctgagatcactcattgcactcagcttgggcaacaagagcgaaactccgtctcaaaaaaaaaaaaaaaaaaaaagagagacatgcctatggagttcaaaaagaaacgctgcatgtactcccacgttataatgaacacgtgtacatatagaactacacgccaggaactgcacagagtgtttccgatgtattcagtagttctcatattcatcataggaggcagatactcttattattcacatttgatacacatcaaaacggaggcataatagggaagtaatttgcccaaaaagtcacatagctggtatgtggcagacttgacattgaatattccagtatctacgctctcttcattaccaactattctgtctttcatagtaagttttatcttaaacaccagtaattatttctaacatttcacatgagctcctcaaacaaagcagtttaatgggaagtggctgttaggcaaataagatacaaccaaatacaaaatttaaccaccccttgagggaaaacttacagtgtaggtcaaagggtaaactactgatggtgttgcattccgaaagattgccacctgctcctgtctgatgctattcttttttcttttcttttttttttttttagatggagtctcgctctgtcatccaggctggagtgcagtggcacaatcttggctcactgcaacctccgcctcccgagttcaagtgattctcctgcctcagcctcctgagtagctgggattacaggtgcctgccaccacatggctaatttttgtatttttaatagacatggagtttcaccatgttggccaggctggtctcaaactcctgaccttaggtgatctgcccaccttgggctcccaaagtgctgggattacaggcaggagccgccgcgcctggcctctgtctgatgttattctgctttgacttttcttcccctctccttagaaaatcccacagaatgtaggcactgctgttgagtttgtgaaattctctttttcctaagccaggaagctgttttctccttctatcttttgtttttcatcctccagtttccttttactctttaaattgctgctttatttgcacctgagctgtgttcccctttggcaagctttccttaccccacaacccatgcatctgataaatgtgtctcaaggtccttcctgccttcttcctccttttgtttcataagcttcttcagtccctcagaaagaagagcacagataaactgacagattagtgtgattacctttagctctgtgagtggaaagcttgacagtcaaaacaaaaacctgatctcaagaaaaaatatttgtaacgttataaatagggaaaaacgtttatatcactgccaggtttgtgcagatgtcagtggcctagagtggaaattctgggtctcactgtagcaagctgcttatttcaccagtcatccgttactcagaattgaacattaattagtcaaaaaaagaacttttatgtttctccctaagtcagagaattgtagctgccaggaggtaatatagctttagacagctatggcacaataaggagttttgcaggtctgaaggcccctgcagttgtagaaacatggttggtgtaaaagtaaagttccaggctgggcgtggtggctcatgcctataatcccagaactttgggaggctgaggtggatggaccatttgttgttaggagttcgagaccagcctggccaacaaggtgaaaccccacctctactaaaaataaaataaaataaattttaaaaataataataaataaataaaatagccaggcgtggtggcaggagcttgtaattccagctactcagaaggctgaggcaggagaatcgcttgcacccaggaacccaggaggcgaaggttgcggtgagccgagattgcgctactgcactccagcctgggtgacagagcaagactccatctcaaaaaaataaaataaaataataaaaaagaaagtacagttccagagtgatctcatgttacaaagactgcttgcaatgggctcagctatgaggtggagtttgataaacagatgctatgctatcactttggatcatcccagggtaacaacacattgatatctggtatcagaatctagaatcaaataaagagcaatgaagctgtttagaaaataaggaaacaggaagcaaaaataaaaaaaaattttaaagtagctttttttttttttttttttttttttgagatggagtctcgctttgtcaccaggctggatggagtgcagtgatgcgatctcggctcactgcaacctcctgcctcagcctcccgagtagctgggattacaggcagtagccaccacacccagctatttttttttgtatttttagtagagacggattttcaccatgttagccaggatggtctcaatctcctgacctcctgatccgcccacctcggcttcccaaactgctgggattacaggcgtgagccaccgcggccagccaaaagtagctttgtaacaccaatcattcaggttttgcatgcagtgcagacagcagaggaagcacacttcagtccaaatgagcttgaagtcctttttctgcagatgtagttcgcacagctttgactgaacagctccaatttagattcctggaccctacctcatttctgaggtttcctggagtgtggctcacttagaaggaagtcaaccaaatttcaaatggagaggaaagactaaattgaatctggagatatgtgcatgtgcctcccttttctttccttatggcccagctttgtttgagcctactatcaaatgtttttgtttcgttttgttttcttgttttgtttttgagatacagtctcgctctgtcaccaggctggagtgctgtggtgcgatctcagatcactgcaacctccaactccctagttcaagcgattctcctgcctcagcctccctaacagctgggattacaggcgcgcaccaccacacccagttaatttttgtatttgtagtagagacagggtttcaccatgttggccaggctggccttgatctcctgacctcaagatctgcctgcctcggcctcccaaagtgctgggattacaggcatgagccaccgcgcccggccccaatggtttctaaagcatctcccaaagcatgtctaccctgagtgacagaaagcaagtgaggaagacatctgcaacacacaatggaaggcgaaggcctctggctttctgattctggtcctggctccatcattttctttttattttttttctttttgagacaaggtctcactctgtcactcaggcagagtacagtggcatgatctcggctcactgcagcctctgcccccctggttcaagctattctcctgccttagcctcctgcctccaagaagctgggactacaggcgtatgccaccatgcctggctaagtcttgtatttttagtatttttagtagagatggggtttcatcattttgcccaggctggtcttgaactcctggcctgaagtaatccacctgcctgagcttcccaaagtgctgggattacagacgtgagccaccatgcctggccctggctcttatcattttctagtacagtacatctttagcaaagaccattttctcatcccttttgtcagtacagcacaatactgtactgtttcattagatgccactgtaacctagacggcagcttaggactctgtcccttggagatatgggtggtagacttgagaaaagatttcagaaagcagagggaggaggggtttacactgccacaacacacaaaaaaacttcaaatagaacagtaagcattaccattctcttgttttttcaccttttatattgtgaagtacatcatggatacagaaaagtgtatttaatataaaaccgtagcttaatgaataattaccaaataaactcctgagctacccgccacccaggtgaagaaataaaatattgttagcattcttgaaacccacccctttcagatgctcaacccctttcagatatgattctcctaatcatatcacttttccaccaaaaaggatgatttcataatagttatttccttacctttcttggaattttaccgccaaagtgtagatccctaaacaatatagttactgtttttgaatgttgtgtggagataataatattgaatatattcttttgtactttctttccaaagattaatctcctatggttttaattcatttatatcaattgctgtatagtattccattgtatgaatataccttagtttgtttatccatattcaactgttggtgaatattcaagttgtttccagtttttggctgttaatgacattctactaaagaactttcttaagagtgtatcccactgatcgacatgtgcatatgtttctctagggtctgtacctcaacgttgaatttctggaacacagggtaggcaaatctttgatttgtaatgccaaactgttattcaaagtggctgtactagtttaccttcctagcagtagtgtatgaaagttcccatttgtccaggtgctcaccaacacttgatattgtcagacttttagcttttacggtgagggaataatgttatttcatagtggttttaatttgtatttccctgattagtaatggagtcaagcatcagtttatacatttgttagccatttggtttttcctttatggaaagtgccgttcaaatattttgtctgtttttctaatgggtcatctttttgttattgatttgtattagttccttatacattctggatactagccctttgtaagttgcatgtattttaaatatcttctcccactccgtgggctttttaccctctttatcatatatcttgtgaacagaagtttttaatgttaatataattatcattttacctttcacatttagatctataacccatctggaatttaatttttatgtatactgtgtgatagggatccttttttttttttttttctgagacggagtctcaacctgttgcccaggctggagtgcaatggcgtgatctcagctcactgcaaccttcacctcccaggttcaagcgattctcctgcctcagcctcctgaatagccgggattacatgcgcctgccaccacacccagctaatttttgtatttttagtagagatggggtttcaccacgttggccaggctggtctcaaactcctgacctcaggtgatctgcccacctcggcctcccaaagtgctggaattacatgcatgagccaccacacctggctcatttttttttttttttctttttagagacagggtttcactctgtcacccagaatggagtgcagtagcagtcatagctcactgtaacctcaaacttctggctcaaattaacctcctacttcagcctcccaaaatgctggaattacaggtgtgagccaccatgcccagccaaatttcattttttatctacatgcttatccagttgtcttggcaccgtttattgaaaagtctagcctttcttaactaatcttcagtgacacttttctcatatatcaaatgtccatttttacatggggatccatttctgagatctctatttcattgtttttctgtctatccctgttcagtgccacactgaaataatatagctttcaaaatcagtcttggatctggtagaacaagtctttccaccttgttcttcttcaagagcctcatagctgtttttgccctttgcattttagaatcagctttttaaattacacacctacataaacacacacacacaaacacacacactcactcattcactcaactgttaggatttttattgggattgtactgaatccataaatcaatctgagaagaattaacatttttacaatattgtgtctcctaatccttcaatgtagtatctcttcttttgtttaagtcttttctaaggtctctcagtaagattttttttttttttgaacagagtctcgatctgtcaccaggctggagtgcaatggcgcgatctcggctcaccacaacctctgcctctcgggttcaagcgattctcctgcctcagcctcccaagtagctgagattacaggtgtgcgccaccacgcccagctaattctgtatttttagtagagatggggtttctccatgttggtcaggctggacttgaactcccagcctcaggtgatccgcccacctcagcctcccaaagtgttgggattgcaggtgtgagccaccacacctggcttcagtaagattttataacaatgtatttcagctctttcggaccttcagttcaacattttcctaaatatttcatatttttggtgccattatcattgtatttttcaaatttcattttgtacttgttagtggtatatataggattacaactggtccatatattgattttacaaaattgttaaattattaatttcataatttatctgtaaatcttctggattttcaatgtacacattagatcatctgtaagtaatgcaatattttataattcttacatattttgttgctttttcttgtttaactgcatttgctagatcttctgtacaatgtcaaatagacagtgatagtgaatatccttgtcttattactgatttcagagagaaagcttacaacattttaccataaatatgatatttactataaatattttgtatatactcttatcagattaaagaagtttcctcctgttcctagttttcttttcttttttttctttttttttttttgagacggagtctggctctgtcccccaggctggagtgcaatggcgtgatcttggttcattgcaacctacacctcccgggttcaaacgactctcccacctcagcctcccaagtagctggggttacaggaacccactaccaagcctggctaatttttgtatttttgtagagatggggtttcaccatgttggccaggctggtcttgaacccctgacgtcaagtgatgcgcccacctcggcctcccaaagtgctgggattacaggtgtaagccaccacacctggccctgttcctagttttcttggaattttaatcatgaatggacattgaattttatcagatgcatttttgtctttattgaaatgatcccatcatttttcttcttaaattgctagtgtggtaaattacattaatttttcaatgttaagccagccttgaaatcccagataaatccagtttatattattatttttctacggtgatttggtttgctgatttgtttttctgttttttcatctaagctcacgaatgagactggcctgcattttcctttctcttattgttcttgttaagttttgctagtgttgtggatgaattggaaagtgtctctgaaaaagtttgtgtgaaattagagttacttattcttaaatgcttaattgtataactgaagaaaccatctgggcttggaattttctttgtgggaatattttgtttgtttgtttttgagaaagagtctcactctgtcacccaggctggagtgcagtgtcgtgatctcggctcactgcaacctctgtctcccagattcaagcaattttcatgcctcagcctcctaagtagctgggattacaggcatgcgccatcatgcccagctaatttttgtatttttagtagacacgggcttcaccatgttgcccagattggtctcgaattcttgacctcaagtgatccacccacctcagtctcccaaagtgctaggattacaggtgtgagccaccgtgcttggccaatattttgttcttgatagagtatcctttgttcttagaggattattcatgttttctggtttttcttgttgttgttgttgttgttgttttttgagacagagtctcgctctgtcgctcagggtggagtgcagtggcacaatctctgctcactgcaagctctgcttccctggttcacaccattctcctgcctcagcctcctgagtagctgggactacaggtgcctgccaccatgcccggctaattttttgtatttttagtagagatggggtttcaccgtgtcagccaggatggactcgatctcctgacctcgtgatctgcccaccttggcctcccgaagtgctgggattacaggcgtgagccaccgcgccaggcccatgttttctatttttttctgggacaactttgggaaattgtatttttttaggataacacccatttcacctaaaatttcaaatttattggcataaagtcgtttctaatatcctcctgtcttttaaatgcctgtaacatctttagaactgttcccttttcactcttaaaactgatgatatttgctccctctctctttttatcactcttgtcaagctgggcacggtggctcacacctataatcccagcactttgggaggctgaggtgggtggattacctgaagtcaggagttcaagatcagcctggccaacatggcaaaactcttgtctttactaaaaaatacaaaaattaaacaggtgtggtggtgtgcacctgtagtcccagctactcaagaggctgaggcaagagaattgtttgaatccaggcagtgaaggttgcagtgcgccaagattgcaccactgcactccagcctgggagacagagtgagactccatctcaaaaacaaaaacaaataaataaattaaattaaatatcactcttgtcagagatctgtgagtcattttaaaggtccaatgtctgtctttattgatcctcttaatgtttttgtttcttattttgtcaatttgtgtgctttttctcctctttttcctggatttattttgctgggcttttttggaggggaagggagcggcttgttgttgggtttgttttggagttttctttgttagctttttgacatgaatacttagctttttgatttttttagctttttttcttttctaaaacaaacaaggtgaaacatatattttctctaaaaacaaaagactttagcttaattccacaagtttgatatgtatatttttattatcactaagtagaaaaaaaaatcttataacttccattaggatttctcccttgacttttgagttacttgacagtatgtgccttaggccggcatagtggctcactcctataattccaacacttcaggaggctgaggagggaggaccacttgagcctaagagttcaacaccagccctggcaacatagtgaggccctggcaacatagtgagaccccatctctacaaaaaataaaaataaaaaattagatggggcatggtggtgcgtacctgtggtcccagctactcagggggctgaaatgggaggatcacttgagcccaggaggtagaggctgcagtgagccatgattgcaccactgcactctagcctgggcaacagagcaataccacatctctcaaaaggaaaacatatgtgccttagccagccaagcacagtgactcacacctgtaatcccaacactttgggaggccaaggcagaaggatcgcttgaacccagaaattcaagaccagcctgggcaatacagggagacgccatctctacaaaaaaaattttttaaattagccaggcatgatggtgcacacctgtagtcccagctactcaagaggctgaggtgggaggatcgcttgagcctgggaagtggaggctgtagtgagctgtgattgctccactgcactccaacctgggtgacagagcatgactctgtctcaaatatatatatttgtggaagattacttcctccagagataatttgtgtttggttctgacaggcatctgggggtacattcagtccaagacccccaaaaaccaagttcacaatttcagattctctggaattctcaagaggatacaaatgcaggctaagttctgagaaaagactgggctgtggttttctcagaattttttttcctttcctttcgctaacctcttcctcactcagtaccaagagagtcttccctgcagtcccctgggggtggagtaagaacagtaagtttactgctgattcaccctaacacttacagtgtagcctttgagattagtctaatatggtagggcaggtttccttgtactagactcccaaacttggataggcccttggccttggcttctggagccatcagtccaggaggctagccaaacccaaacttagtttgcctggatttgcaaatatcaatcccccttacctgaggcaaaattactttaatgttctgatatttcacttacctctctgggtctctagaaagaaagggtaggtcacagagtaacttcacctgctaatttatatttgggaaatgtttgaatgttttataacaagcatacatttctttaacttttaattacagtttctttaaaaatatcaaatagaactaaaaagctggccaggcgcggtggctcaccgctgtaatcccagtactttgggaggccgaggggggtggatcactggagctcaggagttcgagaccagcctggccaacaagggttaaaccccatctctactaaaaatacaaaaattagctgggcatcattgtgggcacctgtaatcccaggtattctggagactgaggcaggagaatcgcttgaacccaggaggcagaggttgcagtgagccgagatcacgccattgcactccagcctaggcaacaagctgtctcaaaaataaataaataaataaataaataagtaaataaataaataaataaataaaagcctgatgataaaaacagcaatctcctgtctacccctcagtcccacacctgccagcctgcactcctttcattgctttctagcttccaaagatgtgttaaagtttcttatctgctgctgcattctttctatccttgtaggtttatacaaagtttttctattgctttactgtcatttagtgaggcttcaaaagacaaaattaacatgcacaacctgccacttttaatcagaagtccatgtatgaaatccaggctggttttggatgttaacatggagcgaatgggatacatcaaagaatggttggctgcttgttttaaagaggtcccactggtgacaggatggtagtggcgatggcagtgaggacagactggtaaagggaaaacccagaggcttgtggggagaaagggcttttgtagttaggaagagacagaggtaggcccctcagccagctccagcaggatagagacaacaacatacagcgcacagagaattcgtgcctcagggtcatagtccatgtcaggaggactgctggccagctcatcccagttctgctccatgacagatttcacctggaaggaaaccccccagattgtaacagctaggaacaacgatataccagaaatggcaaatatttggccacactccttgctgctgagctgataggcagacgtaataatccatcatggcactctttcctgcagagcccggagagcttcatactctctcaacatagtggcaggctctgctagtcagtctgcatgggaactcaagatcataccagctgctgtcctgggactaaccaatttgcagccctctcttgcccacagataaaaaacagagcctaaagaacccaccacaaattgttctggcaactctctgtccagggaattgtcacaaaccagctgcatggatgtgagccggcagaaaactatggaataagaaggggctgtaccctgggacttctgggtcccttgagaatatgggcattcccttccactatgaccatggccctcagcccaggctgtctcacctggtccttcaacagaggaagggtccccttctccagggcctcagccacaaactgctgctcttcagacagctctgggggcaaagaaagagtggtaaaaaggagagatatatggtgggacagggcctcagtggctgatcacacccagaacatgtatcatcaaaaggttccagagagcccctgggagtgctagatgagacttactccaaacaggcctctgctgtgactcctgcttccctcttggcctgcaggagtcacagacgaggaaccagcccctcaatgcctggcctgaggaagacatgaaggagtgccccccataaactgtgaagagcaacatgcagcccctcctcccaagatgtgactccccacaggcctctctgctcacacttcctccaccccagcctacagcgagacccttcctcacctagcagggcatccaggaagtccagaatggcttttgcacgcgcttctaccaagaccccagcagcattaaaaaggctgcttaggagaggcttgtctgggtcctccatgtgtagctccccggaaatcaggacctcagatacctagggccaggaagtgtgggagatgagcagcagtctcaccatagcagattatcctcactgtgccaactgccatcccctctggctcctatctctctctgccccaaggctttcttagggtcccttactctttgctctagatcctgccgaatatcctccttgccgaggcacttagcgagggagtttagcacatcttttctcttctcctctgtcaggtccttgaggacactctccatgtcctccaacttctccttcatgtttctggaatcctccgaacccaaagactttcctgtagaggcagcaattgagaacctgggccacccagcccaaaaggttttatttctaaggctctgttatttgtctgactgtcttctggagaccacctctttgtatcttcccttcttccagtctttccgtgttaaaattaagcatccttcttccaagatacctaccatcattgcctcccactgaccccacttccatcttccatctccccagctcacccccagtctagtcccaaccccaaattcttctccacttcctggaaaaaaacaaaaacttggttatttggcccttgccattcaaagtgcagtcctcaggccacactagaagtaattaggatttggagaaagttaaagcagtggttctcaaccttgactacatgagaatcacctgaggagttattacaaatcctgatgtccaggccacacccccacaattaagtcagagtttctggagacgggactcagtcgtcactagttttaaagtttcctggtgtgattttggggtataaccaatgagaaccactgtgtttagaggagacagatgcagcctccagactaaagttgaaacctgctaggcagtgcctcccgacttcctacccactcagctgaccccacctgagcagcagtcttgagccacatggactcagggtgggttggtgcagccaccctgaacacacttggctatcacccttacctaaacaggatgaagcaccatccttctctgcagagagaggaagagttatttcagaatcttcagatcacctccagtcccctgcagacttctcttcccagtgatggaagtttttactcttgcaatctgagccctcactgctggtgccagggagcctgcatcctcaccagcgtgtgtcaatgggaaagcactgtatttgcagacccttcccacatcctcaaaaacaggcagtcataggactgtgcctagatgattgaggaagaagccaaggcccagaaagggggcagcatacactcagtcgctccgcaaatttgggtcagacttctctatccctttccaagctctcttaggcagtacaaccctgctgggatcaaggggaaaacctagaaattccagaggaagccacataattcagaatcacagggaccttctagtctcactcctttagtttaaagtcaggaaaggctgggcatggtggctcacgcctgtaatcccagcactttgggaggctgcagtgggtggatcacctgagttcaggagtttgagagcagcctgccaacatatagtgaaaccctgtctctactaaaaatacaaaaaaaagaaaaacaaaaaaaaccaaacttaacttggcgtggtggagggcacctgtattcccagctacttgggaggctgaggcaggagaatcgcttgaacccaggaggtagaggttgcagtgagctgagatcacaccactgcactccagcctgggcgacagagcaagactctgtctcaaaaaaattaaattaaattaaattaaaataaagtcaggaaaactgtgacttgggaggctgtagagctagtgagtggcagggtgggactagaccctgagactgcctgactccagtccaggacccttttcacagccagtgctgtcctgctggaactggccaagtcatttaattgtgcttcctaggccaacaagacttcagggagggctgtaagctcaggatccagctgactgccagcacgaagttgtcctaggagcagcctggaaaccctagtccgatgtgcaatccagactcttcaacaggctaatttttcccctgcgcttgccatggttcccacctgtgggtgcgtcttaccacatcctcggacctaaccactctgtaattccatttttaaaaatagtgtctttgcccattctgaaatgacgaacgggaagcccagcagctcactcaccttctggaaaggattttgttttgcccctgaaatgaatatctaaaccagcaccaaaaagggaggaaaaaacaagttattggagagaccagttatcactctgtaagttccctttctccagtccctctcaatccctataccagcctccaatcaaaaaaaaaaaaaaaaaaagacaactgttttttgtttttgtttttgttttttgttttttgttttttgtttttgagatggagttttgctcttgttgcctaggctggagtgcaatggtgagatctcggctcactgcaacctccacttcccaggttcaagcaattctcctgcctcagcctcccaagtagctgggattacaggcgcataccaccacacccagctaatatttatatttttagtagagacagggtttcaccatgttggctaggctggtctcgaactcctgatctcaggtgatccgcccaccttggcctcccaaagtgctgggattacaggcgtgagccaccacgtccagccaaaaaagacaattattctatttggagactgggagaggagttaatgactcttatgtcatgttcaggcaaatcctgggtcagcgggtccaggtccccaggtcagagcatggagcctcagtccttcctagtgctgaacccacccttttccctggacccctccccaacctccaagctcaccagccacccaccctaggctgacagagcctggttgaatcccaccccccacctcactggtgtgtttagggccccccatcctgttctccatctgcctttgcttactcatcgtctccttgttggggaagacaagctgctttactcgatagctcaggacccgatttggggggatggtcacttccctttggccctagaaaaaggagctcacattgacggatccccaggtgtttctacatcattatcttgcctgatctcccaaacaatcctgtgaggcagtcatttgtatccccattttatagacgagaaaactgaggctctcagaggtcagcaggtgagacagtctcacagctaaaaacagtggcagagctgaaatttgaacccacgtctgatgccaaaactcatcttgttgccactgttcattcaacaaatgtttactgaggagctgctttgttctaggcaccatggctcctgtcctcctacctcctagaaaggagacagacaataaacaagcaaaaatacacctgtgtaatgatgaaccatgggaaatgtacaaagaaaatgaaggctgggtgcgtggctcacacctgtaatcccagcactttgggaggccgaggtgggtggattgcttgagcccaggagtttgagaccagcctggacaacatgcaagacctcatctctatttaaaaaagaaagaaagaaaatgcaaatgaaaagagggcaccgctagagagtaacaagggaaggactgggcaatgccacccaccctttcttggggcaaggtggccaagagcagcagggctgctcggagaggagtgaaggaagagtctaaggctggcatcgccttgacctgcggggtgtgggccaacactggcctccacagtccctgcctcccaggatcctaaccttgtgtttatagctgagatggccctgagagatctggctccaaaatttatattgccggtcgcttttcagggtttcctcctttaccgtctccagagtttctgtcaccagatacaggttttctctcgtattaattgatcggaatgaaaagggtagttccctcttcagcttcctggagagagtggagagagatgagagttaaggatctcagggccttacctcccactgactcttttccctctctgtgagccagctcctattgaagattaatcgcttctgagactggaaaaccaaggaacacagcaccccatcgcagttcactttacccacctcggggtggaggtaggggtggggtacaaagtagggtgagaggccaggtacggtggctatcgcctgtaatcccagcattttgggaggctgaggtgagtggatcaccaggcacacatctgtaatcccagctactcaggaggctgagacaggagaatcacttgaacccgggaggcggaggttgcagtgagccaagactgcaccattgcactccagcctgggcaacagagcaagactccacctcaaaacaaataaataaaaacaaagtggggcaagaattcaccagcatttatggaagattacaatgtgccagctgtgagccacgcttttccacttaaccttcacaatcctatgatggtaggcagaattacgtccactttccatgtaaagatactgaggcttagtgacaggttgtgagtggtccaaggtcacacagctagtaagtgtagagctgggattcaaaccctggtcagtgtaagtccaaagagagtgcccttcccgtgacactgagataggcatctgtgaagcccaagacaccctcttctctgacaaggggctccagctccttgcgctggtccctggagccagctgcatcatctgcccttaggctcatgaagcatcagattccattcccgctgggggaaactcatgttgagacctaaaacagtctgatggagtttctatttgcaatcaaaaggccctcaagacatgggtccctgcctccgatgactttcccctacctatccagtgccccaccccacatacagataccaataccctcacctgacaaacaagcattctataatagaaaacaccgagctctcttagaacaattctgaaggcctctccccagcaatactgtggtagggaggggtaattcaaaggaccagtaaaattttattgtaagcctttgtttttaatttattaataaaaaagggtggcatgggcatggtggctcacacctgtaatcccagcactttgggaggccaaggcaggtggatcacctgaggtcaggagttcgagaccagatctctctccaaaaaaccctggccaatagggtgaatgaaaccctgtctctaccaaaaatacaaaaattagctaggcgtggtggcgggcacctgtagtcccagctcctcgggaggttgaggcagaagaatctcttgaatccaggaggcagaggttgcagtgagccaagaatgtaccattgcactccagcctgggcaacaaaagtgaaactccatctcaaaaaaaaaaaaaggaaaaggaaaagaaaaaaggtacccgctccactcaaggagagcaaggccaggaaaactgtgggtcaccttcccctgagctactcctcaatctccaacaatcccagctgaagaaaacaacaacagaactattgctgaggggatggctagtgatgtcctcttgaattggaagcacctgcccaccagctaccagaacctctgtggcactggatcggtgccaccctgctggggtggggtggctgtactccatgcaggaaacatcctccaaggggttctttgctttcctcgtgcttcacttcagctctctttcactcagtacctactgtgtgcttggggtcaatacagagaggttagtaaagtcagtcccttgtcacaagttgcttccagtccagtgggaaagacgaacatggaagccactggcttgcccacaaggcagagggaaacaagcacaaaatactgatgtgggcagctcagtgcaggagagcagaggagagcaaaggagagtgcctcttaaaccaccaggtttggaggtggaggttgcagtgagccgagatcatgccattgcactctagcctggccgacagagcgagactccgtctcaaaaaaaaacaaaacaaaaaccaaacaaaaaaaaaacaaccaggtttgtccaagtcagaggaattaaccatcctgggggacagcagggatatgagtgaattgggggcatcagaaggcttcctggagactgctcctgggtgaatgagaaggcttctggaggcagagaagaggaaggcgtgcttgcgtaaaggggagggctgagggaatcctggaagtagagagcgagaggctgccctagagagccagtcccccacaaagctcatgaaaagcagggaaaagaaaaataaaaataaataaattttaaaaagagccggtctgccacccttgaatcccttggtgcccaagatgggcttcttcccctccttccctgctgcccaactccaacctcacctgttttcaagggtagccagatactgctgggatatccggttctccgatatcttgattttctgatggtggaagccctggaaactgcctgaaattgttatttctttgggtaatctcactatcaactctcccgttgagtctacattatccagaatttgaaactcagccttttgacctggaaagagaatgataaaggtcactctggagcagacccccaaaagatctctctccaaaacaccctccctggggcagccccatcctgggttccgtgccaccatccccctcccttctgagggagcgccacagctgtggctgtccaggaaatgctgttctcaccagaagcacagttaccttggggtcacaggatcccagatttgagcccactcctccaccttcttaccacatgaccttgggtaagtcacttaacctctttgaatctgtttcttcatctatagtaggagaatattactaatgtctacttcctatatttagggaaattagggctgggcacagtggctcacgcctgtaatcccagaactttgggaggctgtggcaggcagatcacttgaggtcaggagttcgagaccagcctggccaatatggtgaaaccccgtctctactaaaaaatacaaaaagtagccaggcctggtggtgtgtgcctgtaatcacagctacttgagaggctgaggcatgagaatcgcttgaacccaggaggcggaggttgcagtgagctgagatcacaccactgcactccagcctggaggagagtgacactctgcctctctgcctcaaaacaaaacaaaacaaaacaagaaaaagaaaaggaaaggaaaagaaaagaaatgaagaaattaaatataatgatgtagttaagcacttaaccaagtgcctggcatacattctaactgcttaataattgtaagccagtcttgtaggctgaaacaagacaaagaaaagtaaagctaaagaagtaggagccccagccaattgggaaataaaaattaagcagttctgggtgggcacggtggggtggctcacgcctgtaatcccagcactttgggaggctgaggtgggtagatcacttgaggtcaggagttggagaccaacctggccaacatggtgaaaccccatctctaccaaattagtcgggggtggtggcacatgcctgtaattccagctacttgggaggccgaggcaggagaatcgcttgaacctgggaggcagaagcaaagactgcagtgagccaagatcaagccactgcactccagcctgggcgacagcgagactccatctccaataaaagcagttctgtcgctgttgtttgtatgaaccacacaagtatgaagtgaggcaaccctggaaagtcacaaacacgcatggactcggccctgattgatcaggcactaataagggccttggttctgagtcagttgccaccccaggttcgtggaggatgtgtgggcatgccgaaggggctgcgtgcctttgtctccaacctcccagatgggaacctacaggggagggagagctcccactgctaggttttggaggcagggctggatttccaaagacaaatccattttggaactggtggaaatgtgacagaattagaaacagtgactgaaatcactatttgtgtgtacatgagacactaatgtcttagggaccatttgcttcttgagcagtgtaaaagaaaagaaaaatatcagagagaaaaagaaaaataaaaactatgtgcacaaagagtactatatgaagaagaggaaaaagagtaacttctggtagagaaacctgacaaacattacctcagccaagtgatcaaggtcaacatcaacagtgataggtcatgttgacagtacgtacccctgatgtgatgtaataggaatggtcctttacctctgtggtcttcctccccgagacccagaacccagtctaaccatgagaaaaaacatcagccaaattccaacagagggacgttctacagtatccctgaccagtactgctcaaaactgctaagattatcccaaacaggtaaagtctgagaaactgtcacagccaagaggagcctaaggagacatgacaacgaaatgtaatgtaggatcctggatgggattctggaatagaaaaaggacactaggtcaaaactaagataacatgggctgggtgcagcggctcacacctgtaatcccagcactttgggaggccaaggcgggcggatcacctgaggtcaggagttcaagaccagcctggccaacatggtgaaaccttgtctctactaaaaatacaaaaaatttgccaggtgtggtggcaggcacctataatcccagctactcgggaggctgaggcaggagaaccacttgaacctagaggtgaaggttgcagtgagccgagatcgcgccactgctctccagcctgggcaatagagcgacactccatctcaaaaaaaaaaaaaaaaaagttaatgtgaataaagtatggactttaataacaaacacaaaatcctatgcacacttttttttttgtttttttttgagacggagtcttgctttgtcgccaggctggagtgcagtggtataatcatggctcactgtgcaacctccacctcccaggttcaagcaattctcctgcctcagcctcccgagtagctgggattacaggcatgcgacaccacgcccagctaatttttgtatttttagtaaagacagggttttgccatgttggccaggctggtctcgaactcctggcctcaagtgatccgcccgcctcagcctcccaaagtgctgggattacaggcatgcgccatcatgcccagctaatttttgtatttttagtagagacagggtttcgccatgttggccaggccagacttgaactcctgacctcaagtgatccacccgcctcagtctcccaaagtgctgggattacaggcgcgagccactgtgcccagccctatgcacactttaactgcaccatcagcattatacagttacaaaataacccatttaaatagggagcagaccaagctaaaaatcaattcaaattaccaattcccatcattgtaaggattttctttttaagtttggtttcacctctgcctccgaattttgtatgcacacagatgagcttttccttaaaggaagttgactgacttagtcaatttttttttcccagacttaaactttgccctgtccctggggagtaatattattgtggcaaaacatcctagttctgggttaaagtatttttccattttcagtgaattgatcatttggcaaactgatttttttttttttttttgagagctgacttttagcaaattggctcttagcaatttacttttcagagaattgactcagtctttgaaagatgcgaatctgaaatttctccaaaagccccttgcttgcttaacgaaactctgcttgtggaaaggtccaccacctccaagtaatctgggtactgctcttggtcacttaaagcagttcctggcacactgtaatactctaaagctgctcagggctgttagagctcttttccgtctcttggcatgagacctcataaaaagaaatggactgtatcagagaggtctgagctatgagcgccttgctattgttcatattatgaaatattttttcacattatgaaatataatgaactcctcaccatattccactttgggctccaagtgagagttcaacacttaaccctggggcttctgaaacccaagtaccccaggaataactgagatcagaggcagggggttggaataattgactcttccataaattccctcaataccttagggatttctgctcatcagaaacttccccttcagtcttgatagccaaggaacatgaaaggataataagaatcaccaccgacctgggagataacttttattgggtgctccttttgtggcaggcactgtgataaatgattcacgtaatttgttctcatttgattttttttttttttttttttgagacagaggcttgctttgtctcccaggctggagtgcagtggcgtgatctcagctcacggcaacctgcacctcccgggttcaagcaattctcttgcctcagcctcctgagtagccaggactacaggcgcatgccaccacgcctggctaattttttgtattttttttttttaagcagagacggggtttcactgtgttagccaggatggtctcgatctcctgacctcgtgatccgcccacctcggcctcccaaagtgctgggattacaggagtgagccaccgcacccatccctcacttgattcttacaacagtcctctagagttgacacaggaggaaactgaaacttagagcaataaaacaacttgtccaaaggttacgcagctgataagaggcagagccaggctttgaaaccaggtgcttccagccctaaagcctgcatcctttcttaaccagtaagcaaactgccctcatttacttattcatttaaatgataaacacatgagaagagctcgctaaattaaaagcagattattttacaagggaaaaaatggaaaaggaagaccatttaggaacggtttccagtggaaataaatctccacttctcccactctcctcccaccatgcagctcttccgtgcatttcttaaattaaggtgtgtggatgtgtacaaatcccacagtttcgttgttgattggttgataacaatggggaattgagaaggagatggagtacaaacggtcaaggcctcctggctggccacctgtcatctaccttatactgaccttggagcccagaatccagttcatctaaccacttgtccccatctgtgtccagaatgtccatcagggtgaggcctgttgtgtagtgccggcatccaaagaaagttctcttctcccccaccagatggaagcagcggaatctatcagcatcaacaaggcttctaacggcaatcatatcccctccagcatccatctccttaactacaattcttgtgatttcctcaaatacgctgaacattgcgcctggaccaactcagaaacagaagccaatttcagtttttgggaggagggtattggttcaagtatttaaatcttccacatttggcagcctgaggtgtcaggcctctgaacccaagctaagccatcatattccctgtgacctgcatgtatacatccagatggcctgaagcaactgaagatccacaaaagaaatgaaaatagccttaactgatgacattccaccattgtgatttgttcctgccccaccctgatacaatatagtctccccgccgccgcccttaagaaggtactttgtaatattctcccctgcccttaagaaggtactttgtaatatttctccacccttgagaatgtactttgtaagcctatcccaaacatataagaactaatgataatgccaccaccctttgctgaccccttttttggactcagcttgcctgcacccagccttgttgctcatataaagcccgtttcgtggactctcttcacatggacgcacgtgacatgaggtcaaggaagagccaaaggttccaggacaatcagtacctggaatgatttgcctgccttacttctagaacgtgaggcagccatgactcagtaaagagggctaaacatcacagatcccagattctcctctgcccctcatggtacccatctggaggaaaaaagtagcagctattgccccaaatagagaaagtgagacccattttctacatctcccacagcagagttgcccccttgttccaaggggcccaagggatggaaaggcaggcccaccatgccccagccagactagccccaacgttgatgaacagaggaaccagggaggaatgacgggcacggttgccagacttcacattactaacctcaactggtcgtttcttcccttggctctgattcttgggctccctgccttgctgtattctgcaaggcaattggatgggtgcctccctaccaacaatttcccaatgaggtggtggtaaattggcctcagaagaaacaaaagcttcctgggatccacttccccatcctacctttggccaccttcccctatatcccttctgcccagcacaggcacttatccactcactgcttcctcctctgtctctggccccatcatggtggttgactctcagttcactaccaacctgggaattctaggtgtctggaaagacagtacccgggaaccacaggcccatctcaagtggtacccacctcctctctgacctcagctgttcaccagaaatggaagttgtgagaatccccacagatctctgcacagttcctggcctctgaatctcaggaagctaaaataatgaaactgaaagttgtccaggtgtggaacttcctggacgggtgggtagggctgggtgccccacctcccaagcctttagataagccaccttataactgagctggaggcagattaaggccagaaccccccttttttttttttttttgagacggagtcttgctctatcgccgaggctggagtgcaatggcgcaatctcggctcactgcaagctccgcctcccaagttcacgccattctcctgcctcagcctcccgagtagctgggactacaggtgcctgccaccacgcccagctaatttttttgtgtgtgttttttagtagagacggggtttcaccgtgttagccaggatggtctcaatctcctgaccttgtgacccacccacctcggcctctcaaagtgctgggattacaggtgtgagccaccatgcccggccagaaccccttcttcttcttgtacctaaggagtgggtaggagatcctggtatgtattctaggtgagtgtgggccagacaatggtgcacaccgtggcgccctgggccatgcaatccagtgtgtttggaatagagaaatggaatatgagtaggtatcaagtgccagcaggcaatggctgtgtctgtgccagggacatgaggaccataacccagcagaaccagctgcccaaatgccatgcgacggtcaacactgaagacccaggacaacagcagctaacacctggaggcaacagggtgggcctgtaaggagcactcagcctccctccccatctcgtgctcccgtgtacactctcaaggagatgctggtcttccttatctggatgccatctggcttctccacctacctccttctccagggagaggcctctgacctcacccatgtcctctctcagagataaccaccccggtgagcccagcctgtcttccagcctctgcatgcctcagttctgaaagaacatttgaagggatgacaggccaggcgtggtggttcatgcctgtaatcccaacactttcagaggccgaagcaggcagatcacttgaggccaggagttcaagaccagcctggccaacatggcgaaaccccgtctctaccaaaaaaaaaaaaaaaaaaaaaattagccagatgttttggcacacacctgtaatcccagctactcaggaggctgaggcatgagaattgcttgaacctgggaggcggaggttgcagtgagccaagatggtgccactgcactccagcctgggcaacagagcaagactcagtctcaaaaaaataaataaataaataaataaatagacgacagtggtggtagtaacaattacaattataataatatggctaccatatattgagtatttactatatgccaggcactgtgctaatgctcacaacagccctaagaggcattatctttacacaacagtggaataaactgaagctcagagaagttgacacagcaacatggctaataagtggcaaagctgggatttgaacccagatcgttgttgatgttctccagcacctcaccctgactatactcttgcaggctggtgaaagcaaccagggcacccctactcccaggagtgaaagcagtggctatatttctctttccaatactgtgtgggctctactcggacaggggtggtggctggacttgggcaaatatcccacactccctgacactcactccaagggtgctgtgatggtggaccggggctagagaccccaggctgctggggacagctcctcccttctacctgggactttgtgcctctcctgggaatagcagctgatactccccagaacacgctggaaggtcagtgccctcgtgagataaggattccttgctataggactcctctctctcctagccatgttggcctcagaaagtccccagaacctcttcccctgccactcaggcttatggtgggaggaggaagtatgaaaagtcccctccactgaaaggccagaaggaaacgcagcgctcccaagggagaggtgactggggaaaggccttggggagagaagtgagaaactggagaagggctggggattcactgggaaggactgagcaccacttgggaccctggctccacgtgtaaaccattgctggagtgtccccctccttggccatggcacaggtcaccccagcctctggggccaaggcgcaagacctgtcggagaacagccaggcaaaagcacagagaattttgctctctgactaccgctgccgccgccagttccctcacagcccccttgggggatttccctgctgaagccagcagaaagcccagcagtcccagcgcccctcctgccaccgtcagagctgcactgatgccccaccagcacctcagcgggagccgctgcccacacccctgccccctcccctcagccttccaggaagcgaaggccagacacagggaaacagaaacatgttgcccttttatttgcgtttctcagaatactgtacaaagggagtaaaaatcctattcacactttgcttagaaagattttaaggtgaaagttccctatgatacacggggtgggagatgcagggtcaggagggagaaaacaggcccagtgacctctcccgttcccttggacccctggaagaggacacagggacccacaccttttcaaaattaacactgcccctagtccaactggggaggggagaaggctccagcccaggctcaggctcccggcctcactttcttctctgcaggctgagacagtgcctacaggccacgtcttgccccttcctctgtgctgcttgagcagggatcctacaggactctcaccacagaccccacatggggtggcctcacaacgccacatgtggctgccacatgagaggccctgcccagtgccagtctgtatgaggaagttaaggggtgagggcctgcagaggaccacagcacccatcgtttctgtcacagcttccccatacccccgcaggagtcagggccaagttggacctgtgcttacaatgactcacgggccttttccccacctgtctacccaacagccaacccaggagttaaacccacagcagcctccctcccctattactatcacattctgtgggtaaattaaccctccaagcctgcttccctccctgcccacatcccaaaggagattgggtctagcttctgtccctacccctccctcccttacaccagtcctctgctgctatgtggccccattcttctaagtctcgactcactagctctcctacagctccccaacctccaccaggccaggatggcagcagccctggccccctcacctctggaaccaagccatctacactctaccccatctttccccaacctgaccctccccactcccaaccaggacccacggtgggttgcagagaagctgccaaaagcctgggacttggattagacagctccctacccagaaaggcaaagacccatcccacacttgcttccatacacaaaagcacacactgcgtggcatcgaaaaaacctaggaatcacagtgaaacaatccagaagccgtaccgccctctgctccctatgcaggggttaaagtgctttggctgcctgagggcaaacaagtgagcaggggtttttcccctggcctcctgtcgcaactgcgtggtccatgttcagcccaggagcccagcccattccatgaccaactccatggagtctctattcaaaaagcaaaaggaaaagatcaaaaaattcagaaaaggtcagagcccagggggcctaccccaaccccactacaagctactccaagttggctactgggggaagcgaggggggaaattaggccagaggctcaacccccatctctggcagtgtccagaggcttcttctttctgtcttcagtgttgcagcacatgccttttaccctacccctcccctgccaccctgggcaggggaaggggctgcactctcagtacttattgattccaaaaatccggactccgtggagctggggcagcttggggataagcacgctcatcagggacacggtgttgagcacaaaatggatctggtcgtacttagtgtagaagctggtgaggaagtacctgggaggggaagggtggggagagatataaaagactgttgggaggaccccttcctccctcacttcctgggaggggaaaggcagaatcccaacagctaaggagttacagaagaggttcccagaccagcgtaagaagcaagagctctcaggctaaaggggcccctcctggcccagtaccgcccccacctcccagcttcaccccaagcctgtaggcctatctcactagcaggaaggaagctccaatggaggaaagatggggccagggaggcccaaagcctgagtccagtgtaagacccaggaatattccaacttcctctgttcatccctacaccaggagccacggcagggttaataagcatggctgggccctggggtcctccaggccttgccctgcctgctggtgtcttcctgtagcccaggcactcacagcacgatgggtgtgatggtcaagaacttccgagaggccgtgaactggaccccataatccatctgctcccagtgggttagcagcctcgccttgccctggtccggggtctcaaagggtgtccccttcaccgtgtgcaggaagatatacatgccctggaggaagaagtctttgttagaggatacaaaagggaaaggcccccctgcccagctcctccacccagtcacagacacaagtaactcccagtgatctggagcctccctctgctgggcagggggatatgggctggaggtcaggatggagcagctgggagtatggcaggagaagaacaaggggactccctgggggacgggctaggcctggcatgagaatgcacggtggaagttggccacaagataggcaccgagatgctgcccccctccaggccactcatagccccctgtgcctgttgggaggaggcaagcgatgggactaagccctgcttacccgacaaagagtgcaaggtagcaagtggtgagggagcagagaagggcaaaagtggaagacggttcgagaagctaacttgagaaaggggcatttctgtatcagcctaggcaccaggactctcgggtcctgggaactctctggagccctttgttcagctctcaggagcacatcttccaggccaacagccaccccaccctagagatgtggaaaaatctgcagatttgattcctgtcatggtacacagggcaggaacccagaagggggagcaaggcagagaggtaagggctaggcctgggctctggaggcagatgtcgtcagtacatcaccctgacacctgggccaggcccgacaggctcctcctatccctcagccctgccaaagggcagcccacagggcaggggcaggggcaggggcaggcagcagacaggctctcaccatgttgtgaatgaggttggtgagggtccagacgacagggacactcacaaacgggatgctcagcagcacgatgtggaggagaccgatggccagcacgtaggagagccagatgccacggctgttcatcacccgcgtgttggggttcacctcgctgtgcgctgtgcccacattcatcctgctgcccctctctgctgttctgcaaacaagcagcacaggtcagacaggtcacactgctttccctgccccctctcaccctcggatcccgctgggaggcaggcccttgtttccctgagaactccaggcagttccactcttttgattctgaagcatggaaagtggagaaagtccatgtggacttagctctactcatttcctgctgctgggctgggataaacaacaggctgccccatgcatcatcccattgggacagggccctggcagggcatcggaggacaggtcatcaagaggcacgcagccccagggcagagaagtcaaggcccatcccccagcctcaccccctatggcactcccatgaggaccctctgccgacaaagccccagggagagaattctcactcagcacaacccctgctggactgtgtctcactgaaggcctaatgtgggacatctgctcttaagctcttcccatcaggagggaaaggaagtgaggcctgtgggtacaggcagcagtggatgaactattttgaggtcactgcatccactcacctcctctgattttttcaattctggatctccccaaaccccaacttaggaggactgatcaggtagaaagagggaagtggggagggaggaagggaggaagaaaggagaaaacaacagactagggacaacctttgcccagacctagaaggcacccctcctgggtgacacaaaacaacccatccggatgttttctccatttggcagccactcaggccaacccttgtgatgctacccactccactgccaaaccaccagggcccttttccccacaagagaggcgaggatagagaacgtggccaacacctgtaactcccatagagagctggaatccacctcaacatatgtctcctaagggcacagactcgaacctgtggcctccctcctgcccccgttcttctctgtcctgcccatcctcacctcagtctcccctctcagcacctgtttccaggtgtatattagcaccatgccttcccctgcccagcaccaacggtaggagtcctgcagcaggaggaaccaggaggtggccgcaacccacagtgagcagagggaagtagagaaggaaggggtggaatgatctgccccttatccagagtttggctgtccccagatccctgagggccctgtgaccaggagaaagtggagacagatggcacctgtgtactggctcacctccctatctgagatagggtcctgcttgctaaagaccgtaaggtcatcaccatggtaacagccccatctttcctgggaatgcagaaaagagtcccagatggagatattctagaagtacccagaaggccacctccctcacgcccctgcagcaaccccgtcagacccagatgctatctatctctgactaggatcctagccaaacctgcacaggagactgagtcctcaggggccagttatttacttccaggataacaggagcaagtttcctcttctcagacagctccaagcttagagacctcagagaaaatgtgacccacaacacgccatcccaacaagcaaacacccgtgcgccagcctggggcgcattctgattgaagagatgctcctgggacccatcagcgcagcccactaggctggataattgagcctaacagaaattcaagtatctagaaagccagagctggctcagattgtttatcttcccagggccttggggcttcagttactctagcagcccctgggacagctgctacgcaaaagcctccacctgagaggggagggcggcatgtggctgacaagtgagggctctgaaggacttaactctgactaaggagagggaaagagcttcccaagtctgacctgaaactgccaccccatcacctctctgtaacccgcacctacaggggtgctggtatagaaagtccactaacccttcctagtatttgtccaggagtgccaaaagccttggggaatcccagatcacaggaccccatacgcctttctggctttcacagggcagccaacaaaacttgatgagcctaggaaaagcctagacctaggtcctagccaacaccctcagaagcttcttcctgaagcctaaacactaggtgccctgagagcaggaaaccaccagagacccctgaaaaagaagagatcaataaactaacaaaaagactggcaatgaggaaacactcttgagactttcgtgtgactatggatacatatcacttccattagtaaaacaaccaactggcccctaccctagatggggagaaacagagagaagaggctggcagaggtcgactaggtctacaggagttgagccgaaaacttctgctgccatagctggcaggtggctgcttagtgctgggccctgatgtggtttcataacctgcctcaaaccagagcctgcagcaactctgttgtgttaaccacttttttgctggtagctctttccccctccttcccgccccaccctcttggctccacatacaaatatccgggcccagccagtatgccagacactcaagccaaggctgagcaccaccagggcagccaccaggtgagcccttcccattccctcccccaggaaagagcagccctcacaacagcaaacctcctgtcttctggaagaggagcacaaaacatccaggcctggatggggaccccaacggggagtccggggcagcacgtcacaatgccatgtccattccgcccaccccccaagctgcaggaccacagctgataacctctcaactttggcccagccaccccgactgggggagggcggtaggagcggaaagcgagtgcccaggcgaacccgcactaagcacaggagaggaggagcgaagaggcggagtcctcactgttgttggggttttctgagtgagacctcgggtgcggggccggggggaggggtcccgctctgttccccagcctgggtcttcgcactcggaacccggtccggtccgggaccccacagccatctccacgcgttcacccagccctggaggcagccaaacgtttatccccgaagccgagccgctccccgcctcccacccctagccgaggcgctcctcccgacgttccacccccggcctcccgctcgcactttattccttggccacctccccagccgatgcaccccctcggctgatgcactccctccaccccccactccctctgcccccgtctctccagcccggggcgcctccccagcagcccccaccttctctcccgcccctcccgtagccctggggcctcttggttccttccgggctcaccgtgtggggccgaagatcaacggcccgggaacggttcccgggagcgggggccgctgctgctccagcagctgtaacaacccgcggctgcagcctccccgctggcagctccggccgaatcagcgctccgcgccggtccccgtacgtcaccgccccgcgccggcacgcccgacgccttctgggagttgtagtttcttccgctggctccgggccggccctcccgacgcctcctgggagttgtagtttttcctgggctccgttcccggcctcttcggggacgcacggttggaagttgtaccgtgacgtgatggtcagatcggatgatagaattttggtgcgtaacaattccaacttttgcttctgtgcccttcaagtgtattttatccgtgccccagttttgcagatgaggagactcggacttgtaagtaactttctgtaggtctttgctgggtcctagactggatcgaaacccaaatattctgaccccaactgcaggatttttccactgcacctggctgcctccgccctggccccagattggctcctccagaaacagactagcccggccctttgccctgctgggccctcctgggagagcgcttttcacaacattggctgggatgagggtctggagggcccggaacggagcctgccttctccttctcagtcacgcttggcccaggctgccccggaccgggccacatccttggccgccccgcacctgacgtgagaagaggctacgtatcatagattcctccatcagtagtaaggagcctgagtttctgtctcaggtcagcttgtgtggctttgaatgagaggctctggtctgcagttttcacatctgcatcgtctaaaggcaagggcacagactttactgcctggtagacatggggtaggccctcctttattggcagtgtgaccctgggcaaattacttgtcttaatctccaattccacacctgtgaaaccccacctccaaggttgtgggaacccaaaagaatgtatgtaaagcacctgttgcattgtaggaatctacttaatattactgtaggaggttgaactaaatggctcttgaggtctcctcggttactcccattctccatgtcaccaagaggtcttgtctgggtagtttcaactccttacccagcttctttctaagtccactctatgcagggcagggctggaatagcaaggtcagatgatgtcatggcatgccaacctgactctgaatggcagttcatggcaccctgaactgaaagtgagggaacaggaaggaaaaggctagcccagggaaactgcggagcactttactcggactacacctacctttccttccccagggggctgccaggaaacagttgtcacacagctggagtgggacccccagaggcacttagtggtcaccaggcaggtgggtatttgaaccacccagagcagaacaggcagcttcttcaatatttccagggccaatggccccaaaagggctcattccaagatcgaaataatcatctgagtctgaaatagctctgcctatgtcctgtggaagtttctcctggtttgtggaggtgcctttccttatagtcatctttctgcagacataagcaaacccagtgttgttcttttcacagaaacctccccagcattaaggcaagaaaggtgtctctgttttttccgaagtgtgcctgcttgactcctttgatttttctctgggattcttcatcctccatcaagttgatcgatccctctggatcttggtcagtttcctgacatctctatgaagttcagtgacccagactgagtccacgtctcaaataaggttctgactaatgcagagtctaacagaaagattactgaacatgtcatgcactattaataactcctgttatcgaggatttttttttcacaataggaatgaacagagttctgactcactctaggtttgtggtaaattgcagatcactttctgctttatttagcgggagtccctgttgtcatctttctccttctctcttggccctcataattatcatatcttccccaaacgttcttcagctgtgaatagccctaagcactattcagagtgagtgacagctctcttatttcgtgctgggggacatacaaacccttggacaaacacttgtcactgtgtgccaagaagctgaaaaattcttcttgcctcagagccataattacacttttggtagcatattctaaggaagtcatcccatgtacaggaaaagctgcaatgtgtcaggatgttcattccagcaatatttatagtagtgaaaaactgaaagcaaccaaatgcccaagaaaaaaattacagtatatccactggatggaatagtatgaagccatttaggacagattgtgaaaaccctgtggcagtatggggaatgtttgctaagttatatgaaaagatgaggacacaaaatagcataacatacattccccagggatatagtcagcaaagtctagaatgaagaaaattaggacaaacacccaattcccttaacaaataaaactggggccaggtatggtgactcacgcctgtaatcccagcactttgagaggccaaggcttgtgtccaggagttcgagaccaacctggacaacatggtaaaaccccgtggtctacaaaaaatacaaaaattagttgggcatggtggtgtgtctatagtcccagctactcaggaggctgaggtgggaggatcaattgagcccgggaggtcaaggctgcagtgagctgtgatcgtgccagtgcattccagtctgggcagcagagtgagatcctgtctcaaaaaaaaaaaaaaaaaaaaaggaaaaaaaagagggggagagacttacagattaaaataaattaaatgatatatcaactaaaagtcttatttggatcctgattcaagcaaactgactttaaaaaaaaaaaaaaaaaaaaaaaaaaaaaggccgggcatggtcacgcatgcctgtaaccccagtactttgggaggccaaggtaggcggatcacctgaggtcaggagtttgacaccagcctggccaacgtggtgaaactccgtctctactaaaactacaaaaactagctgggtgtggtgatgggcgcctgtaatcccagctactcaggaggctgaagcaagagaattgcttgaacccaggaggcagaggttgtagtgagccaagattgcaccattggcactccagcctgggtgactgagcaaggctctgtctcaaaaaaaaaaaaaaaaaaaaaaagattttattaagttatcaggcaaatttgaatactgacaaggtattcaacgatattaaggaattctaaatgtttaggcgtgatatggaattgtggtaaggttgtttttttaatttaaaaagtcctccatggctgggcgtggtagctcatgcctgtaatcccagcactttgggaggctcaggcagacagatcacctgaggtcaggagttcgagaccagcctggccaacatggtgaaaccccgcctctactaaaaatacaaaaattagccaggcgtggtgacaggcgcctataatcccagctacttgagaggctgaggcaggagaatcgcttgaacccaggaggtggaggatgcagtgagccgagatcgtgccattgcactccagcctgggagacaagagtgaaacttcatctcaaaaaaaaaaaaagtcttccttggctgggtgcgttggatcacacctgtaatcccagcactttgggaggtgaggcaggcagatcacaaggtcaggagtttgagaccagcctggccagcatggtgaaatcccgtctctactaaaaatagaaaaaaattagccaggcatggtggcacgtgcctgtaatcccagctactcgggaggctgaggcaggagaattacttgaaactgggaggcagaggttgcagtgagccgagatcataccactgtactccaccccgggtgacagagagagacttcgtctcaaaaaaaaaaaaaaaaaaaaagtcctcctttcagacatacatacatactaaaatatctgtggatgaaatgatacagtgattgcatttgcttcgaaataatctggactgggaaccatagggaaataataagatgagccatgaggtgataattatggaagctgtgtgatgaggacatgaagttccttatattattttctatactttttttttttttttttttttgagacagagtctcactctgtcacccaggctggagcacagtggtgcagtttcggctcactgcaacctccgcctccctagttcaagagattttcctgcctcagcctcccgagtgggctgggattacaggtgcacgccaccacatccaggtaatttttgtatttttagttgagacagggtttcaccatgttggccaggctggttttgaactcctgacttcaagtgatctgcccaccttggcctcccaaagtgctgggattacaggcatgagccaccacgcctgggctattttctctacttttttaatgtttaaaactgttcataataaaaagtctaaacctgcatatacgttaatgattaagataagccaaaatagagcagcactggtaacatcctctggcaccagactgccagggttcaactcgcagctcctctagttaccagctgtgtaaccttaagcaagttactgaacctctctgtgcttcagttacctcgttgctaaaagaattggcaagtgacactggtgttcggaaaaaataaagtaaatgaagatggcgatgatcatgataataccctcctcatgttgtggatattaaatgggtcagtaaatgtgaaatgaaacactcaaaacaattcctggcacataattaagtgctcagtatgtgttgccttttattaattcattccacatttgaatgatatttgagcatctactttactaggttatggaaattcaacaaaataaaaacagaccttgggccgggcactgtggctcaagcctgtaatcccagcactttgggaagctgaggcgggaggattgcttgaggccaggagttcaagaccagcctggcaacgtaatgagaccccccccccacccaaccaccatctctataaaaaacaaaaataaattagccgggcatggtggcatgttcccgtagtcccagctactcaggaggctaaggcgggaggatcgcttgagcccaaggaattcgaggctgcagtgagttatgatctcgctaggaattcgaggctgcagtgagttatgatctcgctatttcactccagcctgggcaataaagcaagccctgtctcttaaaacaacaacaaccgggcatggtggctagcgcctgtaatcccagcactttgggaggccgaggcaggtggatcatctgaggtcaggagttcgagaccagcctggccaacatggtgaaaccccgtctctactaaaaatgcaaaaattagccaggcatggtggcgcgcccctgtaatcccagttactaggaagactgaggtgggagaattgcttgaacccgggaggcggaggctgcagagagcagagatggcgccattttactccagcctgggcaacaagagtggaactttgtctcaaaaaataaagaaaggaaggaaggaaggaagaaagacaacaacaaaaaaaccttgaatcaggatgaagggatttagggtgatctttttcattctctagtttcaaacttcacgtaatgtggtattacttttaaattttttattaaaattgtttaaaaacaaaatgagtctgccacaggctctttctgccctctgggagttccttaggctgctgaggtagacacattccccagcctcagtgtgctttcatctggtgatctgggagtggtgatcgggcctctgcttgtgagacatacaccgtcttgtgggctgagataggttgataaacaaggaacatgttcctgggatgctgctggccgtgttcagaagctgggagaagggatgtcaagaaacagtgcctcgagctgggtgcgatggctcacgcctgtaatcccagcactttgggaggccgaggcgggcagatcacgaggtcaggagatcgagaccatcctggctaacacagtgaaaccccatctccactaaaaatacaaaaattagccgggcgtggtggcgggcgcctgtaatcccagctactcaggaggctgaggcaggagaatggcgtgaacccgggaggcggagcttgcagtgagccgagatggcgccacagcactccagcctgggcgacagagcaagactccgtctcaaaaaaaaagaaaagaaaaaagaaacagagccccttcccctgggggaaagaataccacctctccactcctactcctcccctcctcccccacctgcttcctgaagggagggtggtgaggtcctgtccagagcaagtgcaaggaaggaaagaactgcttatttcattgacagttgtgtttttatttttgtttgggtgggggataccccaggcatgtggtgggaagaaggagggggaggggaaggcagatgttaagcagacaaaggagcagcgaatgaccctcctgagaactactgagccagtcagaagccaggagtgggtgcgggactggcagcatcgccagcgggcactctgttctgcctccctcgcccagtcctgtagttggctattttgggctgtggagagaaagggctgaactggtcagggccactgggtccccatcccccagcctgtgcctgggaacaagaacctccctggggaaccaagtgcagggaggtaccttaggaacccttcaacctgcatattctttgatatggacaattgacactctcccatgaacaaaagcagttagaaaactgaaaatatttcagatcaaaagggcaatggatataaaaacagtaagttcaagacaagaccccctagctccctaccaactgagttcctactcctagcctcacctgtctagaaatctgggtggccaccgttcccagatcaccttcttctgcctaaggccagctcctccctcagtaacaatcacagcaaacattattgtttgctatgttccaggcactgggcaaagggctttatttgtctgttacagaaccacctccccctgggctgctagacttgctccctgtctcacatttgcatttcccgaacagagtgaattctcaataaatgttaactgaactatgtaacggaactgttaccagaaaggggtcccgatccagacaccaagagagggttcttggatctcacgcaagaaagaattcagggtgagtccacagtgcaaagtaaaagcaagtttattaagtaaaggaataaaataatggctactcaacagacagagcagccccgagggctgctggttgcccatttttatggttatttcttgatgatgtgctaaacacggggtgggttattcgtgctcccctttttagaccatttaaggtaacttcctgacgttgccatgatatttgtaaactgtcatggcgcggctgaaagtgtagcagtgaggaccaccagcggtcactctcattgccattttggttttgatgggttttggccagctcctttactgcaacctggtttatcagcaaggtctttatgacctgtattttatgccgacctcctatctcatcctgtgacttagaatgccttaactgtagggttcagcctcattttacccagcttctatttaagacggagttgctctggttcacacgcctctgacagaactgcacgtcccagaccacagccacacagctctcccttgttcttgcctcagcctcgtacccttttccatctgatggactcctatacacccctcaaggcctacctcacctgtcaccttctcggtgcagccttccccagtgtccaagcagagtccactgcttcatcctccaggctgctgtgaccctggcggatccctcaacccaagccttcccttaggtgatcggagggctatatttgtgcacacaccagtcttccctcattggctgggggacatttagttctcagccaggcgcggtggctctacacaaaaatacaaaagttagctgggtgtggtggtgtgcgcctgtagtcccagctacttgggagggtgaggtgggaagacggcttgaacccaggaggttgaggctgcaagtgagctgtgatcatgccactgtggtccagcctggatgacagaacgagacctgtctcaaacaaaagaaaaaaacaactctgaatccccaatgcctaagaggccctggtacacagtacatgctcagatatgtgttaagtaaatgagacagtatctccaagcatggcagcatgaagtgtatgtatacaccccttgctcttttctacagggaacaacaatagcagaggcctttgttgccctctccgcgaaactgcccagtaacctggcattagacgggtccctggctgacctgataaagaaggtagcccttccttatctatcttctctatctatctatctacctacctatctatctatctttttcctttcagttatccccccatccaggctggacctggaggtctccaacatcagggagggaaggggatggaggcctgctgaacttctttcccctgtggtcacatattggggatatagagttaccacccttggagggaggagctgtgactcagactgccgagggtgggaggctaagaggctcactttcctgagccctgaacttgggagccagggccctgccatgcctcagtctcttccctgcctgccattctagacacgtggagcatcaggctagaagggatctcagagactgtgagggtccagaaaacagaaaggatgtgccccgtggcataaacatctgctggtcttgggcctagcccgagaattttcccaggcacttcacaggccaagacagagcgtgagactccccggtgatggcttttccagacccatgccatgtgtccctcaggtctttatcatctcacacctagacctttgccataactggttttcctgccaccaatacatccccgacacaaccaacagagtgatccagacatcaaatctaattttaaaacctttcaatccgaccagatgcggtggctcacgcttgtaatcccaacactttgggaagtcgaggagggtggatcacttgaacccaggagtttgaaaccagcctgctcaatatgaccaaacctcatctctacacaaaaatacaaaaaaaaaaaaaaaaaatatctgggcatggtggcatgcacctctggttgtaatcccttgggaggctgaggtggaaggatctcctgagcctggggaggttgaagttaccgtgagctgtgatgccaccactgcactccaggctgggagacagagtgggaccccgtctcgaaaaaaataaaaataaaaatttggcctggcacagcggctcacacctgtaatcccagcgctttgggaggctgaggttggaggatcacttgcggtcaggagttcaagactagcctggacaacatggtaaaaccccgtctctattaaaaaaataataacattaataaaaaaaattggctgggcatggtggtgcacgcctgtaatcccagctactcaggaggctgaggtaggagaattgcttgaacccaggaggcagagattgcagtgagccgagatcaagccactgcactccagcctgggtgacagagtgagactctgtctaaaaaaaataaataaataggccgggcgcagtggctcacgcctgtaatcccagcaccttgggaggccaaggcaggcagataacctgaggtcagaagttcaagcccagcttggtcaacatggtgaaaccccgtatctactgaaaatacaaaaattatccgggtgtggtgacgggtgcctgtaatcccagctactccggaggctgaggcaggagaatcgcctgaacctgggaggcagaggtttcagtgagctgagatcatgccattgcactccagcctgggcaacaagagtgaaactccgtctcaaaaaaataaataaataaaataataaaaactaaataaaacctttttaatccataagccacggaatcaagtcccaatgcatccatggcgtgcaagccacaaggatctgctccctttttacttctttacccctggcctttgccaccaccccctccatccacgcagtgatctggaagccaagccatttcatgctcccttgctcttgcacattctgcttctccacctgattaacccagccttgaaagcccagatcaaatgtcactccttggtgaagccttccttgattataccctggaaaagctagtgtacagttaaggatgctctcagcagaaatcaacagaaaacccaaataatgattcttaccctaggttgccattagaatcacctgaggagcttttgaaaattcccatcacctggccaggcacggtggctcactcctgtgatcccagcactttgggaggctgaggcaagtggatcacctgaggtcaagagttcgagactggcctggccaacatggagaaaacccgtctctactaaaaatacaaaaattagctgggcatagtggcgtgtgcctgtaatcccagcttcttgggaggctgaggcaggagaatctcttgaacccaggaggcagaggctactgtgagccgagatggtgccactgcactccagcctgggcgacagagtgagactctgtctcaacaagaaaaaaaaatctccattaccagacacatgccacatgggtgtacccaggcatcagcagttttcaaaactgcctatataccagtgtgcagccaagttgagaagcactgaagttagggggttttctttctcacgtattgagtctagaggtggcagttgctggtgttggttgagtagctcagcgatttccaggccaacatctcagtaatactcaaccctccctttatgctttgttgtctcatggccacgagatggcctgagttgaccctttcatgttcaaagtaggggccaggcacggtggctcacgcatgtaatccccagcactttttgcagggggccaaggcaggagccttaggagtttgagaccagcctaggcaacaaagtgagaccctcatctctacaaaaaaaaaaaaaaaaattggctggttgtggtggcacatgtctgtggtcccagctacatagaaggctgaggcaggaagattgcttgagtttggtagggggtcaaggctgcagtgagctgtgtttgcattccagcccgggcaacacagtgagaccctctctcaaaaaaaaaggctggtgcactggctcacacctgtaatcccagcactttcagaggccaaggaaggtggatcacctgaggtcaggcgttcaagaccagcctggccaacatggcgaaacctcatctctgctaaaaatacaaaaattacctgggtgtggtgatgcaggcctgtaatcccagctactcaggaggctgaggcaggagaatcacttgaatctgggaagtgaaggttgtagtgaagcgagatcatgcaattgcactccagcctgggtgcactcagagagagactccagactctgcactccagagagagactccatctcaaagaaaaaaaaaaaaaaaaaggtagggagaggagcagagcccagccctatcctctcttaccagcaaatcaaagactgtcccacaaacctattctgcggacttctgcttagatgtcattgaccagaattgggccaccctcagctgcaaaggagattgaagaagtaggcaacaggatttctgatgggctgagatcaatcaggttgaatcatcaaggactgagtgcattgccactcccaaagccatgtgtgttaatctggtagtaggagggaagggatgattctgccatgttattaatacttattctctctctgtgcttcacagctccctgtacaaacatcaattaatgcaggcagcacatcaaagcattgtggagacatgtctgtgcctccctccagaccatcaattctcaactcaggctgctcgttagacatacctgaggagctttcgaaagaaaccagtgcctagaccccatgcacagagattttaatgtaattggtccagatgaagccccagcataactaatctgtaaaagctccccaagtgatttgaatgtgcagggtgttttgagaaccctgccatagacccagcaccttaagaaccctgtctatgtccccttcaactagcacataaggctcacaggaaatcctcactgaatgaataaacaaataaatggatggcagagaatttctgctccaattctgcagcccctagtgggcagtgtgcactgtcctaagtgtggttcctccttccccccagatctccctccttcaccgagtttgcactcagactcccttaattaaccacatctgcagctccagctgggctcctgcttctcccacagctgctgtgctggacaccctagttccactcttttcctggaagctgccctagtcttagaaggaaataaccctccatcaacagccaggctcaattcttgtgcctcagttaaagcccctgcccagtgtgagagaggaacagggggaaagggaggattgctcagctttctgtcccacattcagctacagtcccgaaatggacaccaagtagccagcagcagagtgtccggccctcagagaaaaggtttgcttgttgcttctcctgcctaagtgtagaaagttatctgattccttagacaaatgtgagtctgcaaaattcccctgttgacatcacaggaataagtctgtggtgagtacatcctcagagatgatatcatctggcatcctaccatctggtctggtccccatcatgcttctgaaactgcttgttcaaaggtaacctacagggccagcctcacaggcatgcggctgacgaggtcccacaagacctcatgccctgtgctcacaagagctctgcacttggttttacactctgctgctgtcgtcatcttaaaattcttttttatttttattttttagagacagagtcgcactctgtcacccaggctagagtgcagtggtgcaatcacagctcactgcagcctccacttcccaggctcaagccatcctcctacctcagcctcccgagtagctaggactaaagtatgcaccaccatggtctgctaatttatttttctttttgtagaaagtgcatttggacaattttttttttttttctggagagacgaggtttcactatgttgcacaggccagtctcaaactcatgaggctccttggtccttggcctccgaaagtgctgagattataggcatgagccactgcacccagccttgaaattcttttttttgagacagggtcttaatgcgtcacctaggctggagtcaagtggcacgacccaggctcggtgaaacctctgcttcctgggttcaagtgattctcgtgcctcagcctcccaaatagctgggattacaggtgtgtgccacctcagcccagttaattttttgtatttttagtagagatggtgtttcgccacattggccaggctggtctcaaattcctggcctcaagtgatccacccacctcggcctcccgaagagctaggattacaggcgtgagccaccatacctggcaaggccttgaaattcttaagttttcacctgggtgtggtggctcacatctgtaatcccagcactttgggaggccgaagtgggtggatcactagaggtcgggagttcaagaccagcctggccaatatggtgaaaccctgtctctactaaaaatacaaaaattagccgggtttggtcggcaggcacctgtagtctcagctactcgggagactaaggcaggagagtcgttttaacctgggaggcagaggttgcagtgagccaaggttgtggcactgcactccagcctgggccacagagtgagactttatctaaaaaaaaaaaaaaaaaaaaaggaagaaattcttaacaggtttttgaaacaagggacccccccacacacaccccatttttattttgcactcagctctacaattccgtgtccagtcctggtcacccatagtcttccaaaatccagcaagaaaaatccttctcagaaaggtctccaatgcgtatgacctcatcttccttcgtgtaagtatatccacccctagtctctgtgacaccccactctcctgttctcttccacctctctgacctggcaggagggcttccaggttccgtacaatacaataccgtgggtaccatcaggctcaacgtgcaaggatgtagggtattggtatgtgtggcagagaggcacagaggtaagagctgctagcaggcaatggaaagtggttggacaaggagttagaaaactgggctctggtctttggccactgactcattgtgtaactctggtcacattctgggcctcagtttaccggtctgcaaactaaggagggatcaactggctggtcccttcctttgagctctatcaatcattgaggctctgaatcccagcaccgaactggagatagtgtgggtaggatggtgccataggaggcaccatgtggttggacttgagggtcaagggagttgcaggggataagccaccatgggctaaggaatgagatgggtcatccacatggatcacatctatgaccctttgtcacctctgcccctgcacagcatacgagaggaggtgaaggggaaaagcctggcgtgggtaatgaaatcatggaggaagaccatgatgtgttctggaagtcagtaatcctaacaactagcctttgcacagcacttcacaaagtaccttcacatccactcaaccctggcgggtcctcccaaccctgcagcagtgtcaggtgacatgcccaggtcacacactaatctcatcttctgccttgaaatccttccttcccactacccagtgaacattaggagagggtggtatcacggagtggcgtggcctgcaaatgatgcctgggatagggacaccctgggggaacaagtcatccaagccatctttggtgcccaggcctgagggagagttcaaagtgccaacctgagagtccagggctctagcaaactgagagaacctgagtcagttctcatccagatcataaaatcagcaggaaaactcagagatgaccacatcaggcttcaggtgccttaaagaactccttccaactcctagagaagcaatcaatctaccacgcagagaacaaactgaaattgaaccacagcacccctggcaggcaggaggtctgggcactgcgaggagccaggaaatgaggaaccctggacagacatgttttccaaggaaagactaggggaagtttgctcaccgtggaagaaggggccaccgagcatggaagaatgtgccatggcgtgaaagaatggcagaagggagtagggagaggaatggagttgggggaatacaggttgctggagacactggatgtgagatggggcccacccagttctgcccgccaggcctgccaagcagggatccttctgcccagccaggttctgggtaaggaagaggagttctgggaagcagtttcagccttggggagtgagggaagatggcagcatcaaggccttgggaggggagcctggtgcagggaatggaattgggtcctggtctccccacaacagagttcatcagggtccaggatctgccctctcttggcattgcctggccacaccatggctcaggtatccgacacctgggcccagagtcacatgccaggaaacccaacactcttgggtcccagcccccaacttccagcagctacgagcaaacagggcttctggaggaggaagcgggtctccagagcccagcagcagggagcctacgtccagggacagggcatctgcactggagaaggctctgccaccaacaggggtgagaggaatggaggaggacggggaggaggagggaggaagtacagagcagagaggacagagctggggcaggcagaggggtggatgctcccggaaaaggggtagatgggcatagaaggtggggccagaggtctattttacctagtcacctggcctagctggatgccctgacaccctgtcgctcatccgtccccttgtctccatcacgcgagtgccaaccagaccctctggtgcctacctagcccacttggcagccacccaggtaggtaggggaagaagactttattccaatgagagaaatcaacacatggacagaggcagaaacttagaaacccccagacccagaatgaccaacaaggcctcacagattaaccttctagaatcaacagaccctaaaagagtttcaagtgcaagagaccctttacccaaaagaccctattgaggagacttaaatcaagagagaccccaataaggaagtgaaaaagtcacccaggcttgagagaagcccccagagaagaggccccagcccaaaaagactccccagagggacctcgggaggagaaagctggcagtggggcatgcgattctcttgactcactcctcctttatgtggcctttccttccccagatcctactgcactccaggactatgccaatttatggccatgctcccaacagcaggtcacctcctgcccctcctgctggtgataggcacagggggtactgtgcccagcccccaggtgcctccccggggctgttatgtggcaaaggaagcaggtgaacggacgttccgctgcagccaggcaggcctcagtgctgtgccctccggcatccccaatgacacccgcaagctctacctggatgccaaccagctggcatcggtgcctgctggtgccttccagcacctgcctgtcctggaggagttggatctgtcccataatgcccttgcccacctctcaggggcggctttccagggcctggagggcacattgcgccacctcgacctctctgccaaccagctggcctcagtgcccgtggaggcctttgtggggctacagatccaagtgaacctatccgcaaacccatggcactgtgactgcgccctccaggaagtgctccggcaggtgaggctggtgccgggcactgggacaggcatcgtgtgtggctcaggagcccgaccggacctcgtggggcaggagttcctgctgctggcaggggaggaagagctgtgtgggtcggggtggggtggggcccggaggagcaccgatgtggccctgctggtcaccatggggggctggctgacactcatggtggcttatctggtgcattatgtgtggcagaaccgagatgagaccaggcgctccctcaagcgggccccagtgctgcccgtgcgttccgaggactcctccatcctcagcacagtggtctgatgacccaggatgctcctccagccacaccccacactcctgcccctatgccctctcctttgctctgaccccctctgcctcctgtgcagcttcacccctgcccccaagcccatcccacccctccctcctttattccccctaaatacctgtgctggttctctctctctctctctgtgtcgtcttaaccaacaccatctttggtgcctggagttttttggtgcctactctgtgcctggattgtgctagactcagaaaacccataacagagaatgacagcaggtggggtgggagcaagggaggaggggctgtgggggggcaggttgaggagggagcctgcacctggcccagggcgatttcaaaggcttcgctgtaggatgtttgaactgattcttttttttttgagatggagtctcactgtgtcagcagactggagtgcagtggcaggatctccgctcactgcaacctctgcctcccaggttcaagtgattctcctgcctcagcctcctgagtagctgggactacaggcgcgcgccaccacgcccagctaatttttgtattttttagtagagttggggtttcaccatgttggccaggatggtcttgatctcttgacctcgtgatctgcccgccttggcctcccaaagtgctaggattacaggcgtgagcgcgccaggcccgaactgactcaggtgggtggatcacccaaggcagcacgcaacgtgaaccccttgggcgattacaggcccacacagcccgtccaccaccagcttcttcctgccctacagagctgaggcctggagtggcagagaaagccaagggtaccctgagggagcccccagctgagggggagtgaagccccaccctttcctgaattgggctcacaaacagaggcttcgagagcgcaactctaagactgaggtctcctacagagtgaggggcatcaaagcgagaggcaacccggggagcttattccaaagggagggactgcctcccccattggactaaagggagttcaaactgctagaaatgattttgccttaggtctctgagaatctgccatcatcaacctctcttacctccaaggaacccatctctactaaaaatacaaaaaatcagccgggcgtggtggcaggcacctgtaatcccagctactcatgaggctgaggcaggagaatcacttgatcccaggaggttgaggttgcagtgagctgagatcacaccactgcactccagcctgggccacagatcgagaccttctctaaaaaaaaaaaaaaaaagaacagggagagctttggacagaaaagcaagagcagagaaggcccctagatgaaaggtgtggacaaggcaaggaagatgtgcaacaactcagaatgtctgggcagcagcaagactcaccctggggctggaagagagggtgcaaagaggggcaaggggaaggtgggtggaaccaagctggaggcgaggtcaaaagccaggctgtggccagatttaaaaggacactgtgggctcctcctgtcttctccctccgcctctactgagagcctcccctggcttcttgcttctcttgtccccaggctcctcttcctcctgtgccctctactgaggatcccctcctccgactcaaggtccctaaccagagactccctatttctctccgtcctctcctttatacactgattagtttcctgagctccttcttctggggggaaggtggtctcctctatgactgagctggggatgggtgactgcagagctgggggaagtaaggagaccctggacaactcaataaagtcacttttatcaatgctccgatctcgtattgctcattttcctgggcacctgtggcctgttggtgaagagaacgggtgctgagcttgtcttcagcccctccaccacccctttggtcgggggtgctcctgctgggctggaggccagcttcccatctccccttctgctccccagcccctgccaccagagtccatctgctggactggccaggactgtgccgacacactcagagcggctcctgcatggaacgactgccccagaatcccggactgctccctctgcatcctgaccccgggcttgtgcttgtccactgggcaggcaggagggggtgacgtaactggcttcactcccatcctcacctctgccatggaccagggatcacaggaccctgggttttgagaaaccacggaagcctggtgaggcagctggacagcctcggtgatgttgcccgcatctgcccttctgcctgggacagagggagagaaaaggcacgctcttctgggagacacactgtgtcagtcccaaactctcccaccaggaaatgctggaacctggctcaggaaccaagacagcccagcctacagctaacccaggcctgaggcaagagttcccgcggcctgggcccaggtcccaacttgtcaccacatgcagcatcagggagccagtgggctgtgatgagaggagagggagaggcctaaaactgcctttgcaaaatgatgactgagacagtgaaagagatttaacttaactgattccatcttgcttttaacctccaagctgtccccgctcattcctaggcataggctgaactaactttgggaaaaacttagtttatagtttaaacaaagacagtaacagccctttcccaaagcagacctccttcttgcctggggactagattgcctttgtagaactaacattagccacaagatcagaaattatggtttaggagtcgtgccgctggaggctccctaaactgctccgaagatcagggcttgagatattttgcagaccctgcacttgatggatcagctggccccacccagatcaataaactggctcctctgatcttgtggcccccacccaggaactgactgagcacaagaagacagctttgactccctgtgatttcatctctgaccaatcagcacacctggttcactggcttccccgcaacccaccaagttatccttaaaaactctgcccccgacgtgctcatagagactgatttgagtaataataaagctctggtctccacacagccggctctgcatgaattactctttctctattgcaattcccccgtcttgataaatcggctctgtctaggcagcacgcaacctgaaccccttggacgattacaggcccacacagcccttccgccaccagcttcttcctgccctacagagctgaggcctggagtggcagagaaagccaagggtaccctgagggagcacccagctgagggggagtgaagctccaccccttcctgaattgggctcacaaacagaggcttcgagagcacaaccctaagactgaggtctcctacagagtgaggggcatcaaagccagaggaacccggggagcttattccaaagggagggactgcctcccccattggactaaagggagttcgaactgctagaaatggtttcgccttagctctctgagaatctgccatcatcaacctctcttacctccaaggaacagtcaccccaaaccaggaaggcaaagggaaagcagaacaaggcccccaagctgccaaatggatgccaccacaagcccaccccttcattcgacaagaatctgttggtcgggcgcggtggctccagccagtaatcccagcactttgggagaccaaggtgggccctgagctcaggagttcgagaccagcctggccaagatggtgaaaccccgtctctactaaaaatacaaaaattagccgggtgtggtggtgcgggcctgtaatcctagctactcaagaggctgaggcaggaggatcgcttgaacccaggaggcagaggttgcagtgagccaagaccgtgccactacactccagcctgggtgacagaatgagactctgtctcaaaacaaacaaacaaacaccatccgttgagttcctgtgcatggcaggcgctgcaactacaaagatcaggaagttgtgcctgaccctggggacctgacaggctagtgtatcagtgatgacagtccaggaagacagggctgtgcacaggggccctgtgaacccataaggagcatctcaatcaaacaccgacaaagggtcatgtactttgctcacaggaaccctcgctcagaactcatttattcttagtttacaagagttctaataatttcagaactgtggcttcctgcttatatcaagttagaaacagtatttctgaagtagcaaaaattatattacagagggtcagaataacagcagtgagaaagtacaccctaacgacggggagggacatgattaaaagtctaagaactcaaaaggcattgtcacagggcattttagtgtctcttaaatggccctgtgtggaaaactgactccccctgcctcacaggggcctatgggcattggcaaaatgcatgagatcagtacattgacttcgggttacctgcagaaaagttcaaatcttggagtgtccattctcagaagcagggagctggtgatgcacttgagaaagaatttccatcaaggactgaagtaaataaggcagaatgactattggaaaatgctacttcaacctcaactacttccttgttccttcttcccactggtcgaagatctgcccctggggccatgcaaaacaaaccagcctaaaagcctagtctttttttttcttttttctttttttttttatttagagacagggtctcactctttctcccaggctggagtgcagtggcgtgatcacagcttttatgtcccactaccaccacacacgcatatgtgagcacacacacacgtatctgcctcgggcccctgtaatgcagttgatcttccccaatcataatatatatttcagccgggcacagtggctcacgcctgtaatcccagcacttcgggaggccgaggctggtggatcacctgaggttgggagttcaagaccagcctggccaacctggcaaaaacccgtctccactaaaaatacaaaaattagctgggcatggtggcgggcgcctgtaatcccagctactcaggaggctgaggcagaagaatcacttgaacccgggaggcagaggttgcagtgagctgagatcacgccgttgcactccagcctgagtgacagagtgagaatccgtctcaaaaaaaaaatatatatatatatatgtttctacacttatgacaactgccatcttcctcttttagaacaccaaacaaaacttaagcccccacactaatactaatgtctaaggtcagccctcacttctcattcacttttggggccaaggcaatttatcagggaatgtttccagcagagggtgtatgggaacgagcacagggcacatctgtcctgtagaactaagaaaagactcaagatcaccaagactgcagtcacaggggtcctggtgaatgcctctgtcactgtcgaaggcaaatgtcaaaactccctggacatccaaaacctcagccatcatcgtgaatgatctggaaaacctgaggaagaggcgagcttgcagggtggggtgaggaggcaggttgaggattccaggccagatgctagaggctggtacagaggaatagcacccacccagaatagcacggactgctcaagttggcagggatctctattttacaaaagggcccaaagagaggcagcgagttatccaaggtcacatagggagggaaggaaagaaccaggactagaatccacagggccctgtccctctgggacatacacatactccccttccaggggaatgaaataagggagagatagggagagacaaccatgagcccagggtgcagctgaaatgggcagagggtctacccactcgcaacctctgacagcctctgagtctagccccaccccttccacaaagctgaagtaggcagagcagtccttcctccagaagcttccggaggatggggagaatctatacgtggtgaccaagaccatggagatgctgaagaaggggggtaaggccagaggggcagttccatccccgacctcactgctgtggggctcaaggttgggaatctctgagatgccttctctgccccatcccttccatgcacacttgcccctctccttcccccacgcagcccctactctcctctgcattctatgccatttcccttcacacttttatcttttctaaggactttttcatctatcatctcacaggaatcccctgaggaaggcaaaattgctattgcaatcaccatttcgtacagtttaggaaactggactttggaaaagtccagggactgacccaaggtcaatctgtgagcaaagcccaggttttgagattcccagctggctctttcgccaggcagctccactgcagccagggttctcccaccatctgccagggttcccttctttcattctctcccatctcctcccctcccctcccctccctgccctgtggacagctgcatttcccagggctctctgtttccacacgggagcatcatcatggcctttctccccaagcagtgggtcactggggaggagagctggagtcacagagtacagtgtgagggagggaaggggaggggaggcggcctcccaagggacggttcctactctgagccaagccctcagagctgagctgaagtctggaagtttggagtcttccatttctgtttgggctctgccccccaaaccagctggcgactccaccccctcctgggtccctcccaatccctattccacatcccctgctgtgtggctccctaatgcctgcacctacgtgtcccctcctggaggcaacactatatatattgggtgcaggggcgggtgggggtgggaagggacagagaagtcagagacagccagtgcccagtgccccatttcttcttttttttgagacagagtctcgcccttgttgcccagactggagtgcaatggtgcgatcttggctcactgcaatctccgcctcctgggttcaagcaattctcctgcctcagcctcctgagtagctgggactacaggcgcacaccaccacacctagctaattttgtgtttttagtagagatgggagagaatccacggggccctgtccctctgggacacacacacactccccttccagtggaatgaaataggagagatagggagagacagtttcaccatgttggccaggctggtctcaaactcctgttctcatgtgatccacctgcctcagcctcccaaagtgttgggattacaggcgtgagccaccacacctggccacagtgccccatttctgaccttcacagacatcccccatccaagaacaagaagctgaaaatgccctcagaaggtcagagaagcagagggctcttctccccatccccaacccaaaggtggacaaaaccttagaaggtgagagggacacagagacccctttcctaagcaaaggaaagaaatctgtcaagtcagcagctgaagcccagagccccttcgcaagggaaagactttggggtgatggtgggtgggatgcagaggggtcccctggacattggcgggacgtagtgctgactgtgatggcagccacgggtttcttgggccttttcggtgcatcctccccgcaagcctccaccacgctgttccaggtaggctgaggttaggcccactcagggcggcaccttggcgcaggacacctcttccgtttgggctttccgtcctcgtgatttcgctctccatctgacagtcatccatggtgacagggtgtgtccctttcccctaaacaggatcctcaatgcccatcggaaaacgttgtaaggcgttgagcccccaacgccccctcaccacaagaccctgctgtgaccatcttttcctggtgaggagagtctgcacgggggagcagggcgccataccccagaaagaaacctctgtgcctgggagtgagggactcgctgagtaaagtgaggtcgaagagggtggagaggggtagggtcccagtcaccactgtcctgaacccacagttcagtccgggcccaagatggccccacaggagcacagggggtttcgggcgctgcaggtggaggtgaaggaccagctgcggtgcggaaaggcctgacccgggcggcagatcgcctgcggagagaatgaccggctggggtggaggcggggctggggtggtgtgggcgtggctggggaggcgtggctggtgtggtaggcttaagcagtgagggcgggactggggcagaggcggggtttgggcgctgagggcggggctggggctttgaggaggtggctggggctggggcgaggctggtgcggaggcggggttggggcggtgagggcggggctggggcagaggcggggctggcggagtgaaggcggggctggggtggtgagggcggggctggtgcggaggcggtgcgggggaggtgtgggtggggctggggccgagacggagtttgggcagtaagggcggggctggtgcggaggctgggctggtgcggtgagggcggggctgggtggaggcggggctggggtagaggcggggctggggcggggtgggcggaattgcgggctgcggggcagagatggtgatggcgtccggggggcggggctgggtggacggccggactacaagggacgagaggctgggcttaaggtagcagggggcagagcggattgcccaggggcggggcgggatcggggacaaggctcaagtgctgaggaccagacatgcgccggaagcccaagcccggctagcgagtaggagggtggatggtgggggatgataggctaggcttaagatggctgagggcggggatacaaggtggtagggccagagatgggctggatggggcgtgatcggcctcctcctgggagatctcagcccacctgagtaggcttcttccggccgcaagagagactggggcctggccctgatggaatggccattctgagcgtgaagacctgcgtccccctcccttcaggaagctccctgtctctcaaatttcagggggatcatcacttcccatctctctgccaggttgatcgagttctggatctacaggagccagttctgagagggaggactgggggtaggaacggggtctttgaatggctgcgggactgcaggagacttccagcaacctcagctccatgttggaggaacattctgtacctgctgggtgctctgtgtggtgagggtcagggatgagggtgagggccatccctgatgtaccaggcctactaggttaggcccaatggtaccaagcaagacctaccacaaaagttaagggtcccagtgcaaaatgaaaatgcaggactccttgctacaaaagttattaagaattatatttggccagacgtggtggctcacgcctgtaatcccagcactttgggaggccaaggtgggggccaatcacctgaggtcaggggttcgagaccagcctggccaacatggtgaaacccccgtctctactaaagatacaaatttagccaggtgttgtggcacatgcctataatcccagctacttgggaggctgaggcaggagaatcgctcgaacatgggaggcggagtttgcagtgagctgagacctcgccattgcactccagcctgggcaacaagagcaaaactcaaaaaaaaaaaaaattatattcaagacagtagcagcagagcattaaacgaagcatggggctgtgtgcaactgcacaggttgcatgcccatgaagccagccctgataccaagctacaagcagagtgggcagggtgcagaccctattgtcccttcctccaaggaaaaggcaagaggggcaagcccacctaccatccctacgccagctcatttttcccaaaaggggaaaagggaacataccattccaggaatctcctctcatcctctcctggaggagaaaaaatgaatctgccgcccacttcccctccacggacacacatgggagctaaccccagttcccagagccactttttttttttttttttttttttggagacggagtctctctctgttgcccaggctggagtacagcagtgggatctcagctcactgcaacctctgcctcccaggttcaagcaattctcctgcctcagcctcccgagtagctgggattacaggcatgtaccaccacacccagctaatttgtgtatttttagtagatgggatttccccatcacggccaggttggtctcaaactcctgacctcaagtgatccgctcccctcagcttcccaaagtgctgggattacaggtgtgaaccaccacacccggcccccagagccactttacaatgccctgcccacagaaggagggagagcatgccgtgtccctcatgccctttcctctcctttaccctctgcagagctgagtgaggtgcaacagcagctgctggccatgtccagggagaaggggatcctttcccaataggtggagctggagagggacctgggggatgacaacgaggagaaaattgagtttgagctcatccagctccacccccacacttgtggatgggcagtctgaggcccagagagcacacaagactttagggccacacagcaggctcttagcagaactctctacagaacttaggtctccggattcttaatccttgcccatctctgcttcactctagcattaacagacagaggggggatcaaggatggggactgtaataaaatagcttgttgaatagcaagagaggctgggtgcggtggctcacacctacaatcccagaactttgggaggccgaggcaggaggattgcttgaggccaagagttccacaccagcttgggcaacatagccagaccccatctctatttaatataggaaataataaaaaataaaaagtaaaagaatggcagtgtgatgccaccttgaagcaaaactgccatggtgactggtattggattcctgattctggcagcaaagtccttaaacaatgcctgtagcatagataacccctgtattagtccattctcacactgctgtgaagaaatacctgagactgggtaatttataagggaaagacatttaattgactcacagttccacattgctggggaggcctcaggaaacttaaaattatggcggaaaggaaaagagaagaagacaccttcacagagcagcaggacagagtgaatgcaagcaggggaaatgccagatacttataaaaccatcagatctcatgagactcactcatgatcatgaaaacagcataggggtaaccacccccatcactcaattacctccacccggtcccacccccaacacatggggattatggtgattataattcaagataagattttgggtgggggacacagcgaaaccataccaacccgtcataaagcaacaatgcctgtaacacagataatccctcatatagatgtgtatctaacctccccagtggccatgacttttgcaagacagtctgagccatgactggctgcacctgtttcactctaaaggcttgttatagaaaagatattttctggacagcaggtgtggggaaccacttttgttcataagtccctattaaatgtttctttctaagaagctggatttgtcagcctctttctttctttctttcttttctttcctttctttcctttctttctttctttctttcttctttctttttctgagacgaagtctcgctgttgtcccccaggctggagtacaatggcgtgatctcggctcactgcaactccgcctcctgggttcaagcgattctcctacctcagcctcccaaatagctgggattacaggcgtctgccaccacgcccagctaatttttgtatttttagtagagatgggagttcactatgctggccaggctggtctcaaactcctgacctcaaataatccgcccgcctcggcctcccaaagtgctggaattacaggcgtgagctaccacgtctggcctgtcagtctccttctttggcctttcgattcccttggcctttgggggtaggtttgcagatatctgctcactgcagaacagcgacaggggctgaaatttaaatttttactgaaaattaaaatttaaaattttactgcaggccaggcatggtggctcacacctgtaatcccagcacttagggaggccaaggcagacagatcacctgaggtcaggagttcgagacccatctggccaacctggtgaaaccccatctctactaaaaatacaaaaattagctgggcatggtggtatgttcctgtacatacagctacttgtggggctgagtcaggagacttgcttgaacctgggaggcagaggctgcagtgagccgagatcgtgccactgcactccagcctgggcgatagaggaagactctgtctcaaaaatagacagacagacagacagacagacagacagataataaaatacaattttactgcagaccacttctgaagttggtggctccctaaatgcaaagcatcctgtgatgctttttctccactgtgcagatggaaaccatcctggactagaatttctttcagggagagatggagcccttctgtctttactttgagctgctcagggggttctgaggtgaggagctgaaagtggtcaggccctgatgggactctgtggccttgacatataaggagaccaaggagacagatcctccttacacctgggagccaaatgccttgacactgctctgtgtcctgtaagccagcctctccatctttcgggtgctggccaacaacacttggctctccagatattttattcatcagggatccccagccctgcccgcccatggctagggaaggcaggatggggcttgaggacaagcctaggggagctggtgaaaatacagaatagtggccgggcgcggtggctcatgcctataatcccagcactttggaaggccgaggtgggtggatcacctgaggtcaggagttcgagaccagcctggccaacatggtgaaaccccatctatactgaaaatgcaacaattattcgggtgtggtgtcgcgcatctgcaatcccagctactcgggaggctgaggcaggagaatcgcttgaacccggggggcggagtttgcagtgagccaagattggcactccagcctgaacaacaagagcgaaactcaatctcaaaaaaaaaagaaagaaaaagaaaaaaaaatacagaaaagctccaacacatgctcccgtgcatcagcaggggctcaggaagaggtgggttgctgggaggatcacctgacagaagagagttctctgggtttgggctggaggctggcagtggcctccttgcccagacagggctgatgggtagggggattggcagtggaggggtgggggcagtgagggctgacaccttgaagctggatgctgagtttgacacacttagagctgaacactgatgtctgttcagccagagtctggggaggtcttggactccaaagctgatttgggaatttgggaagaaacattaaagctttttagagaataaggaaagagtatgggagctttactctgttcagaaaggagaatttatggaagtatagctcacaatctatgatctgcacccccaaacatccaacctcccatatgagagataaaacacagcatccctaggaagcattattcctgcgcctccaccaggcagtcatgccccagcccagcctgtcttcatccctaaccattaccattccacctccttttgttcagggcaggtctgggaatatgttcatgtgagggatcacttcttgcaaatgctccagttatcctgcacccttcaagtaggctccaaatcctacaacattctccttgccctcccaactcgcagggtgccagcttcttcccattctggccagagtttgtgacttccatgaacgcccataatctacttttctctgttttctctgaccccatgctgagggggaaatcaacaataataaaaaggaggccaggcacagtggatcacacctgtaatcccagcaatttgggaggccaaggtgggtgtatcacttgaggccaggagttcgagaccagcctggccaatgtggtgaaactttgcctctactaaaaacacaaaaaatagcccggtgtggtggtgcgcacctgtagtcccaggtactcgggaggctgaggcaggagaatcacttgaacctgggaggcggaggttgcagtgaaccgagattgtgccactgcactccagccagcaatagtgtgaggctcggtctcaaaaaacaacaacaaaaacaataacaaaagggaaaatgagtaaggaaataatgccctgtcccaatgactgtgtctgtctgcagtgcactctatgggtcagagagacagcaatggtcccacggggcaggtgcctggggcttcctctcctaaatcaattctctctcctgatccctgtctcctaacaaccctacatagtcacaagcttggtctctaaatcagaggtgatcattgtccatcactaccttaattgaccaccagagggaggtagagagcaaagtttaccgcctgcctgagcagcactcaccgcatgaccaggtcctgcttccttattgtctcttttaattgacctgaagcgtccttacaaggcagtctaacttaaatatccgccagtacaatttaaattctgccccaggccgggcgcagtggctcacgcctgtaaccccagcactttgggagaccgaggcaggaggactgcttgagcctaggagttcaagatcagcctgagcaacatagggagactcccttctctacaaaaaattaaaaagtgagccaggcatggccgggcgcagtggctcaagcctgtaatcctagcactttgggaggccgaggcgggcagatcacgaggtcaggagatcgagaccatcctggctaacatggtgaaaccccgtctttactaaaaatacaaaaaattagccaagcgtggtggtgcgtgcctgtaatcccagctattttggaggctgaggtaggagaatcgcttgaacccgggaggcggaggttgcagtgagccaatattgtgccattgcactccagcctgggcgataagagcaagactccatctcaaaaaaaaaaaaaaaaaagccaggtgtggtgacacatgcctatagttccaggtactgggagcagggagcgggcactgagatgagagaatccctttagcccaggaagtcaaggctgcagtgagccatgactgcaccactgcactccagcctgggcaacagagtgagaacctgtctcaaaaaaaaaaaaaaacagaaagaaagaaagaaaagaaaaagacgcagctgggcacggtagctcacgcttgtaatcccagcaccttcagaggccgaggtgggtggatcacctgaggtcaggagttcgagaccagcctggcgaacagggttgaaaccccgtctttactaaaaatacaaaaattagttgggagcggtggcatgtgcttgtaacccagctactcgggaggctgaggtaggagaattgcttgaacccaggaggcggaggttgcagtgagccgagattacaccactgccctccagcctgggagacagagtgaggctccatctcaaaaaaaaaaaaaagaaaagaaagaaaaagaggcagggcaccctggatgggaggaaggagcaccaccaagacaagcctaaatgtggatattttcattccaaaagcacaagaacttcaacctggctgaccccacaagcccatatatctcctccctgccttgaactcaccaagccccctgcttggaataccagtaggcagtctgagggaatgggacaatgtggtgcaggcagggtcgggacgacaccaggagtgtgaggacaggcccggcagagtgctctgagatcagactgaaggcgggagaaatgagagaagcaagacttcccggtcagaggagagaaagctgactagatgggctttgcaggtccttggggagagcagagccacgtgtggcttttagatgccactgttctccagatctttgcagaatccactaaactaggaaccttggcctgcagccagtgggagaagggtagtcactgggaagaaactcccaaaagtctgaccgaggcaatgctaggctggtgagagggtgggagtgggactatcttccctggagctgattaaggcataaggagactgcacagcctcaggactatatgctgaaatgcaggcatcacgtcagtgtagtggctgagagatacaaggaggaagaggtggaaatccaggaaaacagacagagatgaaaggactataacacacacagcaggtttctatgtaaatatgtgcttgtgatagggaccagatgactaacgacaaccttttttttctttttcttttttttttttttgaatcggagtcttgctctgtcgcccagcctggcatgcagtggcacgatctcggctcactgcaacctccacctcccgggttcaagtgattctcctgcctcagcctcccaagtagctgggattacaggcacctgccaccacgcccagctaatttttgcagttttggtagagatggtgtttccctcatgttggccaggctggtctcgaactcctgacctcaggtgatccacccacttctgcctcccaaagtgctggaattacagccgtgaaccaccgcacccagcctaacgacaaccttcccacacactcaagcccccacctctgcctctcctaaggagaagggacatttgattgctggaatggctggagctgtggaaggaggatgaagtattgggtggctgcagtgagccatgatcaagccactgcgctccagcctgggtgacagagcgaggccccgtctcaaaaaggtgtagggtggatgggaaagtatgtaaagaaaaagagagtgagcagggaccagagaggcagaggcaaggcttggctttgttctgtttcaagacatagagaagagatatttgggagcatctgtcatattgaatgagactttggggacacaagtggagtaatgactattttagggagttttcctaagtgtggaatggtctagtctcattcaccatcagcccctcaaggaaacgttcagtaaagatggaattggccgggcgcagtggctcatcctgtaatcccagcactttgggaggccgaggcgggcggatcatgaggtcaggagatcaagaccctcctggccaacatggcgaaaccccgtctctaataaaaatacaaaactagccaggcatggtggtgcatgcctgtaatcccagctactcgggaggctgaggcagagaactgtttgaacccgggaggtggaagttgcagtgagctgagattgcaccgctgcactccagcctggaggacagagcgagactccttctcaaaaaaaaaaaagatggaatttactcttcacagcattcagggttgcgtttctttttccatgagtggtactaagaagagcctcaaggtgggagcaggaaggctctgctgtgtcaggttatacctgcacatatgcatggccacatggcccaacactgtaagggccttgcttgtaagtcccttattctgtcctctagcaatgtgaccatgtaggcaacatttgaaattcctttaaaattccttctaggcagagatttaagctaagaggaggacctgagtgacctctggtgcaacatctgaaagcccacgacaagcctcctgggcttttccatgaatatcgccgtgcccctgcctacggatatgctgatgtgtgtatacaatattctgtgagaagcagagacgctgaacactaaacaacacaaacccatttggtctaactccatctctgcctactcagacatctgcttctagcggtatcagagttatgtctatgtagctaaaacaaatggagtaaggcagcaatacacacaggctgacaagcccaggatggagggcggcactgcagatgctctgctctctactggaatgtgtggacatacaggaatccctatcccaggacacccgcagacccccaccatgaatccgagatgctccccaatgacggtgatgatgacagaacagagatgccatccctggtcacacacacacacacacacacacacacactcccactgcctccctctgcacccctcccaaaggcacctgccttcctctcctctcaatccacaagccaacctccagctgccacctctctatcagccttggctacccccacccacgctggcacctgcctggcagctccctatccaccccctcagccctcaggaggccagggcacacgtggaacaggttgatgttgttctccaggaagtggagtgggaggggggtggggtcactagggcaggcggggtccccggaagcctctgtccctgcataaagcagcctgtcctggcaagggatggtcatcctctcaacctacagacccagtgagccctaggccctcaccccagacccagctgctggataggacccagccccgctcccaggtaagaacttgatgacagcagggaaggcaggggtgctctgaggacacaggaagatgggtggaccaagaagggaatggaactcccctagagtccagtgggataagtatcccgataggccttggggagggaagggagaggcaggcctgtggacatctctctggtgaagaggaggctgctgttgcccaagcccttcccaggtgcacccaggtagcaccaggaggttgtcctgccccatcctggccctcccaggaatgagggtgaaaaaaaaaaagcaccttgaagctggcagaacagccccacgcatctgtgccgtgcttcctgccccccctgctgctgtgaagtgcctgtggtggatgtgggatgcttccaagccagctggtgtggcctcttccacccacggggataactggggtgtgccgatcggccacccagccagagcacctggactcaaacttcaaagacagagacttaagatgttgaccctcaggtcaggtgcggtggctcacacctgtaatcccagcactttgggagggtgagatgggcggatcacctgaggtcaggagttcaagaccagcctggccaacatggtgaaacaccgtctctactaaaaacacaaaaattagctgggcatggtggcaggcgcctgtaatcccagctacctgggagactgaggcaggagaatcacttgaacccaggagatggaggttgcagtgagccgagatcatgccattgcactccagcctgggcaacaagaatgaaactccatctcaaaaagaaaaaaaaaatgttgcctctcaggttcccatgggccccacattctccagggccctctcatcctagcgcacatctctcagggccacattcattggttctttccacacacatttgccaagctcgaactctgtgccaggtgtggtacttgctgctgcagaggtgactaagacccatttcctgccctctgggaagtcacagacgagttgctgatagggtcaggtgaacagatcataacaaaggaaggtgcatcagaagagcgctttggaaacacagatacagtcaccagctgcctggaggactgagggaagaggttccaggaggtgacctgaattgagcattagcggaggactagggagtcttcagatccggaagcgggtattgtaagcagagggggcaaaggtgaagagcatcaaaatgcctggatcctggctgggcacagaggctcacacctgtaatcacagtactttgggaggtcaaggagggcggatcatttgaggtcaggagttcgagaccagcctgaccaacatggtgaaaccctgtctccattaaaaatacaaaaattagccaggcgtggtggcacacacctgcagtcccagctactcgggaggctgaggcaggagaatcgcttgaatctgagaggtggagactgcagggagccgagatggcaccactgcactccaccctgggcaacagagtaagactccatctcaaaaagaaaaaaaaaagtctggatccaggcatcccccaggggctgtgagaggggagtgggtgtactcatacctgtggcacgcatgagggaaggacagggtgcagggaagtgtaacccacacatggaaagggcaactggggcaggtgaacagcttggccacccaggctcttgttgccagcagcatctccttccctcccctggtgtcctccgactctggctattgctagtctctggtgtgagagaaagctttacttccattgctaaataaatgctctagaccaggcgcagtggctcacacctgtaatcccagcacttcgggaggctgaggtgggaggatcacttgagccaggagtttgagaccagcctgggaaacatagtgagactctgtctctacaaaaaaaatttaaaaattagccaagtgcatgactgcagtcccagctactcaggaggctgaagtgggaggatcaattaagccttggcggtcaaggctgcagtgagctgtgatcacgccactgcactccaacctgggcaacagagtaagaccctgtctcggaagaaaagagaagaaagcaaagcaaggaaaggcgaggtggagggaaggaaggaagggaaggaaggaaggaagggagagggggaagaaagaaagaggaaagaaagaaagaaggaaggaaggaagaaagggagggagggagagaaagaaagaaggaaggaaggaaggaaagaaagaaagaaagagaaataaataaagaaagaaagaaagaaagaaaaagaaaagaaagaaaagaagtgctccagctgggctccgtggcagtgaagaaaatgagcgtggagtgagaaaaatgcccttgacaaagaaaagggaggtgtggctttgctggccatctgtgggactttggggcaactctttcaactctccagccctaggttcctcatcataaaatgcagactcccttgattctttccagctgtgacatgagacaatccaggcatctctaagagctcctcctgcctcagagccgggtaaactctctctgcaggggcccagcctatatcccgggctccttggcagccttggcagccaccttgacactctcctgtctccccacctccacagagacaatgaccatgtttgaaaatgtcacccgggccctggccagacagctaaaccctcgaggggacctgacaccacttgacagcctcatcgacttcaagcgcttccatcccttctgcctggtgctgaggaagaggaagagcacgctcttctggggggcccggtacgtccgcaccgactacacgctgctggatgtgcttgagcccggcagctcaccttcaggtcagcctcaagcggggctgggaactgagggatactgagggacaggggctgggcacctggcctgcaaggaggacctcaaagctccctctggccagaggtgattagatgtcatctagcccaaagtcatcatcaggagctgaggaggctggtggtcggggggatacctctcagctcagcctcttttatttatttacttgtttgtttttgtagagatgggttcttgctttgttgcccaggctggtttcaaactcctgggctcaagcaatccttccaccttggcctcccaaaatgctgggattacaggcatgagttactgcacccagccagcccagccccttttgtcttttccctcctgcagacccaacagacactgggaattttggctttaagaatatgctggacacccgagtggagggagatgtggatgtaccaaagacggtgaaggtgaagggaacggcagggctctcgcagaacagcactctggaggtccagacactcagtgtggctcccaaggccctggagaccgtgcaggagaggtgagagtgggcgggactgagggtctcccgggatgtgggtggggcagtgcatggaaatggtgcttggggccttgagctgaaaggtaggacccttgcactgacctttgccaatgtggtcatgacaggggagctcttggaggcaacccttctggcccatggctgcatccaggccatttcctagtcacacctcccgctgctgccaccgtctccaggaccacctccccactgtcacgcatgcacagggaagatgatgtccacactagcttgctgtgtgatcttggaaaagtcacttctcttgggacctcagttttcttttctgcaaaatgacaggattgaatgatcatctctaaggctccttctaactctaagactatgcaatacactagaaaaaggagggatgtgtcttaactgcccccagctgagacctgagcactgtgttctgctcccataaatgaagcctcctgcctgaccccaatacacactaagcacgccctcgggaatgctgccccacagcacaaagggtgtggcaggtgccacattgatgctgggcaccaccggatgtttggcttgacacgggaactgacttttaagtagttaagtagtggttgaaagaaggaggtaaggactgtgaaggccagaaggaaaggctggggtagtcatccagcaagcatgtatatagtaaagcactctactacgggctggggtgcgcctagaacatctttgtccaagaaccttgcagtctaggaaggtgaaaattttaaaaacctgtgcaacagtaattataatcaaagccaagaagtgctaagtgctgtagggatggtttgactgagtcttgtggcaggtcaaagggacttctggctggggaaataagggaagatctcacagacatggcagcctctgttttgggccttgaaagatgagcagaaattgggcatgcagggctgggagaagggtattatgaaggcacacaggtgagcaatctcaaaaccaccaagggccaggaacagccagcatagcaggggcggaagaggtgcgagtagaacgagcaggaaatgcaggtgaacccaaaccatggaagaggcaagtggcagctccaggagactgaattgtaggcaccaggaagatcctgaaaatgttctgatgtgtcccatgactaatccagccagatggaggaagtgtgtcagataggggaagaggaacaggggtttgaagcagtcagacaaggcaagacacttttcttctttttttgtttgaaacagtttttcgctcttgttgcccaggctggagtgcagtggtgcaatcttggctcaccgcaacctccgcctcccaggttcaagcaattctcctgcctcagcctcacgagtagctgggtttacaggtgcccgccactacgcccggataattttttatttatttattttatttatttatttattttgagatggagtctcgctctgtcgcccaggctggagtgcagtggcacgatctcagctcactgcaaactccgcctcctgggttcaagcaattatccagcctcagcctctcaagtagctgggactacaggtgtctgtcaccacacccagctaattttttatatttttagtagagacggagtttcaccatattggctaggctgatctcgaactcctgactttgtgatctgtccgcctcggcctcccaaagttctgggattacagggaagtaatcccagttaagtagtggttgaaagaaggaggtaaggtggctcgtgagccaccacacccggctaatttttgtattattagtagagatggggtttcaccatgttagtcaggctggtcttgtactcctgacctgaggtgatccgcctgcctcagcccccaaaagtgctgggattacaggcgtgagccactgagcccggtcttttttttttttttttttttttttttgagacggagtctctctctgttgcacaggctggagtgcagtgacacgataccaggtcactgcaacctccgcttcccaggttcaagcagtcctcctgcctcagcctcctgagtagctgggattgcaggcgcacgccactacatccagctaatttttgtatttttggaagagatggggttttaccatgttggccaggctggtctcgaactcctgacctcaggtgatccgcctacctcggcctcccaaagtgctgggattacaggcgtgagccaccacccccagccaagacactgttcttctatcccatgagcaacgaaaactgaggacccgagctggggaagggcaagaggagtgaagagggaggaatggatgcaatgcccattgccaacggtgatagaatggcctgggcttggtagctgattgcaggatgagggaaagggttttgtcaaaggtgactgcgagattttacccaggttgtgacattataggacattaaagctaccattacaggtgacaaacaggaagacacaggttagaggtagatttggagattgtgagttccttttggatgttttgagtttctggttctgctgagacatcagctgagcatgttgaacaggtgattggaaataagggcctggagctcaggaaagaggtcaaagtgaagatacacacaaggtaatcagcactataaagattaaaactgtaggagccaggggaggagtctcactcccgtaagcccagcactttgggaagccaaggcaggattgcttgagcccaggagttcaaaccagcctgggcaagagagtgaaacccccatctccacaaaaaacgcaatattagccgggcatggtggtgcgcctagagtcccagctactcaggaggttgaggcaaggggatcacttaagcccaagagctcaagtctgcagtgagttatgatcgagccactgcacttcagcctgggcaacagagtgggaccttaaaaaaaaaaaaaaagaaaaaactataggagtgagttgggtgtggggagcttttagagggagttgagaaaacaggactgagaacagaatcttacagaacataaaattttagagaaccaaagaaactggaaaatgaggtgcagacagaatggataagatttaggaactagaagtactggagttgagccagggtggtacactgtgactggaagccaagagaagccagcgttgcacggagggtttccacagcaggatcgagtattgcacagagttaggcgaggtcattgagactgacaggtaagagatcattgtaatttcagctgagtagtggaaatacaaggcaaattataaagaatttaggtggaccgggcatggtggctcacatctgtaatcccagctattcaggaggctgagggagaagaatcgcttgaacccgggaggcagaggttgtagtgagccaagatcgtgccactgcactccagcctgggtgacagagtgagtgagactccgtctcaaaaaaaaaaagaatttttttgatatatttgccaatgaaatgaaggaaaaaatagggtagtaatttgagggagtggcatgatcaaagcaaacaaatttgttaggattagggagtttatatatggaagcagacagaaggagcaagtggagaggaggaactggtgttaacagcaagagagagcataagatgtggagagaaaggatcccagagagatgaatggggaggaaagagggggggagcatctacccccgggatcccagagagatgaatggggaggaaagagggggggagcatctacccccgaactggaggaaaagggggtaagaagcacccaagaggccctgttcctggccaggtgctggcccaattaccgagtttatctctgagcaacccaggaggtcagcatcattatactcatttcatagatgaggcaattaagactcagagaagctgccctgccagtaagcatgagatctgggtttcaacctcagccctagtccagagtcctcactccttccctgccaccacaatgtctagttcctgggaatgacagaaggaaagaggagggtgtggtacaggcaggaaggagctctgaacggttcccttatgtttctcctgcaacaggaagctggcagcagaccacccattcctgaaggagatgcaagatcaaggggagaacctgtatgtggtgatggaggtggtggagacggtgcaggaggtcacactggagcgagccggcaaggcagaggcctgcttctccctccccttcttcgccccattggggctacaggtttgattcaaacacacacacacacacacacacacactctcacactcacactcacacatacacatttacattcagcccctccttggaggcttcattagctttgcctgatcagcgcccaccgaggatgctgaaaagggccactccttcccccggctcttaaagatccaaaccccagacatatgccccctccctggtcagtggcacccagtgagggcagatccctgcgccagatgccacagggaactactggggaaggggaaagtcacattcctgggttttccctcgtggtgctcccattccaaagaggagacatctttactctcggaaagtcatcaggttcatagaggagacacagaggctaaagcccagagaacacaggcttggaaaagccaatggaaataaggaatggtctccatacctctatctattgcatctaaatattcaagggatgatttgggatttggagccaggagtaggggttagtcatggaaggcgtcctgaaagaggtaagcatgggacagatggtgaagaggaagaaggagccagggcttggatggaagctctagggtgatgtacaggcaggagatggagcaggtctgcccagttcccttcatgcatctgaaccaggaactagaactgacctgactagactctactgacctgaaccaggtcactagagggaaaatcagcagaaatgagcacaaggactttgaagtccttcctcagagtccagaccagggacaccactgaaggcttccagcttcttatctccctgaaggctctcagccctgaccctgcacctcccccaactcacgctcccaatatctcatacttaagatgtccagagattcacaaattctcattgtctaattctagggatccataaatcacaaggaggctgtaaccatccccaagggctgcgtcctggcctttcgagtgagacagctgatggtcaaaggcaaagatgagtggggtgagcagagacccgcatgttctccccacaagatgagaattacctgcaccagtactgaggcaccctggtcccctcttgcggaaatgtcagagaatgagtaggggggtgtattgtactgtgatccgactgcagccatggagcctgctctggagagaagggtgaagaggctcctggattctgagcatcttctgggtgctgggcactgtggttattgggggagggggtacaaatatgaacatgcactgcctctgctctcaagaagtctgtggccaaaggaggaaacagacagagactggaatggatgatagaaagtagtgttctcatagtagagaatttatcaaggaagaaaagattgcttccagcaatggaggttgaagctgggaattaaatgaagcatttggggtgcaaggtcctagcccttagcagagccctttggcttgagactgaagaagggaatgtggggcagctgctaagtgtcctcccaccctccctcccttgcccttcacagatattccacatatctgcaatgataacatgcaaaccttccctcctggaggtaagtgaaattgcttacgggcttcccacatcttccgccctacccctgacattatctgccaaaatcctccaccctctcctagcttatactataatcccccaaggagcctctgcttttgtttcccaagtccctaagaatacctagcctcaactttagaaagacagatagaggcatataaatactgtcccagagagatatagaaactgacagacagagaccggaaggcacagtcagaagcagaagtaagacttggagactgagtgtgttcccgaatcatgggggtggatgagctagcataatctccctgtgtttttataatgatcactgatgaaactgccttgaagactgttttagatgaaaaggcaaaaatgggttttgtgctgacagatgtgcattttttctgtcttcagaaaagtcaggagaggagaaggtcatccgtaagtgtttcctttcattccactgaaactttcttgactccaaattttaaaactccagtctttttctttccttctgacaggactgacagggaaatagcagagcgaatctcagcaaataattgtccccgaaacatggcagaaattccaatagcttgggaaaaagcagtggaaaggggggagtctttgcccaggtggtctgacgcctgagacctttgtcctcaacagccttactagcagccaggcacagtgattcacacctataatcccagcactttgggaggctgaggcaggaggatcccttgagctcaggagttcaagaccagcctgggcaacatagtgagacaatgtctctatttaaaaaaaaaaatttttttttggatggagtttcactcttgttgcccaggctggagtgtagtggcgcaatctcagtccactgcaacctccacctccccggttcaagtgattctcctgcctcagcctccggagtagctgggattacaggcacccgccaccatgccctgctaattttttgtatttttagtagagatggggtttcaccatgttggtcaggcaggtcttgaactcctgacctcaggtgatccacccacctcagcctcccaaagtattgggattacaggcgtgagccacggcgcctggccttttttttttttcttgagacagagtctcattctgttgcccagactggagtgcaaaggtgagatctccactcactgcaaactctgcctcccaggttcaagcaattcttgtgcctcagcctcctgagtagctaggataacaggcgcgggccaccacactcggcgaatttttagtatagatggggtttcaccatgttggccaggctggtctcaaactcctgacctcaggtgatcctcccaccttggcctcccaaagtgctgggatcacaggtgtgagccactgagcctggcctagaaaaaaaaaaaaaaaattaagagtcttagtagctataacctgctacacacacatctgcaactcggccgcccagcaactggggccagagccactgagtcacagtaatgccaggaacaaggtagctgggctctcccaggagacaggcaggatgtatttcctcatcttccttagtgtctcaacccctgggtatggctgccattctgaaggattgcattcttatcttttttttttcctttttttctcagttatccaggcatctgatgttggtaaggaactttgtgagtttctcccaagactttggcatggaggtagcattaggggcagagagaggagaaggcgaagtcattctttgtcagctaactcatgggaagggaaaacagactttctttctccactttttgctggagtctcaaagaaaagtcaagtgtgtactgatatgggataaggcctgggatctcaggaagattaactgttgggttagatgatacatgcatcctggcccaccttctcgccccaaccctcaggttagggttggtggatagttctgtcaccgcattccttggtaaagaaaaatggggccaggctcaaactggggggtagagcatgggtacctaaagggggctgagtgtaggagccctgcagggggaatgctgactggagaggaaggtgcccgatggagggctgtgtgtcccattattgtccccataggggacgtacacgaaggcttcaggacactaaaagaagaagttcagagagagacccaacaagtggagaagctgagccgagtagggcaaagctccctgctcagctccctcagcaaacttctagggaagaaaaaggagctacaagaccttgagctcgcagtgaggacctagtggaagtggggaagggtgggagaaggcatgttttggtgaagatttggtgggggcgggtattgcagcaggtagggagatctgacgggggcaggaggtgggtggccaggggagtccaccttagataccttccccaaggctggccacgtgccccaaggctgccaggccactgctcctccctttgtcccctggaaaagggcaaacagtgggttcccccaaggcacatgctccctctgatggccagaagggacttctgctggaggggctggaaccttctctttccagagtccaaaactcaggaaacaaggaacccaggagtccagtactcttcaggacatgaggcctcgaaaaagaaatcaggaaatggagagagtttccgcatgtcaaggggttattatgtgctgggccctgggttgggccctttcctatgttatcttcaatagtcgcccaccttcccccacagcttgaaggggctctagacaagggacatgaagtgaccctggaggcactcccaaaagatgtcctgctatcaaaggaggccgtgggcgccatcctctatttcgttggagccctaacaggtaagtggggaataaggtcttcatttatagaccttttcagtaataggaatgaatcacttgaatcaattcccaaatggatgaataaatgaatgaatgacaaattataccacagttaagtagtttatatctacatttttataaattggtttcatggctggctgcagtggctcatgcctgtaatcccagcactttgggaggccaaggtggatggatcacccgtgatcaagagttcgagatcagcctggccaacatggtgaaaccccgcctcttccaaaaatagaaaaattagccgggcgtggtggcaggtgcctgtaatcccagctactctgaaggctaaggcaggagaatcgcttgaacccaggagggggagggtgcagtgagccgagatcactccattgcactccagcctgggcaacagagcgagactccatcaaaaaaaaaaaaaattggtttcattcctaaggatttgcttggtcacattgggtagtctgagaagacagcctagtcttgctaatagaggttgaataaccctagttttatcagcaacatatttaaaatttctgcatatagctaagctcatcacttctatcctgatacctgttagctttaacttcagggagtaacattttcttatcttgcccctaagagctcttcttccctccacattttctagttttccacttagaaaaactctgtggtccttcaggtgtaagccaaaacgtttgttcccttaggaagcctgccctccgactccaagaccaaagtggacccctcagctatggctcccttaacacctgcgttgtaattacatccaatgaatgaaggctgaaattctggaagtgcgctatttggaggctgtagtcccctctgcaccagcaacacacatctttctctgctttttttctccagagctaagtgaagcccaacagaagctgctggtgaaatccatggagaaaaagatcctacccgtgcagctaaagctggtgagggaaaaacagcagatgctggggagagtctgggagtagctgcagccagtggagatgcagatttcgcctaaggatggagccattctggaggatccctgtcttatcccaggggcttatgcccactcctcctttctctctctatttctcattttttgttatttcacaagaggtagaagactgaatttctgggcaataatctgggtttattagcctgatcttgggagaagagacagaaactgtggctttgcttattcctagccaaatattgtaagcaaatttttttttttttttttttgagatagagtttcactctttttgcccaggctggagtgcaatggtgcgatcttggctcaccacaacctccgcctcccgggttcaagcgattctcctgcctcagcctcccgagtagctgggattacaggcgcccaccaccacaccctgctaattttgtatttttagtagagacagggtttcaccatgttggccaggctggtctcaaactcctgacctcaggtgatctgcccacctcagcctcccaaagtgctgggattacaggtgtgagccacctcgcctggcctgtgagcaaattttttactgtgtctgagtctgtctcaatttattcctctgtaaaatggggctaaaaatcaatgtgctgcccactgtatagggctgttcaaagacccagatggggttgtaatgtaaggtaaagtaaggaattctaataaggggaatgtaaccttcttgtgatttttgtgagttaggagaggagagaggtttccagttctttcttttcatgctgttttgattccctccaggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttaggaatgatatgtcttttggtgtttttctttaaagaatttatcatacagaaattcttaatttgtgccagaaaaagaaattgttatcatactgcatataaatcatatgtacatgaatatgatgctgtactgtcctcaggcaaactggaaaatgctcagagggtatagaatgtggaatccagatttttttttctgttcaattagttttctttaatggaatctagagtctcaagtgagaagatatcaaagcagtttgtcttcaaagaagagcatttgggagtcccctagctctgggttgagggaaagaccgagagatatatagtagaagcccgaaacaaaaataagacagatttcaaatttattgaacagaaaatgcagatgggcctttaaaaaaaagggggacccaagaataagactaacccaaaactttaaaaactaaattgtgatattatttcacctttctctgttctgccctgaaatttagggttcttgtaggaggaagtagtgtgggtaggcttggcatattactactaatatggatattacaatctcatcaaaccgctgggtttatatcatcctcctctgcctaaaagctgggtttgaacatctttcaccaacctcttttaaagcagtatcaggaccggacaccgtagctcacgcctgtaatcccagcactttgggaggctaatgtgggcagatcgcttgaatccaggagttcaagaccagcctgggcaacagggcgaaaccctatctctacaaaatataccaaaaattagccaggcatggtggcatgtgtctgtggtcccagctactcgggaggctgaggttagaggatcacttgagcctgggaggctgaggctgcagttagccaagatagcaccactgcactccagcttgggtgatggagcgagatcctgtctcaaaaaataaaaataatttttaaaaaagtagttctatgagtgcagtacatgtctgtaatcccagcactttgcaaggccgaggcaggaggatcacctgaggtcaggagttcaagaccagcctaatcaacatagtgaagccctgtctctactaaaaattaaaaaaaaaaaaattaaaaattagctggacatggtggctcgcacctgtagtcccagctactcaggagaaggaggcaggagaatcgcttgaaccccagagggggaggttgcagtgagccaagatcacgacactgtactccctagcctggccaacagaacgagattccgtttaaaaaaaaaaaaaagttttatgagtggaagaatttctctaaggattttggtccgtggagtcagactctcccccagtgtcttagtcaccccctgcccagcctggttccctcatccaccaagaattcatgaccaactgccagaagctttgtgttatgccgccagcctccctgatcctgagcaccttccaaagcctcactctattgctcatggatatactgggttgttatctgctgacttggttgttttctccttgtgatgtaaacttaatagagagatgagctaacaccctaactatctagaagagtaactcctttgattgttaaggatgaacataactcatctgttttcttccttaccattctcgcccaccttcagttgcagatatggtgttatgaagaggttctaatgagtttattccaatgatgattcaaaagtcctgttatccaccccccagccctggagggtgagaggacagttgaggaggaactggtcaaggcatgttccctaaaactagagcacatatctttccagttagcgagtggctgtttaacgcaaggaacatcctgcaatcctatgaaagaggatgcaaaagatatgcaggataccctttatatatgcaaaggaggaggtcaaaacatatttcctgccttctaggtccttacaacagggctagattgtcttgtagggtccgtgaaaggtctaaaactcaggacttccacttatgggagagagaaaagtttcaaggtagggagagagtttttgttgtgtgttctaagaaattgggagctatatccttcaccttgtttcaccttccctgcagaaccagtggggcagtcctttgaaaaataagtgggtagggtttcttgtccaatttgcttccccttaggtacaccactaagtaaaccatcattctctccttaggcacaccattattctgttccccatttcacaatgtctgtctggatgtataaaagccctctcaatgggctccctaaagcgtctgccagtaggggctcccaccctctttcctcaacactcccaatccaccgcagcccagagcacagtgtctgcttatctaaccatctgactcccccgtatactacattcttgagctgtttttcacccccctatttgctaaccgtgggccgtacatagggtggacccctatattttgttaaactggagtgattctacgcaaatgcacgctcctacctatcggcactcccagcctgcagaaattgtatgccttatgttcagcactaaactcaaatctaaccaaggaagtccggatcccatagggttcttcctactctccagttcggtttattttaaggccaacagccctagcttcacgtccctccttcacagccttctttccttccctcctgccggatgcgcccggcagccgttgagcacaagcccagcggatctggaaggagaccccgccgcgaccggggaaaattgagcgaacttgggcgcaaaacccgcccggcaactcgtgacgtcatctcgtcccgcgctcggataggctgtacccactccacgctggttgaggcgctcttaaagtcctttgtaacccagattggagcctgaggggacctctcgtggacgcccacagaaatgcactcgagaggaacataaaagcatcacacttaagcgctcgaaagaaagccccacgaacccataaaggctcctccccgctccttcctcgaagctcctccttcatcctgcacctcggctgtggatttatttcccctttgttgactcggccatcggcctgccgggcctggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggagggtacggcagcccaggccgggaacgtgccgcgatcgcgggtgacagcgacccctgtgatttggcttcttgctgggaagccacagcagcctccaccaccctcagttctttgggatcacccccagatacctgctcccactgccccgacactcccgactccaggcccaatgactgaaccttctctccaggctgggaaccactcccctcccatcccctccatccccatatctggggttgcatctatatctaggtcccagtgggcctggggactccctcttttaagtcctcccctctgacctattccgtttatatcccacccgactgattttagcgcctccaatatatgactgattgttcccgctggaaaccagtgtttgtgtctgtgtgtaaacagggccaggatgacctagaatattgactcctgagttttaaaactgtacagcagatttttgttgtcctagctgcctttagcacactcccccgaatgaaccatttcgacctagtatcttgtttcctacttctctaactgaagtgtcccaacagtccccttgctgtctcctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgttttacttttcccacttacagcgtcctgtttccatttgaagtgggcaaagtgagagcttcccactgtgatcctggtgccattttcctggttctggatcaagtgggaccagactacttactaggttttcttttcactaaaatgcgtgagaaactagctcaaaaacattgagataagcaaagttatcctcctaggtggtgcttttgaggatgtgatggtgttgactacatcagctcttactgtaaagttgagcaacaggatcgatatttaatagagatccttttacctaaagtagtggcagcaatgtcaaaggtgccactcagcattgcctactgggtgtgtttattacaggcacttcattttcttcttgtaaagtaattcatattcattgcagaaattgtggaatgtatgagaagttaaaagcaggggataaaaaacatggttaacattttttcttgtgaatttttgagctgttctcctataattgagagcaagttatgtatacagtttgtatcaaggcataactaaatataaattttgaattttatgtgttttcattaacattcgtaaacataatcagcattcaatttattccagaaacatttattgaatacccaatataatggttaagagtacaagttctggaattagttccctcatctgtataaatacaagtaatagtacagtactttattgggttgttgtgaacattaaaatgcttaaaactgtgcctagcacataaatatcagctgttattatttatatcattagtgtggcccagataccctgtgctaatcggtgaatatacagaagtgcctaagaaactactcattgattgcattcccttattgctttgcatttaaactgtttctagtttcttgctatcataaatagctttgaagcaatcatctttgtgcccaacttaaaaaatctacttttctaattatttcttcagtacagattcccaccaaaacctatatgcctgagtttaaaaggctgaacattttaaaggtttttgatagttattgtccagaaaaactgtgctgatttacattataccaggagaaatgtagttttcactgtactctataatttttttttttttttgagacggagtctcgctctgttgcccaggctggagtgcaatggcgcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccaggctggtctccaactgctacccttaatgatccgccctcctcagcctcccaaagtactgggattacaggcgtgagccactgtgccccacctataatttttttaatgttacaaatttggtagtttaaaaatgtttccatttgcaattactcaaatactaatggaatataatttttgtctgttagctatttttcctctttgtatgttagttcgtctccatttttgttttgaaattgtggcaatataatcattataccattatatctcttaaccatttatacaagctctttatagaataaaaatatgaatctttgatcacatttgttgaaaatatttttcttttgtatacacagttatctaaaagggtttttttaaatgaagtcaagcccattaatcttttgtgcgtatgtgatttctcccattgttcacatttagaaagtcttttccattaagatctgataaatctggactccaggtttctgtagttaattggtttttcttttcttcctctgtcatcctctaccccatcctgcacccccactgtatgtttttcttgccacttggttatgtcttaaaatcagtgtgtggaatctgtaaatattatggaccccattagggcagaaaaggtgagtggtcgcattttgcccctctgtgagaggctccttagaactccttgcctggccggcacggtggctcacgcctataatcccagcactttgggaggccaaggcgggcagatcacgaggtcaggagatcgagaccatcctggctaacacggtgaaaccccgtctctactaaaaatacaaaaaatttagccaggcgtggtggcgggtgcctgtagtcccagctactcgggaggctgaggcaggagaatggtgtgaacccagcaggcagagcttgcagtgagccgagatcacaccactgcactccggcctgggcgacagagtgagactccgtctcaaaaaaaaaaaaaaaaaaaaaaagaactccttgcctggagtggtgggggactaggagtgaaagtgacatcattttcttctctgctcttcttcagacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagaggtgagtgagtcaggccaacttaaagggtgcaggcctggcctcagatccccaggaacagcattgttttccatcctaaagtcccatcttattacctgtggtagcatgaggagagaagccaaagcagtccatttgaatactcatctgcacagtgacaagggaaccgtccactgccctgtagtgtcattcttcaaagtcaggggatcaggaccctcccagccaaactcatttcccactaccctgcaacctgtaccccctactccagttgaggttgcgttgggtgacctctctgttgttctaggagagagaaggtgctgctgcctctttcttctgaagcttcaccatggaggaggtagagaacagtggttaggaggagcacagctgtcagggccaggcacagtggctcacacctgtcttcccagcactttgggaggctgaggcgggcacagtggctaacatcgtcatcccagcactttgggaggctgaggcgagcagatcgtttgagtccagcctggattcaaacaatctgcccgcccaggagtttgagaccagcctgggcgacatggtgagaccctgtctctgcaaaaagtacaaaaattagccaggcatggtggcacctgcctgtagtcccagctactcgggaggctgaggcaggaggatcacttgaatgcaggaggtggagattgcagtgaaccaagattgcaccactgcactctagcctaggtgacagggtgacccccctacctcaaaacaaaacaaaaaaaaccccacagattttagaggtagagttgaatttgaatccaaaccctgacagttagtacctgtgggacttgggcgagtgacttcattttgctgtgcctcgttttcttcatttgttaaacgtgatgaacggattgggaagcgggcagtataaagctcctagagcagtgcctggtacgtagtgaatgcagacgaagtcagtttggtggtggtggtggcgcctccgtgccaggagagacctctccttatcctctgtagctgtaaactctccctcatgattcatggcatgggccaggtctcagccttctccaattccactgaccttccagcacctgcatttccttaaaatcctgtatactcagtcagctccgtggatggggaaactcagaacatccctggaggcagggcagtgaagagtttcttgtctgggaaaggggaaaagcgtactgttcccccaactccaccttgaatattttctgaccttcacatcgctaaactcacgaaacgtgattattttgggggtgactgtaacacattattttttccagtgtcagtgacaacataggaaaatatgttttgtttatatgttgactttccctaaattttctttgttcccacaagaaaccattttttggtctcattattctgatttcatctctagaattatttcgttcagccctgtccagtagtatttgcagtggatccaggtgtggtggtttaatgtctccacttaggttgtagcctctttgaaggttccttacatcgtcctttgtctccattatgttgtgtaaagaaattttttgttctcctgtaacactttattgtgtttattaatattatattgccagcctccttgacttgttttgtttttttgagatggggtcttgctctgtcacccaggctgaagcacggtggcacacttatggcccagtgcaggctcagactcctggtatcaagcagtcctcctgcctcagcctcctgagtagctgggaatacaggtgcatgccaccatgcctggctagttcttttttattttttgagagatggggtctcactgtgttgcccagactggtctcaaattcctggcctcaagcattctcctgcctcagccttccaggtagctggcactaccggcgtgagccaccacacccagctcctccttgatttctttgggaaagactgtaatctttatttttttatccctagcacctaacaaaatcttggcacatggtagacactcaataaatatgttgaaatacatagtggatgctcaataaattcttggttacttgatcagactgagcttttccatggtaacttctgtcctctcctagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggtatccaggatgcagtgagagcgattcataagccccaagtgatgcaaggggtttggcggggagatggtccctggtgaagaaatggaaataatcattgattcttaagaactgtcccccacactctttccccatagaggtatgcgtttgatcccacatcccaggagaacccactcttgctctgggcactgtgggacagggcttgcagtggtcatgctgtaccggtctgtgggggataccagcgtagtacattcttggggaaaagtaggggcatttggagacagaaagacctgggttccaatcccagccataccctaggcaaattaatttctcccagctatatgtaagatggggataatagtgcctaccttacaagatggttagcgttacataaaataatttgtttagaaatacttagcgcaatgatctgcatatagtaagctttcgtgatattttcataaatggtagctgttattatggactaatagctccatttgcaaactgcacttctaccactcccccagctagggccagcttctttgttcatcatagccactgtcacaggagcacactcaggaagtaagtcgcactccttaattccctggtttgtttcctttccttaccacactatttttggttgttgtttggttgggggtttttttgagattgggtcttgctttgttgcccatgctggagggcagtggtgtgatcacagttcacttgacctccccggcttaagtgatccttccacctcagcttcttgggtagctgggactacaggcatgtgccaccacgcccagctaatctttgcattttttttgtagagacaggatttcaccttcttgccaagctggtctccaacccctgggctcaagtgatttcctgggctcagcctcccaaagtgttagggttacaggcatgagccactgcgcctggcccactgttttgtttttactggagatggggtcttgctatgttaaccaagctggtcttgaactcctgggctcaggtagtcctcccgcctcagcctctcatgtagctgggattacaggcacgtgccactgtacttggctgtttgtttttgagatataattcacccctttaaagtgtactacaggccaggtatggtggctcacgcctgtaatcccagcaccttgggaggccaaggcaggcagatcatgaggtcagacaatcaagaccatcctggccaacatggtgaaaccctgtctttactaaaaatacaaaaaattagccgggcgtggtggtgtgtgcctgtagacccagctactcagaaggctgaggcaggggaattgcttgaaccagggaggcggaggttgtggtgagccgggattgtgccactgcactccagcctggtgacagagcgagactccgtcaaacaaataaataaagtatactacaattgagtgggttttagtatattcccaaagttgtatatccacccctaattccagaacattttcatcaccccacaaagaaacaccatacgtattagtagtcacttttcattttccccttacccagcccctggccgctactaatctgccctgtctctattgaggatttacttactctggacatttcatgtaaatggaattacacaccgtgtgcccttggtttctggcttttttcacttagcatcatgttttcaaggttgacccatgttgtagtgtgtgtcagtacttccttcctttttaaggctgagtaatattccctcgtgtggatgtgccacattttgtttatctgttcatcagctgacgggcacctgggttgtttctactctttggttatgaataatgcttctgtgaacattcgtgtacatgcttttatgtgagcctaagtttccagttctcttggcttgcatacctaggataggaattgctggctcaaatgacaactccatgtttatccttttgaggaactgccacttgattctcttttggcttcctccccaggcacagaagatctctgatgatctgatgcagaagatcagtactcagaaccgccgggccctagaccttgtagccgcaaagtgttactattatcacgcccgggtctatgagttcctggacaagctggatgtggtgcgcaggtacaggcagccaagcatctcacttggggtccgtggggtcagagacttggtcagtcacaagcacacagctgtggatctgcagagggcgaagaacctgtagatgtaagcagggaagaggggcagtggttcccatgccctgcgccacgtgaggggtgtgggagagagactggtgctagatgaagaagtgggtcactgctgggctgtaaagaactgtccccaggttcttcccttcaccccacatcaaggtaggactgagggtgggttaggggtggagggacaggctagaaaacattttacttctttgctcaaaacctgcagtggcttcccgtctcaaggaaagacaaagtccttacaatacctcataaggcctgacgtgatctgctccattttgacctcccagacttcacctcctcctgctcctcagccccactggcctgcctttcctctggtgtgcccggcacactcttcttcagagcctttgcactggctgcccctctgtccagaacactcttctctccgcctccttcaagccttcccttaactgatcccttctcagtgagtcctgccttggccaagctattgaaaagttcaactcatctttctcacgtcctgcattccccattgcagttcccctggcctcacaggcctcccatcttctgtcacactgcaggctgtgcttctttctcatgaccattgcctcccccactgcactgcattccctaagggcagggttttgtccctttgtcgcacccagaatagtgctgtacaccttaggcactcgatagttaacagtattcagcaaataaccagaaaagcaatttgtataacttttttaaggaattgagaaagagcgaagagttaaaggcagttcagagagttgtgatttgaaggctttgacatctttctttccttcttgaagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacaggtgagcagaggggcccaacccataaatcagaaggtgtctcaggcctgcctggtgcaaattttccaaggggtggtgcataagaggcccatttggcaccctggcttgtcggtggggagttggatgaccctactctgttgaccaactctcctctcctccactcccagggcgaatcaaagccatccagctggagtactcagaggcccggagaacgatgaccaacgcccttcgcaaggcccctcagcacacagctgtcggcttcaaacagacggtgagccacaactaccatcatccctttgcctcttttttttttttttttttaaatggtgtcttgctatgttacctgggctggtcttgaactcctgggttcaagaagtcctcccacctcagcttcccaaagtgctgggatcacaggtatgagccaccatgcctggcccctttgcctgttactcattccctaccacttcagttctcttctctatgctaggggctaggaaaggcatccttaaccttcctatccagaaggacttcaacttttattattattttttgtgtgtgtggagacaggcatatcactgttgctcaggtgagaactcctgggctcaagcaatccttcggcctctgcctccctaagtgctgagattgcaggtgcgagctgccatgtctgcaaaaggttgcttcacatctatttgtgggtgtcaatgaagcagacactacctgcacctctggcagtggatattcagagtgtttctggcagataggtttagaatattcctgattccccagcgctcctgacagtcattccaggcttggacctagattgtgttgatacaaaccccaggtttttatctagtccttcatgttcacatttggaaactgtattgtctgtggccaaggaacccagaaaatctctgcaaggctgagtggctcaagtaaacataaaacttggccacttaagagctgtcagtcagcaagtatttaagcatcaaccttggtattaggcactgtaagggataggaagggaggataataagtgatctttctttcttttctttcgttttttgttttctgagacagagtctccctctgtcactcaggctggagtgcaatggcacgatcttttctcactgcaacctctgcctcccgagttcaagtgattctcctgcctcagcttcctcagtagctgggcaggcgcctgccaccacatccaactaatttttttgtttgtttttttggttcttttttttgaaacggagtcttgctctgtctcccaggctggagacagaggtgccatcttggctcactgcaacccctgtctttggggttcaagggattctcctgcctcagcctcccgagtaactgggattacaggcgcctgccaccacgcccagctaattttttgtatttttagtagagatggggtttcaccatgttggccaggctggtctcgaactcctgacctcaagtgatccacccacctcagcctcccaaagtcctgggattacaggcgtgagccaccgctccaggccaggtatttcttattattagagtatttcaaagagataaagaatgttgtgtcagaaagcttgagggtgtatgtgaagtcacagagcccagtagccaggatgtagacccagtcttcccaaattcaaacctctgctcctaccttcacacaacatccacctccatggtgtcttgacagggaacgggagacgtgtgttgattaggtcaatgtagtaggagattcattttatttctgttcagaagttcagagaaagtcagatttgtttttgatcaaataatgaaagagaaagggtcttaaagaaaaagttggctaggtacagggctcacacctgtaatcctagcactttgggaggctgtggcaagaggattgcttgagaccaacctgagcaacatatggagacaccgcctctgcaaaaattaaaaacctagctgggcgtgatggcatgcacctgtagtcccagctacttgggaggctgaggtgcaaggatcacttgggcccaggaagtcgaggctgcagtgagccatgatcgtgccactgcactgcagcctgggcgacagagcaagactctgtctcaaaaaaaaacaaacattaaaattgaactggtctttgaaagatgggtaggattttcacaaggagtaaaggcttttcagacacacagggtgcgtgagcaaaatgttagattgcttacaatatgagagacactaaagtttcttttgaaaatcactaaaaatactagtaattaacatatataaaatgtgtcatgtaccatgagagaggctttcaggcatttaaatctcagtggcaggaaggcgtagagagctggaagagaggtctcgggctgttggtgagggagcgcagggagagagagggcgggagtgaaggcatgtttgggagaaggcctgcaaccagccctctgccctctgccctcacacacctttgccgtacccctgtcaccacccagcttacagaatcacctggggctctgatgaagctgtagattccgattcagagagtctgtgttcctaacaggccttgggtgatgccagtgctgctggtggcacagagcgctctgaggagggcggtgctggctcatcctgttcaaagcggaggtcagctagcattcattcctgcagccaccttgtctcttgtaaacttgaatgtctctctccgcccattttcaccctccctgtctttacttaacaccagcttcactacctgtgttttccatcacactccttcctctctcttctagccttggcccatcacctgtttgcttcagtctccgggaagaaaacccccagccctgctgcttcctctctcaggcggccgttcctgtctcccctggctccctccccaacagtgcactggccagccccttccctccagtgttctctctgctccttctcaccacctgggcctcagcagagcactctgagagcttctctgtcgatagtaaaaccctcattctctccttgagtgaccttgtttgctttcccagcttcagcgctcgcctgcatgatgctcttcagcctgtacattactaactccgttactctgctggcactgccaccgcaaggtcccacagacttggcggcttaaacaaccgaaattgatttcatcacaattctggaggctctaagtccaacagcaaagtgtgacacgattggtttcttctgagggcctctctcgtctgcttgtcgatggccgtctcctggtgttttcacatggtcttccctctgtgcgtgtctgtgtcctgcttttgtcttagaaggacaatagtcatgtaggattagggtccacccatatgacctcactttaccataattacctctttaaaggccctgtgtccaaatagagtcccattctgaggtactggggtttaggtctctaacatgaacttgagggggatgcagtttagcccataacactaactctgacccctctcacgagcatcaggcctgcagatccagctccccctcccactccccatgtctctctctacagcgtgtcccaaagagatccctcctggcccccttaccattccttcctcctgctttcccgatccagatcagggccttgggatcatctctgactctcccccatcctccttcccatcacttggtcgtctgttgaattgtctgcacatcttctgtgtttgcctgttccttcatattgccagtgccatggtttgagccactaacattcccagacacttctgcctggtcatcttcctctccagcagcccagcttacattcacttgccttactaagcagagctccagctctgtccttcccttgcctgggaagcttccattgctccccactgctgtagggtatcataacggtcttgtgaggtagacaggctaggtattgttattgttatttggtagttttagagatgaggaactaaggacccagttgctcagtgtttcctagctagtgaatagagactagacaccaagtgttctacgtgcagactttatactgctcagcctggcacacaaaatggcaatggcatagtccccagactgcggtcccaactgtctctttcctaacagctccccaggcacccacacttttctgcctctttttcaatctgtacccttgaccctcctcctttttctgctttgtcagactccttaaggcacttcataaattaaccatttccagggatttcccctcacacatgagttattccagtggacagggcagcctcatgggtgcctgtggagggtgaagggtctgcctggccgtaggtgtgatcacacactcccgttgtaacccctgtctcctgtgacacttgctgccccacgatttagctgctttgtgttccgtgcctcctgtttgctggtgaactcctgagttggggggcgtcattccctccactgtagttcttccgcgatgctgactccacccacggtcagcaccactcggaaatacttcacagtcctgtagaggaagacaggtccaggtttccagttacccttctatgtctggatactctgctcattcactgaagccaggccccttcctgcacttatgcctctacccagataatgagttctacccactgatgacctcctctcctctagtaacagtccgcctccctaatgagcatctctggctgacacacgttccgttctccaggcctgtgagccctggtccctcgctgttgctgagccacagcacccgcccttctggcctcactttagagcactgtcatttcagagcagactacgcgcggggtggccaggtgaaatgcagctgacggctctgcgaccaaatgtgaccaaagggccacattcccagcacccggctccaaaggcagagcttggattctatgcccagcacaggttttcagggcttcctcctctctctgggcctaaacagtgatccctttccctgtttcccactacatctggcagaatttaggccacatttcattttcttcttccgcccatggggctccctgcccactgtgttcccctgtcactctgtccaggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagcagatgggacctacaccctaattatccggctgcggcacaacgtgattaagacaggtgtggatcaggatctgaggggctgttggaggagcagaagccaggccagggcaaacctagtgggtatccttgggcaagtgaagggtctgtgtccactctgcccaccccatcgctccttcctctcccaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcatgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaacttggcgaaaccccatctctactgaaaatacaaaaattagccaggcctggtggcaggttcctgtaatcccagctacttgggaggctgaggcaggagaatcgcttgaacccgggaggtaaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggtgagaagcccgtggctgcagagtcacgcctggcagcagcacacccctccctccacactcatggattcctcagagaagactggcttaatttgtggcccacgtcccagccaatctctgtaaaatcactgagctgcagcacagggggcccagaatggggaggggacttggccatagttccatagccagttgccctctcctattgcgtttaagggatgatgtggtcaccagggaggaccaggcagggattcagagggcggggttctacatttggttccaaatttgaggcatttaacttctcaaagctctgtttctccatctctgaagctgatagggaggtgttacctgtcttgcttgcttcacagggttggtaagattaaaagaagtccctgtattgaggcacttagcgaagtctaaattgtaaaaaagatggcgctggtatctagctccacaaaagggtgagcccttatcctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgctttgtgcatcagttactatacttcactgcagtattggcaggctcagattttgggttttttggccttagagtactagccccaggtgtgtaatctgagggcgatgggtctgcagatggggaggtgcccaggggaggatgaagggaccctgacctggggtcgggggcctaggtttactctcttttcgtacttgtgtggctttggtaaggtcttgttaggaaaggtgtaccatgtgtccatcaccagctgcagaccttcatctcccaatacacctcatggtgcttcacggttattgcagtttttacaaattgaaggtttggccaggcatggtggctcatgcctgtaatcccaacactttgggaggctaaggtgggcggatcactaaaggtcaggagtttgagaccagcctggccaacatggcaaaaccccgtctctactaaaaataaaaaaatcagctgggcatggaggcaggcgcctgtaatcccagctacttgggaggctgaagcaggagaattgcttgaacccgggaggtggagcatgcagtgagccaagatctcgccactgcactccagcctgggcaacagagtgagactgtgtctcaaaagaaaaagaaaaggacaaattgaaggtttctggcaacactgcatcaagcaaatctgtcggtgccattttcccaacagcatgtgctcacttagcgtctctgggtcacattttggtaaatcctctcgatatctcaaactttttcattatatctgttatggtgatgtgtgatcggtgatctttgatgttactattgtcattgttggggcaccacaaattgcacccatataggatggtgaacttagccgggcacggtggctcgcgcttgtaatcccagcactttggcaggccgaggcaggtggatcacctgaggtcaggagttcaggaccagcttggacaacatggggaaaccccgtctctactaaaaatacaaaaaacagccgggtgtggtggcaggcgcctgtaatcccagctacttgggagactgaggcaggagaattgcttgaacccaggaggcggaggttccagtgagccaagatcgtgccattgcactccagcctgggtgacacagtgagacattgtcaaaaaaaaaaaaaagatggtgaacttaataaatgtcgagtgtgttctcactgctcacactgctcactccattccctgtctctctccctcttcttgagtctctccatgccctgagacacaaaataatattgaaattaggcctgttagtaaccctacaatggcctcttaagtgttccagtgagagaaagagtcattggccaggcctggtgactcacgcctgttatcccagcactttgggaggccaaggctggtggaccccttgagctcaggagttggagatcagcctgggcaacacaatgaaaccttatcgctacaaaaaatataaaaattagctgggcatgtggcacgcacctgtagtcccagctactaggaagcctgaggtggaaggagcccttgagcctgggaggtgaaggcagaggctgcagtgacctgagatcctgccactgcactcccacctgggcgacagtgagaccctgtctcaaaacaagaaaacagaaaaagggagaaagaatcacacatctctcactttcaatcaaaaggtcaaaatgattatgcttagtgaggaaggcatgttgaaagctgagagaggccaaaagtcaggtctcctgcaccaaacaggtagccaagttgtgaagggggagttctttaaggaaattaaaagtgctgctccaggttgggcacggtggctcacaactgtaatcccagcactttgggaggctgaggcgggcagatcacaaggtcaggagttcgagaccagcctggccagcatggtgaaaccccgtctctactacaaatacaaaaactagccaggcatggcagtgggcgcctgtaatcccagctactcgggaggctgagataggagaatccttgaaaccggaaggcagaggttgcagtgagccgagatcacaccactgcacttcagcctgggtaacaaaagcgaaactctgtctcaaaaaaaatgttttaaaaagagttcgagaccagcctggccaacatggcaagaccccatctctactaaaaatacaaaaaattagctgggcgtggtggtgcatgcctgtactccgaactacttaggacgctgaggcaggagaatcgcttgaagtggggaggcggaggttaccatgagtcaagatcgcaccactgcactccaacctgggtgacagagcgaaattctgtctcaaaacaataaaaaataaaaatgataaattaaattaaaagtgctgctctagtggacacacaaatgatatgaaagcagaatagcattattgctgatacggagaaagtttgagtctggaaagaagatcaaatcagccacaacattcctttaagccaaagcctagtccggagaaaggccctcactctcttcaatcctttgaaggcagagagaggtgagaaagttgcagaagaaaagtcagaagctaacagaggttgttttgtgaggttgaaagaaagaagccgtctctgtaacataaaagtgcaaagtgaagcagcaagtgctgatggagaagctgcagtaagttatccatcagatctagctgatctcactgacgaaggtggctacactcaaaaacagactttcaatgtagacaaacagccttctattggaagaagatgccacctgggactttcatagctacagaagagaagtcaatccctggcttcaaagcttcgaaggacaggctgactctcgttagggctaatgcagctggcgactttaagttgaagccaatgctcatttaccattccgaaaatcccagggctcttaagaatgatgctaaatctattctgcctgtgctctgtggatggaacaacaaagcctggatgacagcccatctgttcccagcatggtttaccgaacattttaagccactgttgagaccaactccttcgtcggctctgtcggccaggctggagtgccgtggcatgatctcagctcactgcaacctctgcttctaggttcaagcgattctcctgcctcagcctcctgagtagctgggattacaggcatgagccaccgcactcagccaaaaaaaatattttttaaagttattactgctgattgacgatgcacctgattacccaagggctctgatggagggataccagggaaataatattgttttcattcctgctaacacatccattctgcagcccatggatgaagaagtaatttcaactttcaagtcttttttaagaaatacattttgtaaggctagagctgccatagtgattccgctgatggatctgggtaaactgaaaacttagaaagcattcatcattctagatgccattaagaatattcatgattagggccggacgtggtggctcatgcctataatcccagcactttgggaggctgaggcaggtggataaactgaggtcaggagtttgagaccaagctggccaacatggtgaaactccatctccactaaaaataaataaataaataaataaataaataaataaataaataaatacaaaacttagtcaggtatggtggcacgcacctgtagtcccagctactcgggaggctgagacatgagaatcgcttgaatccgggaggcagaggttgcagtgagccgagatcgtgccaatgcacttcagcctgggtgacagagtgagactctctcaaaaaacaaaaaaagaatattcatgattaggccgggagtggtggctgacacctataattccagcactttgggaggctgaggcaagaagatcgcttgagcccaggaggccaagagcagcctgaataacaaagtgagaacccatctgtattaaaaaaatttaaaaattaggccgagtgcagcggctcacacctgtaactccagcactttgggaggatgaagcgggtggatcacttgaggacaggagttcgagaccagcctgaccaacatggtgaaaccacatctctactaaaaatacaaaattagccgggcatggtggcgctttcctgtaaccccagctatttgggaggctgaggcaggagaatcgcttgaacccgggaggcggaggttgcagtgagccgagatcatgccattgcactccagcctgggtgacaaaagcaaggctccatctcaaaaaattaacattagcaggagtttgaaagaagttgattacaaccttcatgggtgactttgaggggctgaagacacacttcagtggaggaaaaaactgcagatgtagaaatagcaaaagaactagaattagaagtggaccctgaggccaggcccactggctcacacctgcaatcccagcaatttgggaggccagggcaggaggataacttgagctcagaagttccaaaccaacctgggtaacatagcaagacctcgtctctacaaaaaaaaaaaaaaaaaaaaaaaaagtggagcctgaagatgggactgaattgctgccatctcatgataacatttgaacagatgagttgcttctatggatgagcaaggaaagtggtttcttgagatggaatctactcccggtgaagaggctgtgaacattgctgaaatggcaacaaagatttaggatattacatatacttagttgataaagcagcagcagtttgagaggattgactccatttctttctttctttttttttttttttgagatggagtcttgctctgtcgcccaggctggagtgcagtgcagtggcatgatcttggctcactgcaacctccacctcctgggtccaagaggttctcccacctcagcctccccagtagctgggactacaggtgcacgccaccacgcccagttaatttttttctatttttggaagagatggggtttcaccatgttggccaggctggtctcgaactcctgacctcaggtgatccacccgcctcagcctcccaaagtgctgtgattacaggcgtgagccaccgctccaggccagcattgacttcaattttgaaagaagttctactgtgggtagaacgatgtcaaacagcatcatatgctatagagaaacctttctagaaatggagagtcggccgggcatggtggctcacacctgtaatgccagcactttgggaggccgaggcgggcagatcacctgaggtcaggagttcgagaccaacctggccaacatggtgaaatctcgtccctactaaaaatacaaaaatgagacgggcatggtggtgggagcctgtaatcccagcttcttgggaggctgaggcaggaaaattgcttgaatctgggaggcggagcttgcagtgagccgggatcgtgccactgcactccagcctgggcaacagagggagaccccatctcaaaacaaaacaaaacaaacaaaaacacaaaaatgaaaaaagaaaagtcaattgatgcagaaaatttcattattttcttattttaagaaattgttttcacctgaaggcactaggaaaaataaaaacaaaaataaggaaaaaaaaaagaaattgctacagtcaccccaaacttcaccagccaccaccctgatcagtgagtggtcatcaacatgaggcaagacccttcactagcaaaaagattaggacttgctgaaggcacagatgattgttagcatttttagcaataaaggttttttgttttgttttgttttgttttttgaggcagagtcttgctctgtcacctaggctggagtgcaatggtgcattcttggctcactgcaacctctgcctccggattcaagcgattctcctgcctcagcctcctgagtagctgggactataggcgccagctaccacacccggctaatttttgtacttttagtagagacggggtttaactatgttgtccaggctggtctcgaactcctgacctcaggtgatccacccgtctcggcctcccaaagtgctgggattacaggcacgagccactgcgcccggccaattatttttaaattaaagtatgtacatatatatgtttttaaatataatgctattgcacacttaatagactacggtatagtgtaaacctaactttttttttttgagacagggtctcactctgtcatccaggctgaaatcagtggcactatcacagctcactgtagccttgacctcttcgggctcaggtagatgatcctctcacctcagcctcccaagtaactgggactataggtgagtgccaccacacccagctaattttttatttttttgtagagatggggtcttgcaatgttgcccaggctggacttgaacttctgggctcaagtgatccgtccgcctcggcctccctaagtgctgggattacaggcatgagccaccgtgcccggaccatattgtgtaaacataacttttctatgcagtgggaaaccagcacctctgtgacaccctttatcgtggtggtctggaaccgaacctgcaatatctccgaggtctgcctgtattcataatttccattaaatacaggttttggcctggccttgctctggctcctgatcatactccagccctggtcacaatatttggcatcactaccttcctttaatcttcagctgcctttcggtaaaatgaaactcctaaagttgactttgcaaaacaacacttctcctgtgtttcccaaacccgcccttcaatctctgtggcagatgttttgatcctagcgtccggattcttcatctatttttagggctccaatccttgccccattttaacctttgattttgcaaaccaatcccaaaaccttctcatagatctttgattcccttccaggaagggtgtggtgggaggactacggttaagcacctcctccgtgtccttttaggatgtgaggacaggttcaggtgggttaaatgagtcctgcagttgaacccaggctgacctgataccaagttcaatgcgccttctctcaggctgtgctgccttcttccggcctcagcttggatgtattagtcagggtcctctagagggacagaactaatacaatagttgtatatataaaggggagtttaaggagtattgactcacgcaacaggccgtctgcaagctgaggagcaaggaagccagtccgcatcccaaaacctcaaaagtagggaaggtaacagtgcagccttcagtctgtggtcaaaggtccaaacgtcccaaagctgaagaacttagagtccagcgttcaagggcaggaagcatccagcacgggagaaagatggaggccagaagactcagccagtctggtctttccatgctcttctgcctgctttttattctgcctgctctggcagctgattagattgtgctcaccccaattgaggtctacctttcccagtcctctgactcaaatattaatctcctttggcaacaccctcacagacacacccaggatcaatactttgtatccttcaatccaatcaagttgacactcaatattaaccatcactctggggttctgttatccagtcagtcttcatttgtctttgggtctccatgtagcagtccttctggcccttgacagctttccatgacttcaaaagccaacttttcttgagtgtgtgatccgaagacatacatatggcaggcacagctgcctgaagccctttccagcctgttcaatgtttgtagctgtaatgagcattcttcctgaggagcccagcctcacaagaggttataaatcttcagccttggttgtaagtgaccggagagagtttatcaccctcttccagagagctgaggtcattcgccatgattccctggttcttgcccacataaggtctatgggccatttttccgtctgctcactgtctagaggcttcttcatccactgtctggatgaaccttgttggcgtggcttctaatttcctgaagaaactcagtgtcacttttttttttttttttaaagacagagtctcattctgtcgctcaggctggagtgcagtggcacaatcttggctcactacaacctccgcctcccaggttcaagcaattatcctgcctcagcttcccaagtagctgggattacaggcacacgccaccatgcctggctaatttttttgtatttttagaagagatggcgtttcgccatgttggccaggctggtcttgaacttctgacctcaggtgatccacctgcctcggtctcacaaagtactgggattacaggcatgagccaccgcgcccagccaagtgtcactttcatgcttagaaagttcactgtattattttaccttccagctttgtttgtttgtttgtttgttttgggacggaatctcactctgtcacccaggctggagtgcagtgttgcgatttcggctcaccgcaacctctgctgccagggttcaagcgatcctcctgcctcagcctttccagtagctgggattacaggcatacaccaccacacccagctgatttttgtattttagtagagatggggtttcaccatgtgggccaggttggtctcgaactcctgacctcaagtgatccgcccgccttggcctcccaaagtgctgggattacaaacatgagccaccctgcccggctaccttccagttttgttttgttttttaatttgaaaactacatagaagtacaaagaataacataacaaatatgtacccatatattctccacccaagtttaatcatgttaacatttcattagtctgtgaagttttttaatcaaaaaagaaataaattggacaccatggttcatgcctataatctcagccctttgagaggccaatgcaggaggatcgcttgagcctagaagtttgagaccagcctgggcaacacagtaagatcccatctctacaaaataaataaataaataaaacattatggctaagctggaagtccatcttgttcccctggcaaagccagccactttaatgaattcagctggcaggcttctagtttgtttttatacttctactacataatagtattgagctgccaggtgcaatggctcacgcctgtaatcccagcactttggaaggctgaggcgggaagattgctcgagcccaggagtttgagaccagcctgggcaacatggcaaaccccctctctataaaaaacacaaaaaaggccaggagcagtggctcacgcctgtaatcccatcactttgggaggccgaggcgggtggatcacaaggtcaggagatcgagaccatcctggctaacatggtgaaaccccatctctactaaaaatattaaaaattagctgggcgtggtggcaggcgcctatagtcccagctactcaggaagctgaggcaggagaatggcgtgaacctggaaagcggagcttgcagtgagccgagatcacgccactgcattccagcctgggcaacagagtgagactcctactcaaaaaaaaagggcctggtgcagtgggtcatgcctgtaatctcagctctttgggaggccgaggtgggcagatcacatggtcaggagatcgagaccatccttgaccaacatggtgaaaccccgtctctactaaaaatacaaaaattagctgtgcctggtggcgcgtgcctgcctgtatactagctactcgggaggctgagacaggagaattgcttgaacccaagagtcagaggttgcagtgagcaaagatcttgccatagcactccagcctggcgacagagagagactccatctcaaaaaaaaaaaaaattaggcaggcacagtggtgcgcacctgcagtcccagctacttagggaggctaaggtggaaggatcccttgagccctggggggcagaggtttcagtgagccaagattgctccactgcactccagcctaagtgacagagtgggaccctgtctcaaaaaaaaacaagaataatattgagcttttattcattttattattgaattagtctgttctcacactgctataaagatacctgagacagggtaatttataaagaaaagaggcttcactggctcatggttctgcgggctgtacaggcttcttgcttctcaggaggcctcaggaaacttataatcataagaggaaggggtggaagacgaaggggaagtaatcacgtttccatggtgggagcaggagaaagacaaaaggcaaaagggaaggtgcaacacacttacctcccaccaggccccacctccaacactcagaatcacaattcaacatgagatttgggtgggcagacagagccaaaccatatcaattttatttatttatttatttatttatttttcgaggacagggtctcactctgtcatccaggctggactgcagtggggtgattacagctcactgcagcctcaacctccctggcccaagcgatcctcccacctcagcctcccaggtagctagaactacaggcttgcacaaccatgcccggcaaattttttgattttttttgtagagatggggcctccttatgtcgcccaggcttatcttaaactcctggactcacaagcaatcctcctatctcaggctccctacgtgctgggattacaggcatgaaccaccatgcccggccagtattgagtcttaaaattcttgtaactggtatattacaggaatgtaatttgctctgttttcgctcaatattgtttttagacctaatcacattgatgcccatgccaagcactgttctgggcactgagaatacaaattctcagagtcttcactctggacagctttcctctcagagtctttcctctcagagtcttcactctggacaggttgggaggcatacatagtatgaagggaccagtatctatctagctattcccatgttgatgggcattgcaaatgcatttccattggtttactataacagtgttccaaagaacatctctggccaggtgcagtggctcacggctgtaatcctaacactttttaggaggccaaggcaggaggatcacttgaggacagtagttcaagaccagcctgggcagcatagggagactgtctctacgaaaaatcaaaaaattatggccgggcatggtggctcacgtctgtaatccctgaactttgggacatcaaggcaagtggatcacttgaggtcaggagttcgagactagcctggccaacatggtgaaaccctatctctactaaaaatacaaaaattagccaggcatggtggcaggcacctgtaatcccggctactcaggaggctgaggcaggagaatcacttgaacccaggaggcggaggttgcagtgagctgagatcacaccactgcactccagcctgggtgacagagcaagactctatctcaaaaaaaaaaaaaaaatcaaaaaattagccaggcatggtagtgcacacctttagtctcagctactcaggaggctgaggtgggaggatcacttgaacctgggcagtcaaggctgcagtgagccaagatcatgccactgcactccagcctgggcaacagagagagaccctgtctctaaaaaaataataataataaagaaaaaaacagctctgtttatgtctcctggtacatacatactatgtatatagtttgcaaactcaaagatccagatagtcaattttttaggcttgtgggccgtatggtctctgtcacaatcactctgccctgtctttctagcacaaaagcagctataaacaatacatacatgaattttttatagacatcgagatttgaatttcatatgatttttacattttataaaataatctttttaaaaattttcccctaaccatttaaaagtgtaaaagccggccaggcgccgccatggctcacgcctgtaattccagcactttgggaggctgaggtgggcagatcacttgagatcaacagttcgagaccagcctggccaacatagcaaaaccccatttctactaaaaataaaaaaattagctgggcatagtggtgcacacctgtgatcccagctacttgggaggctgaggcaggagaatcgcttgaacctgggaagcggaggttgcagtgagccaacatcatgccactgcactccagcctgggtgacagagtgagacttcgtctcaacgaaaaaaaaaaagtgtaaaagccattcctaattcagtgtacatcagtgtacatactcaggtctgcgtactcctgctctgaggcatacctgagaagtagagttgcttggtcacaggacatacacatttccacattaactagacactaccaagttgccatccaaggaggttttttttttacaatctacactccccccagcaacaaatgagagttactccagatcctttacaaagatgctctaagcccagtaccagatgaaaacaggaagtgggaggggaagctgccagccccttctaaccatgaagaaatacctggtagagccttctggatgctggaaggatgaataacgggggtctctggagcctgccccctgtcagatcactgtgacttctgagcctccagtccagctcagccccatgtgtcatggccagtgataatgagccctcactctctgtttggtctttattctcccccatgtggggctgaagtctggattgagccgttattcaagatgtacagctttcttgacaggaaagtagtgtcacagaaacagcaggggcttggcaagatgatctaactgcaaatcctacctggctcagccaccagctagttctgtgatcttgaacaagttttttcacttctctgaggccatcccttggctacaacacaccagttggttgacaggatgaaatgacgaaagtgccttacacctgtaatcccagcactttgggaggccaaggcgggtggatggcttgagcctgagaggtgacagcatgccggcagtcctcacagccctcgttcgctctcggcgcctcctctgcctgggctcccacttcggtggcacttgaggagcccttcagcccaccgctgcactgtgggagcccctttctgggctggccaaggccagagccggctccctcagcttgcagggaggtgtggagggagaggctcaagcaggaaccggggctgcgcgcggcgcttgcgggccagctggagttccgggtgggcgtgggcttggcgggccccgcactcggagcagcgggccagccctgccaggccccgggcaatgagaggcttagcacccgggccagcggctgcggagggtgtactgggtgccccagcagtgccagcccgccggcgctgtgctcgctcgatttctcactgggccttagcagccttcccgcggggcagggctcgggacctgcagcccgccatgcctgagcctcccctccatgggctcctgtgcggcccgagcctccccgacgagcaccaccccctgctccacagcgcccagtcccatcgaccacgcaagggctgagaagtgcgggcgcacggcaccgggactggcaggcagctacccctgcagccctggtgcggaatccactgggtgaagccagctgggctcctgagtctggtggagacttggagaacctttatgtctagctcagggatcgtaaatacaccaatcagcaccctgtgtctagctcaggttctgtgaatgcaccaatccacactctgtatctagctactctgatggggccttggagaacctttatgtctagctcagggattgtaaatacaccaatcggcactctgtatctagctcaaggtttgtaaacacaccaatcagcaccctgtgtctagctcagggtatgtgaatgcaccaatcgacagtctgtatctggctactttcatgggcatccgtgtgaagagaccaccaaacaggctttgtgtgagcaataaagcttttatcacctgggtgcaggtgggctgagtccgaaaagagagtcagcgaagggagataagggtggggccgttttataggatttgggtaggtaaaggaaaattacagtcaaagggggtttgttctctggcgggcaggagtggggggtcgcaaggtgctcagtgggggtgctttttgagccaggatgagccaggaaaaggactttcacaaggtaatgtcatcaattaaggcaaggacccgccatttacacctcttttgtggtggaatgtcatcagttaagttggggcagggcatattcacttcttttgtgattcttcagttacttcaggccatctgggcgtatatgtgcaagttacaggggatgcgatggcttggcttgggctcagaggcttgacagctactctggtggggccttggagaatgtttgtgtcgacactctgtatctagttaatctagtggggacgtggagaacctttgtgtctagctcagggattgtaaacgcaccaatcagcgccctgtcaaaacagaccactcggctctaccaatcagcaggatgtgggtggggccagataagagaataaaagcaggctgcccgagccagcagtggcaacgggcacaggtccccatccacaatatggcagctttgttcttttgctgtttgcgataaatcttgctactgctcgctttttgggtccacactgcttttatgagctgtaacactcaccacgaaggtctgcagcttcactcctgaagccactaagaccacgagcccaccgggaggaatgaacaactccggccgcgctgccttaagagctataacactcaccgcgaaggtctgcagcttcactcctcagccagcgagaccacgaacccaccagaaggaagaaactgcgaacacatctgaacatcagaaggaacaaactccagatgcaccaccttaagagctgtaacactcactgcgagggtccgcggcttccttcttgaagtcagtgagaccaagcactcaccagtttcggacacaagcccaggagtttgagatcagcctgggcaacatgatgaaatgccctctctgcaaaaaaaaaaaaattacaaaaattggcggagcatggtggtccgtgcctgtggtcccagctacgcgggaggctaaagtgggaggatcgcttgagcctgggaggtgaagactgcagtgagctgtgattgtaccacagccctctaggctgggggacagactgagaccctgtttcccctccgcaaaaaaattgacaaaagtgtaataagaggtgcctgatatggctaggcgcagtggctcatgcctgtaatcccagcactttgggaagccgaggcgggcgggtcacctaaggtcaggagtgtgagaccagcctggccaacatggagaaagcccatctcttctaaaaatacaaaattagccggctgtgggggcagtggtggagcatgcctgtaatcccagctactcaggaggctgaggcaggagaatcacttgaacccaggaggcggcggttgcagtgagccgagatcgtgccattgcactccacccactccagcctgggcaacaagagccaaactctgtcttaaaaaaaaaaaaaaaaagtgcctgacatataagaggtgtgcaatgcaatagttgccaggcaacatgtttaagaatgtggagctcctgccttccatggtcctgttaaaaacccaccctcaaggccaggtgcagtggctcatgcctataatcccagcactttgggaggccgaggcgggtggatcacctgaggtcaggagttcgagaccagcctgaccaccaacatggtgaaatcccacctctactaaaaatacaaaattagatgagcatggtggtgcatgcctgtaatcccacctacttgggaggctgaggcaggaaaatcactagaaccagggaggcggaggttgtagtgagccgagatcgtgccattgcactccagcctgagcaatgagcgaaactccatctcaaaaaaacaacaacaaaaacccaccctctactcccagggagctgggtacagagctgggccacatcagtgcaaggtgctgagccacagagctaaggcggagctgcaggaccgcggaccagataacagtgtgtgagatcagtgtgtgagatcagacgtccctgccattggtgaccaccagggggcccccaagcaccagagatggccccatccagtcaccacatccacttctcatccagagatgtctgtttcttggcacgctggggtaaattaggacagaaggtgacagtcttgggtgtggtcagtcagactgccccaggcaggccttgtggcctgtagaaaacgttcaggcctaggccgggcacggtggctcacgcctgtaatcccagcactttgggaggccgaggcgggtggatcacgaggtcaggagatcgtgaccatcctggctaacacggtgaaaccccgtctctactaaaaatacaaaaaattggccgggcatggtggcgggcacctgtagttccagctactcgggaggctgaggcaggagaatggcgtgaacccgagaggcagagtttgcagtgagccgagatcgcgccactgcactccagcctgggcgacagagcaagactccatctggaaaagaaaaagaaaacgttcaggtctgagccagaggcccaggctgtaattctgtcacttaccatgaccttgggcaaggcacttccttccctggcccagttcacggggttggaatcgactccaaggtcccttccagcattaacgctgcatggttctaagatgagaagatggggcagtttcccctctctcaccccagcccgtgtccacttcaaggtgaatgaccagggaagtcacgtgtcccaatcccgcagttccaaagcccttggggaccctactgtcagggtcgtgcacgaggaggtgaaggtcaggtgagccaatcgcctcgaagggtcttgcctcattcgggacagacatccggtttcctctggctctaccgggattctaggggctttagccgaatgagtcatggggggcgggggggtttctgggggagttcccagctaatcaacttgggacaggacagcctggaactttcgatggtgcctatccaagtgtggggtgggcacagcagccaagacccaatgtccttatctcaggtaggggctcaggaggtctcccagacaggcagcctccggagagtttgggggtaggaatgggagcaaccagcttctttttttctctcttagaatttgggggcttgggggacaggcttgagaatcccaaaggagaggggcaaaggacactgcccccgcaagtctgccagagcagagagggagaccccgactcagctgccacttccccacaggctgctgccgcttccaggcgtctatcagcggctcagcctttgttcagctgttctgttcaaacactctggggccattcaggcctgggtggggcagcgggaggaagggagtttgaggggggcaaggcgacgtcaaaggaggatcagagattccacaatttcacaaaactttcgcaaacagctttttgttccaacccccctgcattgtcttggacaccaaatttgcataaatcctgggaagttattactaagccttagtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggtgggtgagagggctgtggagggaagcccggtggggagagctaagggggatggaactgcagggccaacatcctctggaagggacgtgggagaatattaggagcagtggagctggggaaggctgggaagggacttggggaggaggaccttggtggggacagtgctcgggagggctggctgggatgggagtggaggcattacattcaggagaaagggcaagggcccctgtgagatcagagagtgggggtgcagggcagagaggaactgaacagcctggcaggacatggagggaggggaaagaccagagagtcggggaggacccgggaaggagcggcgacccggccatggcgagtctcactcagcatccttccatccccagtgtgccacctacaagctgtgccaccccgaggagctggtgctgctcggacactctctgggcatcccctgggctcccctgagcagctgccccagccaggccctgcagctggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacaggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaaggtcgtgctggcattctgggcaccacagccaggcctgtgtatgggccctgtccatgctgtcacccccagcatttcctcatttgtaataacgcccactcagaagggcccaaccactgatcacagctttcccccacagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccagtcacgtccttcctccttcttgagtccagctggtgcctggccaggggctggggaggtggctgaagggtgggagaggccagagggaggtcggggaggaggtctggggaggaggtccagggaggaggaggaaagttctcaagttcgtctgacattcattccgttagcacatatttatctgagcacctactctgtgcagacgctgggctaagtgctggggacacagcagggaacaaggcagacatggaatctgcactcgagcagccaaagcctggcagggaagacagaggcacagggaccatgggaacccggaaaggagagggcatggggtctgggtgggcttaacaggccagacacagccagacaagatgaagccagggagtgctgagcatctgcaccaggcttgtcatttaccatcttccataaacttgagcccatccatcaagttgcccacaaagtggaagccaagttcaaggtgaccactggggtcagagcttctctcctcagactcggtctctgcactcgccccagctggtcacttcctgcttgtggcagccttgggctgaagagcgctaagctcacagcccaggagggtggggagctgtggcaagcagggggggcagcgaccgcaccacaggtgtgaggcctgcctgcagccaaagactcctgtgtggctttggggtacccccaccagtccccagtccactatctgcccaaaccttctcctcctcagctcctcagtccctcccacctcccctgcccgtggctcctcggaaagcagggtcagaagttcccactgccagctcggagtcatccatctaggggctcagagatgtgtgaggcaggcaaggaagggttaaagaaaggtccggcccctcatccccccgcctcccatcccccagtccttttttggaggcaacagatcaaatcccaggctagtcagagtgtgggtggtgttggaccaggttcgggagacagcagagcaggccaccctgccccagcactgtggggccctgagccaaagcctctcccctttcagggtacagctggctttgggggagggggcagcaggccagccaacttggctccaaggaagggaagctgctttcccctggcccttccccagctgagcaagcccacataggaccctgagccctgccgcctctgctcctcttcctcctcctcctcaccacaggagtgagccgttccctggccacagcacaggagtccagggagaggacactatgccctgccccgggtggcaccaataccaacagcacacacagtcacaaagggagccacgaggagctttatttatacatgaacgaaggtagatttccctcacatattacaaaatacacacaaacacacacacacacacacacacacacacatacacactttgcatctagaaagttcctcagaggtaagactactcctgggctggggcgggcgcacacaggggtgaccactgggcttgtggtccaggctgctcactctcctcaggtgccagcagatggagaggaaattttgaaagaagaaaccgggagacatcctggaggtcaggagtcaggagcggggaactggaagccgctagaggctcttgcaccatgtggagcggatgtgaggcacgatgcctcatctttcctcactgcttcccttggaggcgcctggggctgcgccagtccccagcccccactgcggccatgccaagcccctcagagtgcagcaatggctttagcagccacctggcggcccaggggcaggctgaggtccgtgatggccagaaccaccttggggctggacatggctgacaccttcaccagttccgacacctgccacggacagacagatgctgcttgcgggacggctggtggtgggtgtgctgtcccagggggaaggaggcccctccctgctctaagggctgccccgaggccccagcaccagcaggagagccgggaaggtggtactcacggtggtgaagggcatgaactgcaggacgctgccacggccaccctgctccaggcagtccacacactcctccatgaaccactgcacgaactgggtgtgggggccagcggtgcgagaccccaggatggaggagatgagcaggaacaggttggctgtagagagtggggggagagtgacaggagggagttccatgagagtgggtgaggtcacactctgggagaaggtgggactgaaaagggaaaagaaacacatgctgagcatgtccccaaaatggggtgtcagagagagaaaatataaaaggcaattggggaggggaggagggggaactagacaggagcctgggggccaggacagccaacaatgaggggcatggagagggaagggaggggcaccgcaaggccccttccagctgacaaggtctcccagcctccatgagaagagagactcgtccagcttagccccaggttcggcagcaggggtggggaactcacccaggactcggttcagagggtcccgcatgttgaccgtgtggagctgagaggctgagagggagctgctcatggatcggtctgctgtgggacggagcagatggagcgctgggaaacagcctgccgagtgcaaaagtggtgctccccggggatgccccaacccgaccttcacccatcggaggtaactggtacatggagagcccagagaagaccctgagatcaagagcacaaagggaggccaggtacagtggctcacacctgtaatcccagcattttgggaggccgaggcaggaggatcgcttgagtccaggagtttgagaccagccttggcaactagcgagacctcatctctacaaaaaatacaaaaattagctgggtgtggtgccaacgcctgtagtcccagctcctcgggaggctgaggcagactgcttgagcctaggagaacaaggctgcagtgagccgagatggtgccactgcactccagcctgagcaacagagcaaaaccgtgtctcagaaaaacaggctgggcgtggtggctcacgcctgtaatcccagcactttgggaggccaaggcgggtggatcatctgagttcaggagttcgagaccagcctgaccaatatggtgaaaccccgtctctactaaaaatacaaaaattagccaggcgttgtggcaggcgcctgtagtcccagagactcaggaggctgagacaggaaaattgcttaaacccaggaggcggaggttgcagtaagctgagatcgtgcgactgcactccagcctgggcaacagagggagactccaactcaaacaaacaaacaaacaaacaaacaaaaaacaaaacaaaaaaagggcacagagggacctcagatacagagatcccaatggaatgagagagaaaaactaacatgtggtgagcacacagggccaggggccgatcttggtacttcctaagctgcttactcctcacaacaccccatttacagatgaggagacccagacgggggctggctcagtcgctagctaaaggtcacagcacttgtagctggcaaacctagcatctttcttctgatcaagtgtatagttggtcccctagttcctaaaaggcttcagagaaaagttcaggctcaggagaaatctctggaaacaggaaaaatgccacagaaggaacccttggcagtaagcctggcagggaggaggggacagtgaaaaggatgacctccagggaagtggttggtggggggtgtgctctttaggcaggaaggtggggagtagccccatgccccagcccgggcctctccgggcatgttttgggggaaggaaggaaggaaggtcagagctggtgagtcaatggcacaggctgtgcctgaggcagtgaactcactcacttgggtagcttgtcatcccctcaaccctggggtaagggaggggcaggagggctgtgggggaacaactgtgggctgggctggacctgggcagaggagcttcaaccctcagggagtgagaacagcaacctcttctccaggggcaggacacagagcacccccttgggggctagaacagcaggtccctgccacaccctctctgaccagctgcaaagatgcctgcagctggggcagcggcagagtggcagcatcggggagtgaattcccaggaaaaggagcggcgcgcggccagcccacacactcactggggctcgaaaggatgttggcatcgtcctcattagagctcagcagtcgcatcaacttcgaaggctgcacatcgtccagggggaagaggctgatataatcctagagggagtgaaagtcactgttatacacccctaaaccccccagtttccagctgtcagggaaaagagcttgagctccgatttgagcgaggtcagcatggctagcagggcctcagcccctctctgctcaacccctcccacaatctgacaggccccttgtgcccatgggcaagctggggccacacaaatcacccatgcagattcctgaccaatcatgcccaggcacagctgccccaagggcaggggccacaactgcttccctttgcctggggaatccttaggaaatgctgtaacaaaccggtgaacaagtgaagccggcgagggcagctggggggcctacctcaatgtcttcgcggtgtctcttcttctggcgggtggacgcctgtcccttgtgggaggagtaggaactgagggcacaccacacggccagcctggcaaagggttccagaaaaagggggacagtgagaggtgccccaggagctttctgtgtctgactgggctccccaaagcccagtctcccagggtggcaccaggcgaggggtgcttgaccctgggtggccggagcagggcaagctctgaagagaatcttacttggcaagagcagtgcccggggggtccatgaggctgtgccacttggaggagtcagtgagcaggccaggtaggatgtggcccagcaggaccagggtcacttgctgcatgtccaggcagaagatggagtagagcagctccactgcccgcagcgtgtgctccttccgcgtctccttcagcagctcctagtgcgcaggaaagggggcagttcaggagccaggggcccgggatctggggctcctacaccctgccaccccagcatggctgtccagtaaggcccgcagagggggccccagatgttgctccgcccctcaggctgaatcccagtctctggccagagctccccaaggaggcaactctgaggcgaggcattccggggaggccacctggctcacggcagcctctcagggaagcctggcagaccaggccaggtgtggggagccaggggacaggacccatgtcggcccacagccactccagcccaagtaccttaatcaggttgttgcagaaccagtagacgccgcccatgtgcagcagggtgtcaaagatgtggatggagcggctgtccacccagcccttctccagcaccttggcaaaaatgtccgtcagcacctctttgatgggccgcttggggggcagcaggttccagtagggcattgtgtccaccccggtggagggaaacttgatctgcgtggctgtctgctgcagcacgtcggcacacatgcgctccaggatcgagttcatgatcaccaccctgggggagggccgagagaacctgaggctcaggtgccactgtagggtggggagggagaggagggaacacccatgccagactttcccttggacttaggttacggaaatctccctgaggcattaacccagttttgcgctgggggacggtataccccggggtgacctggcccctgctctgctcctggcaggtctctcacctgcaggacacaaagcctataaatagggactggggagggactttcctccccctggccattccagccagatattcacattttcttttattctccaacttcccccatcccccaggcctgggccctgccaacctgccacataaataaacacaatcacttccccctaggctgagtgcttgggggtccccgcccagccctggcctcctcccaaagtaaactgttccttccaggagaggcccaagggctgccccacaggactcttcccggcccctggtagctgggcagatagaagtgtatatccaggaattttctcatggaaagaggcttcggaagtgaatacagacccgggccgagtgctgactgttcctggaatgcagggtggctctgggaaagttgctatgacctttagagccacttttcccacctgcacaatggagccacagacttctcactaccccttacccagataggatttagggtgcttagaatgggttacaccagagcaaaagctccctacttggtagggcgggggggaaggtggtggagaaatgagagaagaaaggaaaaaaggaggaggcaaggggaaaacgagatgtgcttttccagaccgtccaaacctcattcagctcaatgcttccccttctccctattaagacatcctcaggcccggtgcggtggctcatgcctataatcccagcacttcaggaggctgaggcgggaagatcacctgaaatcaggagttcgagaccagcctggccaacatggtgaaaccccatctctaccaaaaatacaaaaattagccgggtgtggtggcacatgcctgtaatcccggctactcgggaggctgaggcaggagaatctcttgaacccaggaggcggagattgcagtgagcctagatagtgccacagcactccagcctgggtgacagagcgaaacgccgtctcaaaaataagtacataaataaataaataaagacatcctcaacgttgccataaagacatggcaacacccaaaacgtattagctggtaaacacccatgttcacagcagcactattcactatagcccaaaggtggaagcaactgaagtgtccactgacagaggagggatcaagatgtggtatagccacacaatagaggtttcttttgtttttgttttgttttttgagacagagtctcactctttcacccaggctggagtgcagtggcgtgatctcggctcactgcaacctccgcttcctgggttcaagcaattctcctgtctcagcctcccaagtagctgggattgcaggcgcctgccaccactccctgctcatttttatatttttagtaaggccaaggtttcaccatgttggtcaggctggccttaaactcctgacctcaagtgagccactcacctcagcctcccaaagtgctaggattgcaggcgtgagccaccacgcccggcccacaacagagtattattcagccttaaaaaggaaggaattcctgtcacgtgctactacatggatgagctttgaggacaccatgctgagtgaagtcagtgagtcacgaaaaggcaaggactgtatgattccagttaaatgaggcatctaaaaagtagtcaaattcagcagggcacggtgggtcacgcctgtaatcccagcactttgggagaccacggtgagaggatcactcaaggccaggagttcaagacctggcaatatagtgagaccctgtctctacaaagactagaaaaattagccggctgtgggcctgcagtcccagctactcgggaggctgaggcgagaggatcacttgagcccaggaatttgaggttgcagtgagactcactctgatctgggcaagggtaagaccttgtctcaacaacaacaacaacaaaaagtataaagtagtcaaattcctagacacacaaagtaaaatggtagttaccaggagctggagggaggggaaaataggaagctgttgttcagtgggtatggagtttcagagatgcaagaaagttctggagacctgttacacaacagtgtgaatatacttaacactactgaacagtacacttaaacatggctaagatggcaaatcttatgtgttttttacaattaaaaaaagcaaacaacttattggttgggtgaatgaactcaacgtaactggtcaccagggaagtcctccaagcccctgaagagccagggcaggaaactgtcctaagaggtaactgagggtggggcatggcctgtaaaatctacagacaggttcctagctcctagacagtcacacagctttgttcttttgggagctagttgtctagaacttgagtctctgcgggcagaccctgtttagggtctgcatttctgacaacacagcaggtgctggcatataaacgcttctgccacagagacacagtacatgtttgctgagtcagatgagtgaatgcatgaataggaaagtgagtgagtgatcaagtagcgtgtttgcgaaggtcagaaaagagaggggtgcttgttattggatgtgctgacttctcacaacacacttgaagggtctgagaagggaaggcaggttaccgacctctcattgtagaactgcagggtgttctcactaaacagtggccctgccagctggcggatcatctgcagcgacttctcacgctcatccagccccagcatccggacgtgggccacaagccaagccacagcacacaccgccagactgcataccttccctttgatgttatcagtgattttctaggggagacggaaaggtgatgggctaccatctatctccctttcttgagccaacatcaccttctcagcctctgcgggcagctaagtgcagcgggtggagtcccgggccacattccacacctctctccacaagtttgatcttcccagagctacctgggccagagggagtagctaagacaacgattacacaaaatatcaatatcaaaacatgagctcctggattaaaggtcttcttgcccttacgaaatataacaagtcatcactggctggctctgtgtctcaggggagcaaacgctgctgggaaggcggggctacctggatggactcgaaggccaggaccccattctcccaggcattgaggatttccaagatggcggctgagatgctgagacaggcctcatgccacttcatctgcctgcgggtgtgcagagaagtcagcacaggggagcaaggaacgggctcagggagcgggtcttgaccctgcccccaccgccacccttggagtgggcgcccgggccactgacactagcttcatctccgaggagttgttgagcagggccaccagggactccactttggtggagtcggggcggaagcaggggtggtcagggttcaggatcttgccctcctcaggcatgcaggtctgcatccaggtctcgaagaagggcacctcagctcctgtgcgcgactcggacagaatcacctgggaaaggggaaggggggcaccagccgagtggggagggcgcggcgcctgccagcgctggacctggggctgcactgtttcccgccaggctgctgctccagcccagcccaaagactggggacgaactggtctaagggagccagacgggggcaatgctgccacctagtggtcaatgtgaacatagggctgaaggtgcctctacggactccagcccgggtgggcacctggtttctgaggcccacagaactaactggctgagaggctgcgggggcgcaggcagtgaggtggggagagttccgggttacctccttcccttgagcccccgtcccggtcgctcccctctctcacctctgaaccataggtctgggccacatggcacagcatgaggaaggagatgtcaaacagcagggcccggacggaggccggtttggctgtggaaggacgggaaggctgagctcccagacgagggcaggggggagcccgtgtctgggttgacagggatcgggatttgcctctaggaaggtcagggaccaagtggctccttcaaagctctgaggctcagaatccttttcttgagtctcaactggaacatcatcccttccttgagaccaaagacccccagcaccctctcctggcatacctaaccaagtcgtaaagggatgagggggggaaggagacacagggatggtctgggaagaatccttttccagcattatccactttcaagctctgtggaagcttccattggtcatggctctgaggagggagcacagcctccccctgttgagctggggagccctcctccctcccacactctcccgccacacccctcctcagggcccactgggcctgcggatgcacagggctgacttactgctttcttcgctgccataggttgtgaattcattcaaactgaaaggaatggagacaggctgcattgaccagggcatgagctgagcagtagctgggcgctggggctacacatgttcagagagcgatagctagagtctgagttactggttaaacttaaaatgagacacattgctatagaaaaaaggtttttgtggtttttgttttttgttttttttttgttttttttgagaaagagtctcgctctgtcacccaggctggagtgcagtggcacaatctcagctcactgcaacctccgcctctgttcaagcaattcttctgcctcagtctcccaagtagctgggattacaggtgcccgccaccacacccggctaattttttgtatttttagtagagacagggtttcaccaagttggccaggccggtcttgaactcctgacctcaggtgatccgcccaccttggcctccctaagtgctaggattacaggcgtgagccaccgcacccggccagaaggatttttattgttagaagatttccaaggcctagagaatggctcactgaatggaaccatgttctatatatgtcaaattccagggcaatcaaaaaaggcaacagaatttgagagccccttattaataactgggcatacttggaattcctccatgcccaatgttcaacacctcaacccttaccctcatctctttaccaaacatgtccactccatcctcagctgaagagaaaggaacacttaggtcgtgagaacaggcccttcctccaagatctccagccaggatgctctgcctaggcccgtgggtctctggatgagacccagacccaggcacctgactcctaccctgctacctcctcccaacgcgcagcctccctgcacgccctggggtcaggggcttggccttcctcacttgatgaatttccgggcgaaggatttcagctttccagtggcggcggcggcagccagcagcaagtccagactcttcccggacagcatgtggcccaggactcccagcagtccctccggtgacttagagtggtctgcatccatcgtctggggacaggacaggaaatcaagtcctgaagaacactgaagaccccccacccaagatacagcctagccacattttctctcttcacaacctggaatgtaatctacatctttctgacttcaatctggaaaatcattcctaaaacccacccctgctctccgatccatccctctcatctacactggcatgcaggtggtaaggttggagtgggcaaggtcacggctaggatcttctctgtcctttccttttttagacagagtctcgctctatcgctgaggctggagtgcagtggtgcgatcttggctcactgcaacctctgccccccagggttcagcgattctcctgcctcagcctcccaagtaactgggattacaggcatgcaccaccacacccagtgaattttgtgtttttagtagagactgggtttcaccacgctggccaagctggtctcaaactcctgacctcaagggatcttcccacctcagcctcccaaaatgctgggattacaggcgtgagccaccgcacccacgtctctgttgtttccatgtgagatggcctaagtgaaagcgcctactgcagtgcctggtgtacaaatgaagctcccacgggttagcattcagtggtagctgcccttgcctcccctttcactacctccaaagcaactatgtataaaagctaaaggagacagaggtctgtggcctctgtttatttatctgcaagcagatggagcactggaaagaagaaagagaagactgtggtggccagggaagggcacactcaccttgaggatgtttgtgacagtgggctccgcccggaggatcagctggatgttgggctggatgttggcattctctcccgatttctgctggggtgcgtgctctcggtccgctttgctgtggacatcaccagttggccaaggaagggaagaggaatgaagagaaattcttgacacgttccctcgttcaagcccggaaggaaatgcgcagaggaggtgggaagcatgtaagaacctccgaggttggggtgaagtttatggaagcatagtcaatgttgcaatcactgatttagcattagtctttttttttgagacaggtctcactctgttgcccaggctggagtacagtggcacgatctcggctcactgcagcctctgcctccagagtagctgggcgctcaccaccacgcctggctacttttttgtatttttagtagagacggggtttcaccatgttctactggtctcaaactcctgacctcaggtgatccacccaccttggcttcccaaagtcctgggattacaggtgagccagcacacctggcaatttatcattagtcttttttttttttgagacagagtctcgctctgtcacccaggctggaatgcagtggcgcgatctcagctcagtacaacctctgctttccgggttcaagtgattctcctgcctcagcctcctgagtagctggaattacaggtgcataccatcgcgcctgattaatttttgtatttttagtagagatggggtttcaccacgttggccaggctggtctcaaactcctgacctcgtgatccacccgccttggcctcccaaatgctgggattacaggtgtgagccaccgcagccggcctatcattagtcttaaatgctctgaaagcacatttaagattaaaggaagattcaggatttttatttatttatttattttttttttgagacaaggtctcactctatcgcccaggctggggtgcagtggcatgatttcgcctcaccacaatctccgcctcctgggttcaagcaattctcgtgcctcagcctccagagtagctgagattacaggcacacaccaccacgcccagctgatttttgtatttttagtagacatggggttttgccatgttgggcaggctggtcttgaactcctggcctccaagtaatccacccgcctccagcctaggatttttacttttatcacaaagatgggtatgagttaaagagcagtgactaagagtgtaaaactctggtctgaagacatctgtgctttcttttccttcctgttccctgtacccccaggcacggtcccagtcacttgcagcccaaactttcgacaggaggttgaaaggcacgcagcagccccaccgtaacaagagagaggtcaaggggctcttggggtagcacaggtgcgttcacacttaccgcttagccataaggttgttgacgctggcctcagacagaagcccctgcttgccacattcttggagcaggaagtttgtacagtcacagctgtgagggagaaagatgctgagggaactgggcacctggataggatggtgaggggtgggagtggcaggtccctgagcagcatcctccctctttcaggatgaggaaaatctggagtgcctgagggacggtagaggggctctggggacttggcaactgtgggctcctatttcctgcccctgccaaggggagtgaacaaggagacagagtcccctgaggcttctctggcacagagatcaggggaagagcccagaacgccttccagtagggcgggggtgaccaggggagctcatacttgcagcgctggtcagctttgtccaacaagggggtgagcttcagcaggaactcaaaagcacagttgacatcctcagtgaagtcctagaaagaggcagaagtgtccatctggtttccagggccaccaggccctgatcatctcaggcaaccttgtctgctggaggcatcggcctgagttgcctggctgctttctgcctggagcctgggtgtatgttgtgggtgcacgcagacgctgaagcacacacactggctgaagcacacgtacacgctgaagcacacacacgctgaaacacacacactgaagcacgcacacactgaagcacacgcacatgctgaagcacacgcacatgctgaagcatgcacattgtgaagcacgtgcacgctgaggtgtacactcacatccggctctcttccaggcatgagaacactgcccagctggggcctgaaggaccctcccctttgcccttatttctgctcccatgcctccatctcaatccccaactcaccttgtctccatgagagtacttcttcaacttcaccaaaacctgtggaatctagggggtgaggcagggggaaaaacaggaagatccatttcttttctctttcatctacccctgaaggcatccccccgaacccctgctccaggaagagagacaggaacactcctaccctgggagtgagagcacacttagtgctaaatgagaaagccaataggtgcccaggcccctgatgcccccaggcctaggcacaggacacaagcaccctgcacctccgctagctcaacagaaaaagatgccataagcaaaagtggatccccagcttcaaggaggactggggcccctttccctggctccctttactgccctgcacctatctgtctgatgaccaagctaaactgcacctctgtggtaagaaacaacggagtctgccaaatgggctaaatatagccctggcactttcagagaaaatgatcaatgggaacttgcactggaatacctggcaggctgggcccagtgcccgcagggaggaacacagggcaaaggtccagggtgccactggtcttgctaagaaccattcctagactggctctgcccctcccacgtccccagtaccttgaggaaagtgaaagctgtccacttgagctcctccgtaccctcgggagactcaatgagccccacgaagcaagctttccagatctccaggacaaaaagtggggtggggatatgctgtgggaagagccaaggatgaggcctaagagggtgcccataccccgtcacccttctgtggactctgaggatttggctgggtcagagactgcatggcagagtcactgctcagctatgtgctgagaaccaggggagtaaggtccaatgacagaagtgtgcacgactggcacccactttccatcatggagcaggagaaaccccacttctcccagggagaaccagaagaatcctccctcctgcccccaacaggctggcctgccttggagaagggagagccactcggcccctcccacctgcatgcgcttcaccatcgtcagctgctccaccagggactgcgtctcgcctgtcaggttcatggtgccctcgagcaggatcacggcgtggacagtggggaagccggtcttgtgcatctgctccgcatgcacagacagcatcgtggggatgctgaggggtcacaaacacaggggacggtgtttggggggccaaaggtgaaggcggagaggatggcacgggtgccacatcttcctaccccagggcgtgtcctccctctcccttctccaccatcccccagggagccggtacctcctaatgagggtgccacactgctcggcctgactccggagctgcgggttgctgagattggccaggatctctccaagtttcaagagagaatgctcgatggcagtccaagaagctggcagagggaaggaagtacagaaacatgatgggaaacaggagagaaggagcacctggccctgaactcctcgattttggcactccctccggcacacgaaaccacacaggaaggcttcccctgaggacaacagggagggaggggcctgagggcagcatgcactgtttccagaaggggggtgggcacctagagctggaaaccccagagaccattcccaaaagcctgatttccaggggacacagccagctgacttcagaaggtatggcatcacacaggctcaggagagagaggcagagggaggccagaatccagtggctggaacagggagggcggccacaaatcactcgaggagtgagcggatcccaaagtccagtcttgcagaggctgtcactctcctctgggggaactgggtccctaaatggctttctcattctcaaccactccctcatctaggcattgcgtttgctgccctcccctgctgaaggcctcttacacactctctctcaaactcccaccatgctctaagcttctgttcaagccccagttcctttagcaactcacccgactggtctaactcactgttctctccttaatgcccacactcatggtctaagccatattggttagcactgaactataagttacttatcctagttacaattccagagggtcaaatgatgaataatggcaccaactagcccattaacctccatggagcataaaagggggaaaaaaagacaagacctgagatccattaaaattcagtattcatccgattttcagccaataaacatttatcaagggcccaaggtagggaagaggctgtcaacacagtccatttttatataaagattgtctttttggacttttcacaggcagtaaaacatacttggggaagaaataaatatactagtcctaaaacaagctctccaaccaggtcctgaagcctcgagagtagcccattctagcattcttgttcctggagaacaagagacctgtaggtggtcccaagccacttgggcttcaaggagcaagactatggccttaggaccccattgctggaaatactggcatcttccctcccgccaggtgatctgtctgttctcaggctctggaaagtacccaaacttaacatctgaacttgagtcaagaggcatatggtacaacaggcccaacagcagacaggcactgtgttaaaaggggcattttaggtaacattcaaatacaagagtcatctgcttccaagcgatgagtaacatggagacaaacacaataatggacactgtgcttgtcttgtcctctagttttttcctcgtctgtgatgtactagtcttgctacccactagcagctatgcttgatgagggcagggaccctgccacatgctcctttggtagccccccaccccccacccccagcacctagcacagtgctgggtatacaacaatgctcagtaaatacctgttggttgattggctcgggtgccaccctgcccaagtccctgggatgtgtgcaatgcttatggggagaaaaaaaaggaagtgggatggtttcagatcctcctggaaagaggtgggatggcatcctgcctctcccttctcaattaaaggaccggctatgggagcagcggcaggtggggctcaggggaatcaagggacatacaggcctcctctagtttggcgatgtgcagcagggcccggttcttggtgctgctgagggttttctccaggcgctgaaggcacatggcaagctgcttctccccagcggctggagtgccggcctccagcccctcccgcagccgctctgcagaggctgccgtgcagcgcagcagccagtggagggcgctaagaagggctcggcacagtccgatgcattcctctgctttgccgtgacagctacagggaaggatgcaaaatcagactctgttcttccaatggctgaaatccgacccacatcaatgttccccagagtccctggcactcccctactagggactagggctgagaagctagcaaagtcctggggaagatgcttagcccctttggctcctactggacaagatttcaaatgagctactccagacagagaggaggcactctgtcctaagggagtaagaaaaggagggcacaggtaagtgtagatgggcaggtggggagaaaaaacgttggaacccggagttggtctcggtctgtgtgctaggagctgcacctctgcacaaagacaaggctggaacattgtattgtgagcccccttacccctgcccttacctcagacggtcacaaaacatgtccatgatgtccagcaatgcctggacacacaggtcccgagaaaagtcatcaaactgtggaaaggacagtggagatgctacggaatgcctccatccacccccaggtctcacatgaggcagacggtgcattcaggactcctgctcctctctcctccaaccctgggttccagactcagcatcctcaacactggacattggctcccaagcaccagcccctacttgccaggatccccctcccatggaagtccagcaatgccagccagaggcatcatgtgctgcctatccagcctcacgggtcacagcatcagggccgtcaaggaggcggggccttgtctgtcatccccaatctagctcctgagtgtctatggtcataccttactgatggctgtgaggacagaagagtaggacaccatctggagagaaggaagaaagataatctttagacaactagtctcccacagttgagaggaacaaacactgatgcttcaagttgctgcagctctcctgaacctcaaccccttccacaggccctcttcaacccaagcaaggagaggcagtgtcactgtgcactgccctgttcctgcctctgtcagacttactgcaaatggtatcagcataagcccatcaagaagatgattctggggatgctcaaaggctccatgtttcaggccgagcatggtggctcatgcctgtaatcccaaaactttgggaggccgaggcgggcggatcacgaggtgaggagtttgagaccatcccgcccaacatggtgaaaccccgtctctactaaaaattaaaaattagctgggtgtggtggtgcgtgcctataatcccagctactcaggaggctgaggtaggagaatcgcttgaatcagggagttggaggttgcagtgagccgagattgtgccactgcagtccagactgggagcagagcgagactctgtctcaaaaaaaaaaaaaaaaaaaagcgcctgctactcactgtcctcaataagcatgggttaactgacggctagtgggcagaagcatgggcaagagtgaagccatgtcactgtattcctacagcttccggcaagaacagaggttttaatgggtaagaactagagacaaacaaacatttcctgcactgagcaggtagtacctgcaccttgaaacagggagtggctgggcgtggtggctcacgtttgtaatcccagtactttgggaggctgaggcaggattacctgaggtcaggagttcaagactagcctggccaacatggtgaaaccctgtctctactaaaaatacaaaaattagctgggcctggtggcctatgcctgtaatctcagctacttgggaggctgaggcaggagagctgcttgagcctgggagacggatgttgcagtgagacgaaatcttgccaccgcactctaacctgggtgacagagtgagactctgtcaaaagaaaagaaagggagggagagagagagaaagagggaaggaaggaaggaaggaaggaaagaaggaaagaaggaaagagtaagttttactgtacaaactcttatttgttctccagaacttactccctaggacccatccaggacaccttccctgatcaaccccaacctcccccacaaagctgaaacccttcctctgtgctccaagtaatcacctaaggctcatcattacacggcgggtgcctgcagtccccactaaattagaagctccttgaggacaaggatgcttttactcagtgaccaccacaaacttgatgtttgtagaatgaataaataaaaacacctttagctcagcatgtctcaaagtagcttccaaagctgccctacccaatacacaagtcactagccccatatggttatttaaatttaaattaattaaagttaaataaaatttggccaggtgtggtggctcacgcctgtaatcccagcactttgggaggccaaggcgggaggatcatgaggtcaagagatcaagaccatcctggctgacacggtgaaaccccgtctctactaataatacaaaaaattagccgggcatggtggcgggtgcctatagtcccagctactagggaggctgaggcaggagaatggcgtgaacccgggaggcagagcttgcagtgagccgagattgcgccactgcactccagtgtgggcgacagagctagactctgtctcaaaaaaaaaaaaaaagaaatgtcacacacataccctgagcttgtgtgtgacataaatttgagaaacactggattaaacatataacgagaactttaccacagaacttctcggaaccatgatatactcgtatacaatgagaatctctaagaagactgacgataaaacaaagcaatatcctttaaacttacttgaccaaggaatttcatgtacccagtatttccaaaatacattttgggaaattctacctgaacagtaagttcccagaggacagagatggtattgaatttatatctgtttctctagcatccagcccaagaactgatacacaataggtcctcaggaagtttttattgctttgaacagatgaattctactaactagttgccttctggaaaaatcttaccttaaaataaatttctgttagtaaaacctattcatcaccatcataagactggatatctagttcagctgtctctgctggaggagtggaagcctccaaagatttaagaagaaagctgtcggccgggtgcagtcgctcacgcctgtaatcccagaactttgggaggccaaggagggtggatcacggggtcaagagatcaagaccatcctggccaacatggtgaaaccccgtctctgctaaaaatacaaaaactagccgggcgtggtggcgcatgcctgtaatcccagctactcaggaggctgaggcaggagaatcgcttgaacccaggaggcagtggttgcagagagccaagatcgcaccactgcactccagcctgatgacagagcaagactccatctcaaaaaaaaaaaaaaaaaggagaggaagaaagccgtctgctcaatcacctgggtttggcaaactttccatccatgtgcaatttccctctcaccaaaatacactgctctgttcagccatctttcactagtactcctgggtgaacaggagcaaaacacagagggcttaaataccatcagtgttcagaaccaccatactgtgaggccagggctagtgtctgatatccatcagaaagctgggagcctgcctgggcaggatgaccataacgttccggcgagcgttttgtttatttataactgatgtccccatagcgagtgcttggcaaagaagtgaaccttgctggataccaacctgcagggggagctggatgtccccactgaacactgaccctcaaatgccgggagagaaacccccaattatgcatgttccgagggatgccattcgtcaaaatgaatttatggtcttcaaattctgaattctgttcagcagatttctgctaactgtatcaataaagcacggctacttcagagacccaaaaatgctttctacatgacgaactgttttacacagcaggatctggcctattcaagtcttaatcattctatcacagtagaagctctaaaccaccacaggcccccagggcaggagaccctctgtgtggccaccatgcttgtggctagccccacctgaccctgcagctgctctcaaatcctctctgctcttctgaatattcaacaccccaactactcctaagtgccctctactcgcataacattgggccaaagagcctcttgactctgaaggaagaataaattactaattttgcacagcacttgagagggcacaaaggtctttcatatctatttacttctgttacttcagcctctttctctttcttccctttcccatcagtgtttatacatctcaagactcttctattggtctgtttgttgtttgagacagggtctcgctctgtcacccaggctggagtgcagtggtgctcccggattcaagcaatcctcccacctcagcctcctaagtagctgggactacaggtgcacaccaccatgcttaattttttttttttttttttttgagatggagtcttgctctctcgcccaggctggagtgcagcggcgagatctcagctcactgcaagctctgcctcccgagttcacaccattctcctgcctcagcctcccgagtagctgggactacaggcacccaccaccacgcccggctaattttttgtattcttagtagaagcggggtttcaccatgttagccaggatggtcacgatctcctgacctcgtgatctgcccacctcggcctcccaaagtgctgggattacaggtgtgagccaccatgccaggctaattttctttttttgagacagagtctcactctgttgcccaggctggagtgcagtggcacaatctcggctcactgcaacctctgcctcctgggttcaagcgattcttctgcctcagcctcccgagtagctgggactacaggcacgcgccaccatgcccggctaattttggtatttttagtagagatggagtttcactctgttggccaggctggtctcgaactcctgacctcatgatccacctgcctcggcctcccaaagtgctgggattacaagcgtgagccactgtgcccagctgcctgactttcgtattttttgcagagatggggttttgccgtgttgtcaagggtggtctcaaattcctggtcaagtgagttgcccacccacactggcctcccaaattcctgggattacaggtatgagcctggcctagattcttctatttttaaaagagtttcctatagaccccacacttccatttaaccaccaccccatctctgctactcttcacacatataaaagtttttttttttaattttattttcttttttttttttgagacagattctcactctgttgcccaggctggagtgcagtagcgcgatctcggctcactgcaacctccacctcccaggttcaagcaattctcctgcctcagccacctgagtagctgggattacaggcatgcaccaccacatccagcttatttttgtattagtagagacagagtttcgccatgttggccaggctggtcttgaactcctgacctcatgatccactcccttggcctcccaaagtgctgggattacaggtgtgagccactgaacccggcctttttaattttacttttttagtagagatagggtctatgttgtctaggctgggctcaaactcctggcctcaagtgatcctcctacctcggcctcaaaaagtgctgggattacaggtgtgagccaccacgcccggacaacataagagtcttctacactccctggctctacctgcacaccttccattgactattcaacgcactccaatcacttctgtcctgaccactctatgaatcttctcattaaggtcattgacaaactcttcatgttaaacctaatggatccttctctgttctgatcttacctgacttcccagcagcatctgaccccttgaaacattccctcacccctcaatcctctcttggcttttcttgataacactctcacttttcttccctactctctggccccttctcttcagactcctatgaggaattatcctcctaagtgtgttccttaaatgagattggttcctcaggaagttgggtttagtcacttctttgctcactctccctgctgtctctgcacaatctcatccatgcccatagctttgattaccatcagtagctggtgacttctaaaccaaaagctccagtctagaactctccttttgagtaccagacacgtatgttcaactgcctaccgagtatcctctttttgataccccacagtcttcttaaatttaaaaggccaagatcaaacatgtatcctcacccacatcccaaccctactctgctcttccactgtctcatgatccatcagctatctaatgtccaaaccagaaacctaagcgttatccttgaccccttctcctctctcactctgctcgtcccattaatcaaattgtttcaatgccacttcctaaactgttcttaaattcatcatttttttctgctgccacttcccaattttgtgctagtatcatttctcgcctgaattacagcaagagcctaaatcaggggttggaaaactacagtctgcaagtccaatttggctcatcactatttttcttaatcaaattttattagaacacagctatacccatttgtttacagatgggctatacctatttttgagctgtaatgacagaatagtgatgagagagaccattcagtctgcaaagctgaaaatacttactatctgggtcctttaaagacaaaatatgccagactcaatgatatccccatcttctgtcttacctccctccaactcgttcttcaaactataaccagagtgatctttttaaaattaatccacaaatgtccctaattaatctacaaagtcaaggaaatctggattaaaatataataggatttttatggtaacttaacgaattgattctaaaatttgtctggaaatgaaatgtctgaaaacagccaaaaaaattttgaaaaataaagaaactaagtgaagatttgtccaccaaggtatcaaaacatactataaagctctaataaagttctggtgcaacaaaagagaaagaggccgggcgcagtggctcacgcctgtaatcccagcactttcggaggctgagacagatggattatgaggtcgggagttcaagaccagcctggccaagatggtgaaaccccatctctactaaaaatacaaaaattagctgtgcgtggtggtgggcatctataatcccagctacttgggaggctgaggcagagaattgcttgatgcttgaacccaggaggaggaggttgcactgagccgagatcgcaccactgcactccagcctggaagacagagtgatactccgtctcaaaaaaaacagagaaagataccaatgaaatatactagggtgtcaaaaaatggacccttgtgtacaagagaatttaaaatttaagatatgacaaagaatggcctattcaataaagacagttgagccattatccatctatttgaacaaataataaatgtggatcccatcctcataccacaataaattctaaatggatcaaacaaagtaaatacaaaaaataaaagtccagtgttggcagaaattagagaatatatttttcattttattacgtatgtatgtatttatttattttgagataggatctcactctgtcacacaggctaaagtgcagtgatgtgatctcagctcaccgcaagtgcgcctccgcggttcaaaggattctgctgcctcagcctcccgagtagctgggattacagatgtgcgccaccatcagctaatttttacatttttagtagagacagggtttcaccatgttggccagactagtcttgaactcctaacctaaggtgatccacccacctcggcctcccaaagtgctgggagccaccacacccggcctgttgttaataatgagattttcccttcagatttccccttcccagatcccgttgtctcagactgatgggattttctccacagcctcttgactggctcaccaattgttgtgctggacccctattcactagggatggcaccaggttcaagaggctgaagggacctggagacagcagatgacacatagggttttgctaggcggaacttatatgcagggacagtccaggggtggtgggctggacaggagaaccgcctgtaattttttttcttagtatgcagaaattttttatgtttttgttgtcagttttatcctttttttcccttactggacttttgtcttccttaaggatttttctgcttcaaagatttaaataagccaggcgcggtggctcacgtctgtaatcccagcactttgggaggccgaggcgggcggatcacgaggtcaggagatcgagaccatcctggctaacactttcgtgaaaccccatctctactaaaaatacaaaaaattagccaggcgcagtggcgggcgcctgtaatcccagctactcaggaggctgaggcaggagaatggcatgaacccgggaggtggagcttgcagtgaaccgagatactgccactgcagtccggcctgggcagaagagcgagactccatctcaaaaaaaaaaaaaacaaagatttaaatattaggttcgagacccgcctggccaacatggagaaaccctgtctctactaaaaatacaaagattagccgggcgtggtggcacccgcccatagtcccagctacttggaggctgaggcaggagaatggctggaaccggggaagctaaggttgcaataagccgagatcacacagctgcactccagtctggatgaaggagtgagactctgtctcacaaaaaaaaaaaaaaaagccgtaacaaaaaaaaaaaatagaaaaataggcaaattatatatttatttgtgtatttatgaatacataaattatgtattcataaatacataggccgggcgcagtggcttacgcctgtaatcccagcactttgggagtccaaggcgggtggaccacatgaggtcaggagcttgagaacagcctcgctaacatggagaatccccgtatctactaaaaatacaaaaattagctgggcatggtggcgcatgcctgtaatcccagctactcgggaggctgaggcaggagaattgcttgaacccgggaggcagaggttgcagtgagccaagattatgccactacactccagcctgggcgacagagggagactccatctcaaaaaaaaaagaaagaaaagaaaatgcacattataatatgatataattatttgcctctggaaaaagttttaaaagattctggccaggcgcggtggctcacgcctataatctcagcactttgggaggccgaggtgggcggatcacgaggtcaggagatcgagaccatcctggctaacaagatgaaacgcatctctactaaaaatacaaaaattagccaggcgtggtcgtgggcacctgtagtcccagctacttgggaggctgaggcaggagaatggcgtgaatccaggaggtgcagcttgcagtgagccaagattgcaccactgcactccagcctgggcgacacagcgagactccatctcaaaaaaaaaaaaaaaaattatatccagcgttggcaaaggtatggggaaatactgtcagacattacggatggggtataacctaatccaatcattttcagggggaaatttgcaggatctactataatttagtatgtgtatattcttcaaatcagatattccattgtgaggtatccaccctagagaaatacttccagatatgcagacaggtaggtataaggatattcagtgaaacattgattataacagtaaaaaattacaaacaacctaaattaaagtacatatgggctgggccaggcacagtggctcacgcctgtgatcccagcactttgggaggccgaggcgggcagatcacttgaggtcaggagtttgagaccagcctggccaacatgatgaaaccctgtctctactaaaaataaaaaaatgggccaggtgtggtggtacatgcctgtaatcccagctacttgggaggctgaggcaggagaatcacttgaacccagcggcggggacaggaggaggttgcagtgagccaagatcgtgccactgctctccagcctgggcgacagagcaagacttcatctcaaaaaaaaaaaaaaaagtacatatggaatattatgtagcagtggtttaggggtgagctccatggctcacgcctataatcccaacactctgggaggccaaggtgggtagattgagctcaagagttcaagatgagcctgagcaacatggcgaaaccgtgtctctacacaaaatgcaaaaattggccgggtgttttggtgcgcacctgtagtccaagctacaggtgcaggaggatggcttgagccaaggaggtcaaagctgcagtgagccactattgtgccactgcactccagcctgggcaacaaagcaaggatcctgactctacacattttgttttttttgagacagagtctcgctctgtcaaccaggctggagtacagtggttcgatcttggctcactccaacctccgcctcctgggttcaagtgattctcctgcctcagcctcccgagtagctgggactacacgtgcatgccaccacacccaggtaattttttgtatttttagtagagatggggtttcaccatgttggccaggatggtctcggtctcctgacctcatgatccacccgcctcggcctcccaaagtgctgggattacaggcgtgagccatcacgcccagcctctaaaaaaaatttttttttttttttttgagacggagtctcactgttgcccaggctggagcgcagtggcgcgatctctgctcactgcaagctccgcctcccgggttcacgccattctcctgcctcagcctcccgagtagctgggactataggcacccgccaccacgcccggctaattttttgtattttcagtagagacggggtttcaccatgttagccaggatggtctcgatctcctgacctcgtgatccgcccgcctcggcctcccaaagttcctgggattacaggcatgatccactgcgcccagcctaaaaaaatttttaataaaaaaaaatatatatgtgtcaactgagaaatactattcagcagttaaaaaataagaagaaaaggccgggcgcggtggctcacgcctgtaatcccagcactttgggaggccgaggcgggcggatcatgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaacaagaagaagaagaatgaggccaggcatgggtggatcacacctgtaatcacagcactttgggaggccaaggcaggaggatcgcttgagcccaggagtttgataccagcctgggcaacaaagggagaccccgtccctacaaaaatgtaaaaattatcagcctgggcaacataggaagatcccatctttacaaaaaaatttaaaaattagccaggcatggtggtgcatgactgtagtcccaactccttgggaacctgaggtaggaggattacttgagcccagaaggatgaggctacaggaagctgtgatcctgccattgcacactccagcctgggtaacagagcaagaccctgtttcaaatttaaaaaaataaataaaaagaatgtactattaacatatacaacataaataataaatctcaaaaacatttatgttaaacaaaagacagtatacgaactatatcccatctgactacattactaagaaatccaaataaaggcaattgtgggagaggggagtggactagaaagcggtaaaagggaactttctgagagaacagaaatgctctgtatcttattttggatgctggtgacatgggtacatacaattgctaaaactcactaaataggccaggcgtggtggctcatgcctgtaatcccagcactttgggaggctaaggcaggtggatcacgaggtcaggagttcgagaccagcctgaccaacatggtgaaaccccgtctctactaaaaatacaaaaaaactggccaggcgtggtggaggacacctgtaatcccagctactccggaggctgaggcaggagaatagcttggacctgggaggcggaggttgcagtgagctgagattgccctactgcactccagcccaggcaacagagcgagactccatctcataaaaaaaaacaaaaaaacaaaaaacaaaaaacaacaacaaaaaaaaaaccctgactgaattgatcttaagatgtttgtatgttctgagacgaagttttgctcgttgcccaggctggagcacaatggcgcaatctcggttcactgcaacctccgcctcccaggttcaagcaattctcctgcttcagcctcctgagtagctgggattacagacgcccaccaccatgcccggctaatttttgtatatttagtagagacggggtttcaccatgttggtcaggctggtcttgaacttctgacctcaggtgatacactcgcctcggcctcccaaagtgctgggattacaggattgagccactgcgcccagcgcaagatctttgtatgttatgctatgttaattaaaatatgtatatttttacggaagtcttgtcatgtgacgcctccacttaaaaccctttaaatgattatttgtcaccctaaaataaagtccaaattccttagcatcactcaaaagtctgttacaatcttatcattctctctccctaaaccactctcctccttaaagtgccagcctagcagttctaaaggtacggttcaggaactccccagggtccccaagacctttcagggggtctaggaagtcaaaattatttttaaaatactactaagatactgtttacctttttgctctttttctctcacaattgtacagtggattgtcctggaagctccataacatgtgagaatatgatattattaaatgcatcaacaactgtaatatctatataacttagtcatggatattgtccaaattaccaattcatgatgtgacaaaaatcatgcatagataaaagatctattcaaggtgcaacaaagagaccagttaattttatttcattttattttttattgagacagagtcttgctctgtcacccagggtggagttcagtggcatgatgttggctcactgcaggctccacttcccgggttcaagcgattctcctgcctcagcctcctgagtagctgggattacaggtgcgcaccaccacacccggctaattttttgtatttttagtagagacagaatttcaccatgttgaccaagctggtcttgaattcctgacctcagatgatccacccacctcagcctcccaaagtgctgggattacaggcaggagccaccatgcctggccaataatatatatgttttaatatttgaagaaatttattctgagtcaaatatgagtaaccatggcccttcaggaggtcctgaaaacatgtacccaaggtggtcgggtgcagcttggttttatacattttagggaggcatgagatcaaatacaatcaaatatatttaagaaaagtctcaaaattttgaagactgtaaaggggtccagggactgagcacagtggctcatactcataatcccagcctttaggaggacaaggaagaaggattacttgaggccaggagttcaagaccagactgggcaacatagtgagaccccgtttccacaaaaaatacaaaaaaagaaaaaggagaaaaaagaaaagaaaaaggggtcctgagagcaaactccttttctctagccataccaaattattttcagttcctgaacaacattatgtgatttttgcctcccaccgtgtacatatgcttttctctgctttgcacacacactctcctcaatgtgccggctaactcatactcaacattcaggtcttggtttaaacatcacttcctccacaaagccttccttgattgttcacactggactgggtgcctttcccatgtattcccatagcaaggacagtcccaacttaacaatggttcaccttacaattttttgactttattttttaattttatttattttactttttgagatggagtctcgctctgtcaccagactggagtgcagtggcacaatcttggcttactgcaacctctgactccctggttcaagcgattctcctgcctcagcctcccaagtagctgggattacaggcactcgccaccatgcccagctaatttttgtatttttagtagagacggggtttcaccatgttgtccaggagggtctcgatcgcctgacctcgtgatccgcccacctcggccttgcaaagtgctgggattaaggcgtgagccaccacaccccaccttaatttttcgactttatgatggtgtaaaagagatacacattcaggctgggcgtggtggctcaagcctgtaatcccagcactttgggaggccgaggcagatggatcacttgaggtcaggagttagagaccagcctggccaacatggtgaaaccctgtctctactaaaaatacaaaaattagcggggcatggtggtgcacgcctgtaatcccagctactcgggaggctgaggcagaagaattgcttgagcccaaggagatggaggttgcagtgagccgagatcgcaccactgcactccagcctgggggacaagagtgaaactccgtctcaaaaaaaaaaaaaaaaaaagagagatacgcattcaggtcaggcacggtggctcattggaggccgaggtgagcggatcacctgaggtcaggagttcgagaccagcctggccaacacagtaaaaccccgtctctactaaaactacaaaaattagctgggtgtggtggtgcatgcttgtggtcccagctactcgggagacaggcagaagaatcacttgagcccaggaggtggaggtcacagtaagcagagatcacgccactgcactccaccctgggtgacagagtaagaccttgtctcaaaaaaaaatatgagatacacattcagtagaaattgtacttcaagtgctcatacatgtaagccattatcctcagtgaaataactgaggaatagaaagtcaaggaggttgcagtgagctgagatcagccattgcactccagcctgggcgacagagcaatactccgtctcagtaaataaaaaaaaagtcaaataccacatattctcactgataagtgggagctacacaacgtgtgcacatatagagtgaactaacagacactggagaatataaaaggtgggaaggtgggagtggggtgagggttgaaaaattacgtattgggtacagtgttcactactagggtaatgggtatactaaaagcccagatttcaccacgatgcaatgtatgcacataagaaatctgcacttctggctgggcgtggtggctcacgcctataatcccagcactttgggaggccaaggcaggcgaattacctgaggtcgggagtttgagaccagcatgactaacgtggagaaacccagtctctactaaaaatacaaaattagccgggtgtaatggcatttgcctgtactcccagctacttgggaggctaaggcaggagaatcgcttgaacctgggaggcagaggttgcggtgagccaagatcgcgccattgcactccagcctgggcaacaagagctagactctgtctcaaaaaaaaaaaaaaaaaaaaaaaattttgccaggattggtggtgggcgcctgtaatcccagctacttgggaggctgaggcaggacaattgcttgaacccgaaaggcagaggttgcagtgagccaagattgtgccactgtactccaccctgggtgacagagtaagactccttctcaaaaaataaaaataaggctgggcggccgggcacagtggctcacgcctgtaaacccagcactttgggaggccgaggcggaaggatcacgaggtcaagagatcaagaccatactggccaacatggtgaaaccccatctctactaaaaatacaaaaattagctgggcatagtggcacacgcctgtagtcccagctactcaggaggctgaggcacgagaatcacttaaacctgggaggcagaggttgcagtaagccaagatcacgccactgcactctagcctagtgacagagcgaaactctgcctcaatcaatcaatcaatcaataaaaaataaggctgggcgtggtggctcatgcctgcaatcccagcactttgggaggccgaggtgggtggatcacctgaagtcaggagttcgagaccagcctggccaaaatggtaaaacctcatctctactaaaaatacaaaaattagccgggtgtggtggcagacgcctgtaatcctagctactcaggaggctgaggcaggagaatcacttgaacccaggaggcagaggttgcagtgagccgagatcaagccattgcactgcagcctgggcaacaggagcgaaatcccatctcaataaataaacaaacaaacaggctttgtgttagatgatttttcccaactgtaagctagtgtgttctgagcacatttacggtaggtagatggccaggcacggtggctcacacctgtaatcctagcactttgggaggccaaggcgggcggatcacaaggtcaggagttcaagaccagcctggccaatatagtgaaaccctgtctctactaaaaatacaaaaattagccaggcgtgatggcaggcacctgtagtcccagctactcgggaggctgaggtaggagaatcgcttgaacccgggaaacggaggttgcagtgagccgaggtcacgccactgcactccagcctgggcgatagagcaagactctgactcaaaaaaaggtaggtagatgacctttggcaagttatgtgtattaagtacattttcaacttatgagtggtatatcagcacatcaccccattgtaagttgaggagcatctgtactctatcctaacctttatcataaacccatctagtgactgcttatttacatgtctatattacccactaaattttctgtgtactgacatcgggttttgttcacagctatattccccaggggctaagcactgtctggcacataaaagcattcatgagtatttgttgatagaataggtgaatgtaatcctctttttttcttttgcttgttgttgtttttaatagacggagtgttgttctgttgcccaggctggagtgcagtggcacaatcagtgctcactgtagcctcaaactcctgggctcaagcaagcctcctacctccaccttctgagtaggtggggccacaggcctgtgctacctgctaccactcccagcagaataagtgaatgtaatattcatcacaacaaatgaagtattatttttatgagaacactgaaactcactgaaatgatctgttcaaacagatcaatctagaatcttactctttcatctagaaagagtaagctgacaattgtacaactgcaccccaaattgtgtttgtttgtttctttcctgagacagggtctcactctgttgctctggctggagggcagtggcaggatcatggctcattgcagtctcgacctcccagggctcaggtgatcctcccacctcagccttccaagtagctgggactacaggggcaccaccacgcaggggtaactctttgtatttttgggtagagactgggttttgccatgttacgcaggctggtcttgaactcctgggctcaagcaatccgcctgcctcagcctcccacaatgctgggattacagccatgaaccaccggggcccaaatgcactccaagttttttacccccagaactctcacttcttggtgggggtttgcgggaagcttacctgggaactaatggcatacttcaggtaggacaagatgagaggattgggggatggtccaatcatggcctgctctagtaacgcatctgcaagaggaatagcaaaacacaactgagtgattacaacttctctgggtttatccctcccatctttctttcccagttcacttgagacctgccaggttgagaatatcccaggtggctcctttaggaaagaatttcttcatgttgattgcccattggtagtcactccagcgctccttccaggcttgcaaaatggcttgcttcaggttgaccaccttcattatttcactctgagcaggtggcagcggtggcggccagctttgaggtgaaagaaatggagctaaagaaaaggacatgaggttctaaggagaaccggggaaggcagaattaaatagaaaggagaagatgcgggaagatttaagcgagacagaggaatttgaaagaaaaagagctaaagggataaagtaagatcctgtcagactctctcctcctgaaccgcccttccttaaactggggcactaagaaagtatcggccgagcgcagtggctcgcacctgtaatcccagcacttcgggaggcagaggcgggcgaatcaccggaggtcaggagttcgagactagcctgaccaacatggagaaacctcgtctccactaaaaatacaaaattagccgggcttggtggtgcatgcctgtaatcccagctactcgggaggctgaggcagtagaatcgcttgaacccgggaggcggaggttgttggggtgagccgagatcgcaccattgcactccagcctgggcaacaagagcaaaactccgtctctcaaataaatgaataaagaagtatcaaagggactaatagattaaacagggcatcaaggagttaaggcagtcctggttgcctaattacgcccttagctctaaaagcgtcccttggccaccaccattccaagtccagatttgctccctcatttcctccaccttctccagccctgtaactatacctcccaatttccttttcatccaccacctccccaaatttaagcctaccgcacaatccagttctaggtggtaggcatcgccattttggcacttgtcaagaagctcactttctattggctgggagtaacaaacgccaaccaatagaaatgcagcaaggaacgccccgctgtcttctgggaatggtagttccttggactgaaaccgtatttgtctgcgccggcgaggaaactaagggactcgtctagtcggcccgcattgttcttctcctttaagggaggacatccaggagctgaggcactacagagactcagggactcgagggagctcgaaaggccgctcacaacccggcgtcgcccacgacgtcactgtcgaccgggcttctccatcatattccgacaccctttcattcgttagcccctagttagtaggtgcggcaagggtgtggcgtgggggcaagggtgtggcgttcagcaataaggtctttctcctttcctgggctctttctgttctcctaagcccctggagctaccagagctattctcatttccacaactatattctaaaagcgacaccgaggtgccttagttgcacacatatcaccgtccccgaatcttacagtcctatcagaatctccaggccctccatacagcttggatacaagggaaagtaaagaggaaactaaggtgaaggtgatcaaaatcaaaggaattctgagaaactgtcacaactaagagggctaaggagacctgatgactaaatgtaatgtggttttctgaatgcgatcatggaagagaaaaagaatactgggtaaaaactaaggaaatctaaataaagggtggactttaattaataataatgtatcaatattagttcattagttgttacaaatgcataatactaatgctaagatgttaataaaaagagaaattgggtgcagaatatgtggggaccctctattaccttccatttttttcctgtaaattaaaaacttgtttttttaagtttcttgttgttgttgttgttgttgttgtttaaatcttgcttatcccaaagatccatatataaattatgcccagggctttggccatagcctttccttcccccagtgagaaacccgaaagcaaatgttacccacctctggaggctccaatgtctgagccttcttatgcatagccctcatccctccccatgctatggactggtcatccctaacatttacaaccaggaataagagtaaattactcgggaggctgagaaaggaggatcacttgagctcgggagttcaaatccagcctgggcaacataatgagactctcagctctaccaaaatacataaataaataaacatggaggcctttagccagggcccaatatcctagttcacaagttcaagctcaatctgtattcctcaacaaagattctttttttttttttttttgagatggaggcttgctctgttgcccaggctggagtgcaatggcgcagtctcagctcactgcaacctctgcctcccaggtttaagcaattctcctgcctcagcctcccaagtagctgggattacaggcgtgtgccaccacatccgactaatttttgtatttttagtagagacagggtttcgccatgtcggccagggtggtctcaaaatcctgacctcagccacccaccttggcctcccagagtgctaggactgtaggcatgagccaccgtgcctagcctccaacaaccattctttgctcaccctttgagtggcaaaatcagtcctcgggaggataaatctgggagagcagcccacttaaggctctggaagcaaaactgtggccatttgggcagagaattacagcgccctgggtgtctggagaatggtctaaacagggagtcaagaacttctgttccaaaggggagagtgtggctgaaggagggtcagatcatgtcctcctgcggttggtactgcctatggcctttcttcctccccatacattcaatccacacccctctcttaggctccctttgtgcctgcccaagtgacaccattggggaatagtgtgtatacaaaacagctgccaaatatatgttgccaaagcttctaaagcaggaaggagggaaatacggattcctcacctcaccttccagatgacccccggccactccactcatacttgagactgccacaaaccctgcttctcctcagtctctcacatatctgacttcccctgttctcccaggcccctcactctacctttgcctgctcccctgctgtcattctgtgcctgtagccacagcctaaggccctccacctggagccattcctggatcatcctggagcccctgtcgcatacctcagagcccaaactgcctctcttggagagaagctgtcaactgtgtgtccggtccacacaggactggggactatttgggccctgaggatggtgatattttgagctcaaaccattccctctggcagggagcctggcagatttctagggaggtgcctcctccccacttcgcagtgacagggaggcggcttttgtagtcaggccatctgccttctctgtctccccacctcccaccagcagccctttctctaggcttggcaaggtttccccaaaggctggactcctatgtacaaaggctcccttagctctgggcaaggaccatttttagtttatccactttgacctccctgcctctctagtctgtaaacatcagaggcagcctttcctatatcacctcttccttccacaccacaatatcttcctagggacccccttgggctctctggctcactgcaagcacaggaccgggaccccatgataatcctccaaagggtgaagagagatgctaacatttcctttgggtgtacaaaaaaacagccccccaaccgggcgcggtggctcacacctctaatccctgcactttgggaagccaaggcaggcagatcacctggggttaggagttcgagaccagcctgaccaacatggagaaaccccatctctactaaaaaacaaaattagccgggcatggtggcgcatgcctgtaatcccagctgctcgggagatggaggtaggagaattgcttgaacccaggaggcgaaggttgcggtaagctgagattgcaccattgcactccagcctgggcaacaagagcgaaacttcgtctcaaaaaaaaaaaaaaaagccctccagcccatctcaaagccccgtcctacttaccccactttcttttgctgttcatttcctctcaacagggacaggggccgaactcccatctctgccctcctagtcctgagccccaacctctttcttcatcttgttgcctaccttggctagagagagaagaggggaaggtggaagtcaaccagtcagagtgatatggcaaccctggagaagtgtcagaaaagcagctaggccagagtggggtaagaggtggcaaggaacagggttctgggtacccaaagggaagggaacattccttatctatctaggctagaaaacagtataaagaaaagtggcaagagtccagacccaaaaacccagaaacactgaaatcgttggtaaagcatacaaggcacagagggtgtcagcttcccttctctccatagggaaactgagtcattccttttccctaagtggaacattttcctctggaagcttgcctgggtccccccactatgggcagcaggtggatgggaaaagaaagacagtcactcccaaacacttatacacagctggctccaaaccagtctcctcctcataccagtcaccaaatcaaaatccctgctttctgtctatctgggggagggaatgatgggaaagaggtctgcaaggtggctgcacctcagggactcagggactacccctggatcccccacagttgcctgtctctgtcttcccactgccccaggagagtgaaaggcagaatttgaatcaactcttggaatagcttcccctctaacaccctggaggatgccttccctctccatactcccagcacaaagagaagtgctgtgatcctgaggccgacagtggctgggaagggagggcagcctgccatttcctttgtatggcccctccctccaggccctgagagctgctctgctttatacttttggcttccatatcatactaccctatcccctcctttaactggagtgggagaactgcggaaaggtaagccccaaactctgatggtaaaggagacttccctgctccccctcctctcctctctcctgctggcaaagataggatgagaagactctaagggaaagtgaaaccagaagctgggagcatttggggaatctaatacttggcacatattaaatgcttaaaaaaaaaaagtgtcaggctgggtgcggtggctcacgcctgtaattccagcactttgggaggccgaggcaggcggatcatgaggtcaggagatcgagaccatcctggttaacacagtgaaagcccgtctctactaaaaatacaaaaattagccaggcattgtggtgggtgcctgtagtccccgctactcgggaggcttaggcaggagaatggtgttaacccgggaggcaagctttcagtgagccaagatcacaccactgcactccagcctgggtgacagagcaagactccatcaggaaaaaacaaacaaacaaaaaaaaaaaacagtgtcagattaatgaataaaattaggagaaaccctgaaagacagcctggaaaaggtgtcagcttccttttccatttctcacctcagctaccaaaagcaagactcagccaggcctggtcccttccctggctccctcttttgtgacccatagcaatagcgcctgatgggacaaaggggagaattaagtggccactttctcttaccaggtaattgctaatttgccagtctctcatctcctgcatcagcctcccaagtagccagaactgaaggtctgcaccacaacacccagataatttgtgggtttttgtttttggttttttttttttttgagatggaggtctcactatgttgcccaggatggtcttgaactcatgacctgaagagatcctcccacctcagcctcccaaaatactggtgatgtcagtcagccaccttgcccagcctgctctccaactttctttcctccatttgcaccactctttctgattgggaaacccctaggagggagaaacatctgagctttgagttctcttggctggtagtacctcagtttcctctgctgtctttccagagcacccccaataagttcagctctgtctgcagagtctagaggtatatgctggacatgtcatcacttgctgacctagggtccaagaggtcaagatgagatagaggaagggatttactgaggcccaggccacagagcttgttccatggtggctggtagaggggcctatctcctgtttccccaaactgctagagatgtgtaaggcttttgagcaggggtagaggatgctgtgtggagttttagctgccagactttgaaaaaaacctcttcagaaagatatctggataccttggttcctaggggtcgtatcctcaagaaatcttagggtgcttcctagcaacagtctggaaggaagggagggagagatggagggagagagggaggggcctaggcatggctgttctgatgggagcccagagaacaggctgttcctgctacctccttagcaacggaaatctcagctggaggggccatcagacatatcctcttggagggtctatccagccttattcatgccacccctaccctcctcatagattcggggaatgctctgaagcagaggtggggaatgggaggggacagccctggtggtggtggggggtttcatgacaaggacggaaaaggagctgaggatgaactcaatctgagaagagctagcagcttcaagaaatgggtgggcagggtgagtggggtgggaggacagatgaggcaacacagggacagtggctatacgcccagacacgggctggatcctggcacctggggagaggcctgctttgaaagcagtgtgcccttcactttgccctgcccagacctgtcaccagtccatactgggagcccaagaaaaagagagaggtaaaaagaagatgggggtggccggggacggtggttcatgcctgtaatcccagcactttgggaggccaaggcaggaggagcacttgaggccaggagttcaagactagcctggccaacatggtgaaaccccttctctaccaaaaaaacaaaacaaaacaaagcaaaaaaacaaaaattagctgggcatgctagcacatgcctacaatccccgctacttgggaggctaggacatgaaaatcccttgaacccaggagacggaggttgcagtgagccaagattgtgccactgcactccagcctgggcaaaagagcaagaccctgtctcaaataataataataataataaattttaagaaggagaagatgggactggtaaacccttgtctttgagtgctccactctgcccctcaggaaaaaaaaaaagtggaacaggaggcacttcattttctatggctctgggtttaggatttcagaaagtcgtcaccacccaacattatagggccttgcatcaaagagagatatggtggggaaagccagaatggaagagagacaaaaccgtagcaccttcctcctccccctctggacaccatcactcctgccctgatccagattaccgctggccctccccactgcctcctagttctgcctttgtgatgcagagtataaatgtatctcatgcattgggattccctcccagctccttgagcagcccaatcccaagggactagttccatacagggtagagtacagaccctgagcactacatactgcagccttgctccccagggttccggccaaacctgatcaccgaggaggtggcatcgactggcagacagccaccctcagtgcacctcattccactcactgcactgactctgcacactgcagcctcctgccccacactgcagctgttgcttgtctcctgtgagcccagactgaacacaggttcgcttactgcatggaggctccgtacgctgcagcctcaattccccattacagctgccactgcacaccacaggctcccttcacccatggcatgccctcaacaccaccactgcactctgcacgccataggtttcatcccagctgctcttctcatctccatggttccagggaccccaagagaggtaccctcccctccgccaagcattacgaactccagtaccccctgtgaaagaagtggttccaacagcactgaggatgcaggtggctgagactaagacatgagcaagggcagcccaacttgggtaagctgtggctcagaatcccacactcgccaagtgactctgcccagtataaactgggcgattagccgagcagctccccctaacacacacacacttacacacacacacactcacacacacacccctccccaagagcagactatgtagccagggccccaccctgagagccgtgggaaggctgtggcccccgctggtaaaactgggctaatgacagcaggggaaccggcggggccaggggggtgctggggtaattagggctcggcctggcgctaggagatcctgagatgaaaggtgctctggcgtcactgggttggttttatgtccatgaatgcaggtgtgtggtgtgtgtatgtgtgtgctgggggtggggctggcatggtggagacctctcctttgggttgggttagggggtccatttgtatgcagcccaccgtcttccttagattgactctggtaccatttggatttttgtgggagcaaacatggggggaaataccaccacccgggagctaggaattgagggggtatggcagatcttgtcccctccccgagctcaggagagggagcagattgttgggggaaatggctggtgacagagaatagaaagagcctatatggagaagggtgacgttggaaaagggaggcagtggatcggtattgatgttagaaatgagaggggagggaggtaacagggaatgaacccccacaaggatgaaaaacgtaagatgattgaagttaaaaggacatcaggggtcacctgcccagccctcgcagctgaagcttgaggaagctctgcccccgacagcagtggcgatttgtcaaggtcacacagtgagttaccggcggagaagggacccgaactcccaaacaaactacacctgcaagcgtttggtgtttagactttctccccgatgtataaggtgcaggctgctcgtcgatacttcctcctccaccctcacggtgcacacccgaaaaccccccaattctcccggcaagcaaaggctattttttaatgacatcttttccaaaatatgtcaccaagtacccactcctgcgggagccgcccgggctggggagggcgagtccgagcggggcggggcagaggcggccgaggggcggccggacctctggcgggggtcccggggcgcggcagggggcggggggcgggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgaggtaaggaggagggagcgagggggcattaatatgcaaatgccttgcgattgattatgcaaagccgcggggctccgtggccagctcccaggcgggctaggggcgcccagggggtgcctgctgccagcctcagcctttcctggcgccccagtgaccctgtcacgagcccgggagcttgcaactgacgccctggggaagggaggtgttgctaggaggtcgctgggccccggggttcgcaggcggagatggcgtccgagcctccccctggagggcccgcccggcctctgtccggccagtctgctgcgcattcccgggccgggccccgttgccggccgccggagctcccccgcccgccgcgccgcggtttgtttacggtgcgccggaggcctgcccccccagcccccacccctagcctctgaggcccgagtggcctttgcaaagctgcctccagctgcggagggcagtatgagtgcggtggcgcgggtgggcttgcacgggtccggggagagggaagttcccccgcctcacccgcctcccggttgagcatggctgtctggttgcaacactgctaattgcaaaaacgcggttgttgggggggaatgtgtgtgtggaaggggtgtacttggtggtgcctagatgattaggagagttgctggctggggaggagagggagaaatggacctgtgtgtgtgtaccccaccttgtttccctccccttgcaacgtgtctctggtgccccttctccatctggggccctcccttgtccagcgtgaaagaaaggcctggggggatgacaggggcaattgaaagaaccaccgttccaggggtgggggtgggggacacagaaggaaagccagtgaggtgggagcctgcccctcagtgctggctttggctccaggagggggaggggatgaagggggctgttgtccaaaatgaggggggaagcaaaagtgacacgcagacacagagatatgtccacacagacagccacatgcacatccagggacacccaggcagactcaaggacaggagctactggacacacccacatggggacaagggaagagacaggctgctgctgcaccgtggagctctgaggggtgggatatacccatgggagaccaagagcatggggaccgatccatgcacatacccacgcacagggtcacacgtagatgctgtcacacactggggcaaggaggagttgctgtcacccacacataaaaagtcactgtcacatgcatgcatgcacacagagcaattgcacacagcagcacaattacaaaagaccctgtcactcacaggcacacacgtgctcgcatgagcccagtcacacagacatcattgcttgccgtgacagtcgctgtcactcagtcagatgcaaacacagttacacaccaacacatgtatacacaacttagcaacaagtattttcctggactctttactgtggagctctgaggttctgtaggcaacaaaacccttgctcccaagaatattaaatttggctgtatgaaaaagtgttcctgcgtaatggtgtaaagcatgcattcccaatgacatgttcttggtctctatcgcttgagataccaccctactagacagtgagctcttggagacctgggagaatcacttaaagagctctggatcccacgcagagcctagcacaagggctgctctgtaaatacttgttagttgattgactgtggaacctgcagacacaggtgcactcatttgcacatggtcccctgaactcaggtgcagaatgagttcacaaggcccaggtccccacagttgcaggtccacaccaacagtcgtgtccacacaaccccagatacacacaactgcagcctgtgcagccgagcacacacttagatgcacacaatcacaaatttttccccttcagcttcctcctcccctttttcctctaggctcagccactgtgcgggaatgggctgttttttttttctttctttcttttagagggacagagaaacaagagcaaagacagtgggttcaggggggttccagagggccgagtcatgggctcaaagcagtgtccagtgacttctagaagctaggattctcttgactgttggggaaggggagagctgctctcctccctaccctaaaagctcaggggtgtctaactgcccctgctctgagtcatttgcctgggtctttcctgggaacagtcagtcacttccagctgagttcctgcgccccaccttgagtctggccctttttcccacctgtaccctcctgtccaaacttggaagctttccttaagaggccatcggctggcgagtgtctgtgtgagtgatatgtacttttgacttggaatttctctctaactctgtctctctgttgctctgtcttgcagtgtctgattctccctctctctctccttgtttctctgccagtctgtaactctctctcaccctgttgctacccccgatctacccctgtccttgtctcagagctggggactggcagcaatgttcttcatacttttccagttgttaatacccaagctccgcccctctgccccccctgcgcagcctctggggtcagcttgaggttggggtggggggcggggggctcagctggctgctcaggacttcctgcacttccttagtgccgcagctgtggccagcaagttttaggggctgggaatgggggaagggggggggggtcagccactgcccatgctgacccctcgggcctgcatgtctggagacaccagttctgtgggcaccctcagggtgcaggctgcagccagctagcagctcttaaacaagccatgaagaggctccccccacactggcccaagctggaaaagaaccgcccccatgggcagtggcgggagctggcaggaccctgctgagttgggtccactgcagggctcacaatggcctttctccacacccctggcagctgaggcccacctcagagatgcccaacagctgtgtcctttttgcccagcctcagggcctggttctgagggcacagctgcctagactaagtatgtactaagcgaggccctcccacccgtgagtgcaggttccagcctagaaggggtacctcttctggagagggaatttgaggagggggaactcaggcaggagacatcgagcccgggggcaccaagcacttctcgctatgctcccctctagccttggactatttggaggtggaggcacttggcagagaacccacagggcagctacagaggggaaagactgaggcttggtctcagggaacacatagctggatgaaagaacaaggcattgggccgggcacagtggctcacacccgtaatcctagcacactgggaggcggaggcaggcagatcacctgaggtcaggagttcaagaccagtctgaccaagatggtgaaaccccatctctactaaaaatacaaaacttagctgggtgtggtggcggggtcctgtaatcccagctactcaggaggctgaggcaggagaatcgcttgaacccaggaggtggaggttgcagtgagctgagattgtaccactgcactacagactgggtgacagagcgagactccgtctcaaaaaaaaaaaaaaaaaaaaagaaaaacaaaaaagaacaaggcattatctatcaagcaggtgatataccatcacagctaagaacagagatgatggtgatgatcatgacggccatgattgacctggactgcctaggtctgaatcccagctctgtcacttgctggatgtgtgactttgagcaagcgatttaacttccccgttgcctcatctgtaaattggggatgatcatatctacctcatttagcttttttgaggaaaaatgtttttaaaagtgcctagttcataacaaactgtatatgtgagcggttgtgatgggtgaaggaagctgtgggcctggggtctcccagatttcttagagaagcttcgtggagaattgggtctcctagacatcagtgagactggggcctggggcagtgggtctccaatttccagccttctcaccgtcatgtaatcttttcctcccagacaaatttttgcagcctggaatgagtgtatgggaaagagcccaaggcaggcccctctgccccaccctcctttgaccctcgcccttcagcttacaaggagcccttggcccctcagcctgggacacaccccaccagctaggggcacctgcataaatctttgggcatcactgcatctctgttcagggtctgagctctgggggtgggagagagagaacaaggaaagccgtcccctctcttatgtgtgggctcaaagaggaggcagtgcccttcctccctcctgggagcccagcattggtcaaccaggacccagctctggctgataggcaccagattcccctgccctccatggagtggtacttagtgtgaaaggtggtggcagagagaaactgaagcactgagtaatgaccagtgtggtgggcacagcactttgagatccagcatctgtcctgggttgcctctttgcctttgtgagtctggtgatcaggatcccctctccaaaccccttttatttagccctgcccctcaaggtgaaggaaggacaatgggaggataccctgtaggggtgacgggaagcctttggagtgggaaccaatctcaactctagttctcggctgggcacagtggctcatgcctgtaatctcaatattttgggaggccaaggcgggaggatcacttgaggccagtagttcatgatcagcctggtcaacatagtgagaccccatctctaaaaacaactttaaaaagttagccaggtgtggtggcgcatgcctgtgttaccagctacttgggaggctgaggccggaggatcgcttaagcctggaaggtcgaggctgcggtgagctgtgattgtgccactgcactctagcctgaacaacagagtgagaccccccacacacacatcctctcaaaacagacagaaaacaaaacaaaaaacccaactctagttctcatggctgcaaaggtgtctaggggactttggagaactgttgtgtctcttggggagggaggcaagcatgaccgtggtgggaagatcactggctgggagttgggaggcctggctgttgacattcactagtcgtatgactttgggcctgggttttcattatctagagacaatggttcctgtctcactcaggttgagggcaaataacacaaggtgggatgacccctgtgttcaatccatgttgcatcctggcatggtgagcaatgcctgtggattctccttttttcccagggcctggcacatgccagggtggggcatacacatgctgcctggaaccagagacagttctcagtctctcactgaagtatctggggctggtgtgtggtgggggcacatgtggttccaccttggtgtcacttggcaggccaaagctggggtcatagggacctccctccggtatgccattgcgtgaggtggtccagagggagggtcagaagtttgctgggtagacaagggaagcaagatgggtgttactggtgcccaggaaatactatccttgcttcgctgttttgggggtgggcattaaaggttgataccaaagcctcagccatgcccctcagcagtggccaagagcagaatgattggaccaagcccctggcccacctcctcctcctcctcttttcctcttctaaagaagagatcggctcttggctcccagagccccagctgcctgtttctttttctcttttaccaggcatgggggtggggaaacaggggaaccgaggctttggtgtctttcggcatttttgtacacatcagtgagtgggtgtgttgtgcacgcatccatgtgagagtgtttttgtgcatgtgtgggctggggagggctctgaatatctcctggaacggtacccagagccctgtggctctgcgcatgcggggtgagtgtgtgtgtctgcacgtgtccgtgtgtgtgccggagactcagctgcattcacgcgcgcgctctctccctccctctctccctccctctctctctccctccctcccttcctcttccctctccctctctctctccccctccccctctctgtctctccctccttctctccctccctctctctctctcacacacacactctcaatctttctctcttccctcccccttcctccctccttcctattccctccctcctccctttctgtccctgtctctctgtctctgtctctgtctctctctctctgcctctgccagttctgcttggttaggggctagctccagcctctggggtgcctgggagaacatccctccctttctttccccctccaccattccctcccctcctaggccatgctcttcagggcttgcaggcaacttcttctactgccttagatgagggagtgaggagggaggaccccaagccttgtgcccatggtgccatctgcagcaagtgccttggccccgtgacattcatgcctccagcattcagctgccccagctcccagctccaattacccgctggctgctgggggagggtggggagaatgtgccgtgcccagcttgggggtgctcctgcttctgctttcttggctacttggatctcctgcctccattcctgaggggaattgggcagggggggcgtgaagttctgtgggctgataaggaggggctgagttctccagcatgggtgtgggcatgaccacccaccagtggtcatgggggatggatgtgacctgggaggagacctccagacctgggcacccaccttgatgcctggctggagctggcccgggcaggaggagggagaggagagcagcaggtgggtgaggctatgggggagccgagtgggaagcagtctttgatgttaatactgggcatctggcccaagtcaaggctgctgtttatgtctttctgtctctgacctgcagggggggtttcctgttatattcttttggggcggggtggggaggatcctttgtttaagtaaccaatctcccccttatgaggatccccaccccatctcccattctctagcctctaaggtcccacagtggctaggtgatgagtcactgccccccagctccagaacctgtctcctgggggcccagtgagagctcaccaaggggtgccgcctcccctcctcccgtctcccccatgcctgccaggctggggccctgagtctgtgtgtactcctctgccacatcacacctgccaaatagtaccttccttcccgccttcactcctcctctccttcctggcactaggataacagagagttgggtggggcagccctgctcaatccatacctgagaatagaacagggggtatgggaaaggacagggagtcccggtcctagagaggcctctgcccctcagcatgggggcacatgtcgctgctgcagcactgccaccaccacagactcccaggggcccttggtgtgggtggctgcctgtggtgcccgtgttggcatggggggcagtgctgcccatagacgcctgtgcccatgcatgcccatttatgtgtctgggccacggtggccgccccggcccctcagcatcgcccttcctggctcccatggtgggaggctgggtgatcaggagtgggtggtgggggagggatctccccccaccctagcagcaggcagaggggaaggggagagggaggtgtgaacctacccacagaactattaatagcccacatgccaggccaccaagaaccagctgtcaccgtggaaaccattcctacgcccccctccccccagcctgcatggggtgggacttagacagggtacgaagccccccacccatctttctttgttacctttctctctttgtctcccctccttcatgtgtctctcctccctttatctgtcctcctttctacctcaccccttctccccatcccccatctctggctcccctttcttcctctccctctactgccttgtcacccctagctctaccccagccctgtcccatttctttgttcttccccctcctcccttcttccctctttcccccaccagcctttttacccctcctcccatctttccacccttttctcagccgccccgcatgtacgtgtccctgtggctggcaaggagggctgggctttcttcagagcactaaggacaaagttcaggggccccagaaaggtggggccaaagcccagagcagatacgcaggagggttaatgcgggtagtattgggggttagatcctggggacagaaactcccctctggcagccccaggagtcctttgggggtgtcctcagatatacaggactgcagagtgggacggctcggcagtgggaacctggcggggcgcccgtggatgccgcattggccccgtgtccctgtccccccatggcagaagtacttaagcttaatgaaatgcttccccctccacgggcactttgcctacactgcctcccagcagctcttatctcacaaggagggagtgggtggccaggccagccgacaggtgggtcttgctgtcctgctgtccagcctgggcacagaaccccatagctccgccccctcggcctccttggggcagggcctccctcgcctctgcagaggaggtaccaggaaggagtttggggagttaagctggactctggaggaggggtgagaggctgcccttcagggtgggtacccctgccccatgccccttacccgctgacctttttctgtccgtggctaacacaggctcatgtggtatgtgtctccccacatgctgggccctctgcctcgcctctgtatcaccccaaaggcccaagtgtgtccctggagagatgccaaggagtccccaggggttccagcctctttctgggtacccagtgagggtgccctaggcagcaagggcagcaccttgctcctctgcccactaccaggggctgactgtagctgggctgcactgcccagcaccagggcaccattcagttcaaaagaggggtggggcagagagcgagtctgcccctccccccagtgggcacgtgcaggcccttggcagtacccagacacatttggagttaaggctgggcaggagagagggatggggaaataaacatggtggcttaggttggcactgctccaggtctgcaatgtagcaactggtaagtggcaggggcctgggggaggggaccctcaggagccctggcctggggcaggagctgcccatgccatgtggctgccactggtgttccccgcctggcccggcccacagcagccagtgctcattcctgcacacactggtcctcctcggctgcccccaggacctgctccccggggctgcccctctctcagcatgcccactcctgtgcttgcctcctcccctccctgggggcgcttgggcctccggctggcgagtggatttttccagcttctgtaaacaagtggtggcagtgtgccaggcgggcaggagacaggcgggggcagcaccacagccagggtgtgccaagcaccgaggcacagcctggggggcagacggagacacccagacccggagagagagacattcagacacagacagacagacagacatgcaggcagcctcgctggacgtggagtcagaagatcgtcctctattgtccagcccaacccccgtagcggccctcgccccctgcccctcactgtctggctgagagcattaggccccagtgcccagcccctgggcttccccacccactccttctcctccccaacctccaccccttagggctggctacgccattataaatttataacaggaatttctccacaagccaagaaaaacttgacctactttcttgatggctccctgggctaaggctccctgctcatgcccccccaccccagtctcctgtccagcccccagtgcccagtcctggtctggggtgggtatcagaggtagaacgggccacttttctgtgcaatgcccatgctctccacactaccagcttgcctgggtgcagaggccccgttctgctgctggccctgcccaatcccctgacttatctccctctctcttcccaccctggctgcttatcagctcctgggggtggggccagggggcctaggggtgaggtctcctatgcagcagccacgtgacagaggttgaggtcgtatgttggggagctgtaccctttgtccccctcctacccgccacacctgcctgtgtgcacacagacagtaagccacaggtctgcagcccagggtcagaggtgcaatgccgtaggaatggtgggcccggcttggcactgccctggactccaggtagcagaacaaggctagcattagggccaggctgtgaggcttatcccacagccacctgcttactagttgtgtgaacttgagtgaatgaccaagctttctgagactcagtttcctcatctgtgaagttctcgtgccctctttggagggtacagattctctctccagttaatatgtgttagtttcctttcctttcccccttgccatcctggtcgatagcagctcagctaaaccaactgagaagtctggtcctctgcctgggaagtgggattcgagaccttgcgtgggaagctctggagtccctgaggggccagagttggggatcataacttggctggcagcatgggaggtcagttccctacagctttcaacatctctctctattaaggcacaaagatgggcattcatgctcactgcgtgccgctctatgtcccatccttccttcacagataccctccctgcctatgctgaaaactgcttgtctctggtcccctcttgcccctataatacagatgagtttcaggaaagcttttctagaggggtggtaacaatagctagtgtttaatagttgctcattaagggccaggcatttgtctgaatatgaagactgagacatattacttagtacatgaatgatctcattctctccctccattccttcccatgtctggggcttaggaggtggatctccaatctcgcctgctgtacctgttatctaagggatcatcctggtcccctctctatgcctgcccttcctgccccctgctgtcttgttatgggatcccaaagccccaaatgttgccaccaaagggatcctacccaccttcctaccgtgacaccttcttacccctgcctctctcttctctccacagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacaggtaatgggttcagcaactaggtcatgccaactcctaagcagcaggcatgggcacctggctgagctctcctttaggcaccgcctttaagcacctctgtgggatggacgtgaggccagcaagccttctgcctacctttgtctggcagatgaagtcatgttcagatgtgacaggcacttggattgagagatgctcattttgaagcggggagcgatacagagcaattacagggagcacataaggggctcttccctagacattgctgggcagtctcagatgcccccaacgtcccttccaccattgctgcccttaccttgagcatgtgggatccaaacagccttgccattttcttcctctccctaccagcccatttactatctgaccacaagtgtgttgtccacaagctgcggttcacgtaatacatttcagggcacatgcaccagtaactattggtcatagcccaagcttatattcggaatctattgggagccccacaagctcttccttgttcatggtcaagggcgggcactgcgatggggctcctcccagaaagtgcacgccaaccatgatggttttgcttccacatgggtgaggtgtcagccctgcacatacaccaagggatggttacctgtgatctgcattgcccttgaggagcccagagggtctctgtcttttctatcagctccaagtggcacagagctttgtcccagttggcacggtgccctgggagctgggtacagcctgtgcctatggccagggagagggtgggggtgggggtgctccggggagcagtgtggctgactgttgcctaggagatcagatcccgagccaggaagccagaggcctggccaggcaaagccctaaggcccacaactgggtccctggagggtagaggaagtagatggaactcacagctgggcagggcatggggtagctcccctcccccaaagcctcaccccaggaaggactctgaggacgatctggcctgtcgctgtgtggctgtcacttgcagcccctgtgtctcccagcttaggcttctgtgggtctggaagagtctgtgcttaatgtttggagaaaggcaggaatgccagttcccagtctcctaagactgcaacccctcccccatcaccttcccctcccccatgtctatgcgccaccttgtggctatctctaggactacactcagaggctgtgagtctggtggtaactgctgaagccgctagctcaactggggcctaggtgggctgagttcccctgcacccaaccctctgggaggcgtgagggagacctgacctttcagcctcataggaagtagaccggagtaatccccacggggcgtggagcatagggttgtctgtgactgtgaccctggccaaggtcactgtgtcagtgtgttgggagctgcatccggctccaggaggaaggggcctgcaacatgccacacgcagggtgggtgcgggaggttatacaatccttgcatgcatgtagagggcttatgtaacctgtgtgcaccgaggttatgcaacatgtatgtggagagcctggcaacatatatgtgcagtggctgagggttgctaataatacgctgcacagaggggctcagtcccggctctgactctagctcatggtgtcaccaggcacaagcagggtctcagtttgctgctctgttaaatggaggctgtgcagagggtgtagtgttttctattgctgtgggttatttagcatgtgtgtatgacctggagctcaagcaacacgtgcacactggagggatgagggtggttttatgaggtgcctgtgcagagtgttgtgtaacacatgggcatatcctagaggttgtatagcacatttaagaatgccctgaaaatttcacaggtatgttggccctggtgcatactcaccatccatgggtttatagtgaaggttgcatggttattcatctgtgccggtgttatgttgcatatgtatgtgtgtgttctaaaggctacatagctttaagcatatcctgagaattcttccagcgtattcgtcatgtactgaaagatgaggatgtcctgcagattatgggtgcttcaggtcttctggcgggtgaatgtgtgtgtgttggggctctagaatatgcttgtgccacagccaagccccttatctctctcccctgcaacttccagataactggacccttttaagcattgtcagctgaccctggggggtgggaggtagaatgaggacacaaaatggaaagaatcaggccttgggggattgcataagcctctcggatgagaaaggggctactcgaagactgctctgtgattctgcccactttgcctccatccagtgccaggtcaccagatggaaagcgaaaaagaaagaacggccaatgttccctgaaaaccagcatgtcaggtgaggctggctgtgcgtgccccttctccacgtccccaaccccaccaaacccagccagggctcctctggacctggatgtggaacagtaattcatgtgttccctggggggagcctcctagagggcttgggatggacttgtctgggggtgagaaaggtaatgtgggatgtgcccagcttttgagggtggattaggtcaggacggcctcttccctcttcccctaataccctcatctgaggccctaccagaatcagggcctgagctgaaggactgaggggctgtattatccccagtgagcagctgacgtttatttttccctctccaccatcctctgccttgtagatagatcaagaagaaagccctgaatgggcagtcagaagaactgagattcttcatactcttagggcagagatggacaggttcacctcgtgtctctctaggattctaccagggaggctgggctaggagaggggtcagaaacaaaaagttgagggatggggaaaagtgtgagagcctctctgctgggactccaagccatgcctgccttcctccatcctttccttcctcccagggtatatccctagttacctggacaaagacgagcagtgtgtcgtgtgtggggacaaggcaactggttatcactaccgctgtatcacttgtgagggctgcaaggtatggaagctacctcctgcccctcccctgccacctgagcccccatattactccctatgtcacctaaagcccgcctgttaggtcatcactttttttttttttctttgagacggagtctcactcttgtcccccaggctggagtgcagtggcgcgatcatggctcactgcaacctccgccttcaggttcaagtgattcccctacctcggcctcctgagtagctgggattacaggtatgcacctccacacccagctagtttttttgtatttttagtagagacggggtttcactatgtggccaggctggtctcgaactcctgacctcaggtgaccacccgtctcagcctcctgaagtgctgggattacaggcatacctgcctggttactttctcttctcttctcttattcattcatttactcattcataactcctcctctgccactcacaggaaaattgcctaacttcttcgagccttagtttcagtttcttcatctataaaatgaggataatcattctctctaccttatagcattgttgggagaattaaatatgttgggagatagttcacttgaagtgtttaaaacagtgccattgggtgctgtggctcatgcctaaaatcccagccctttgggagggaggccaaggcgggagcatcccttgatcccaggagtttgagaccagcctagctaacacagtgagacactgtctctacaaaattaaagaaattagctgggtgtggtgccacatgcctgtggtcccagctactcaggaggctgaggtgggagactgcttgaacccagaaggtcagggctgcattgaacggtggtggcgccactgcactccggcctgggtgacagagcaagattctgtctcaaagtaaaataataaaataaaataaaaaatagtgccatgtgcataagaagcatttgataaatgccagccatcacccattcattcagtgtattcttaggtgtgagagtgtagtacgtacctcgccttcaagctgctcacagcctgtcagagagagagacacaacttgaaacaaacatcagtgttattcaaaatgtggttcatggaccacctgtcctactagttaaaatgcagattcccagccttcatcttttttttttttttttttttttgagatggcatctcgctctgttgcccaggttggagtgcaatggtgtgatctcggctcactgcaaccttcgcctcccgggttcaagcgattctcctgcttcagcctcctgagtggctgggactacaggcacctgccaccacgcccagctaacttttatatttttaatagagacagggtttcaccatgttgaccaggatggtcttgatctcttgacctcgtgatccgcccgccttggcctcccaaagtgctggggttacaggtgtgagccactgcgcccagcctgcccaggcttcatcttaaccctgctcactcagagcccttttgtggagcccaggaatcttccttttaacagaatcccggagtgtttcccatgcacctgaaagagcgagagccagtactgggggggtagtgggagctgggagcacagaggagaagaggacagcaggttcttccaggcagaggggatgacaaggtcatagattttgggaggcctaattgttttgttttgttttttttgagatggagtctcgctctgttgcccagcctggagtgcagtggtgcaatcttggctcactgcaacctccacctctcgggttcaagcaattctccctgcttcagcattggtagctgggattacagacacctgccaccaagcctggctaatttttgtatttttagtagagatagggtttcaccatgttagccaggctggtctcgaactcctgacctcaggtgatctgcctgcctctgcatcccaaagtgcttaagaggcctaattagatttcactttgatcatttcagcctggatagcctttccaggatcacctcctaaaaatgcaaggccttccaagaaacagaattatttaaatcccagcactttgggagtccaaggcaggcagatcacctgaggttaccacacccggtggcactgttttaaacacttcaagtgaattgtctcatttaattctcccaacagtgctataaggtagataaaatgattatccccattttatagatgaagaaactgagactcagagaagttaggcaattttcttgtgagtgacagaggagggattatgaatgagcaaatgaacgaatgagtaaggtcaggaatttgagaccatcctggccaacatggtaaaagcctgtctctactaaaaataccaaaattggccaggtgtagtgatgtacgcctgtaatcccacctacttgggaggctgaggcaggagaatctcttgaacttgggagatggaggttacagtgagagtggagattaagtcagtgtactccagcctgggtgacagagcgacagagtgatactctgtctcaaaataaaaaaaaaaagaaacagaatgatttatatgttaaaggccaggtatagtagctcacgcctgtaatccaaacactttaggaggccaaggtgggaggattgcttgagcccaggagtttaagaacagcctgggcaacatagtgagaccctgtccatacaaaaaaatttttaaagtagccaggcatggtggtgcacacacacctgtggtcccagctactcaggcagctgaggtaggacgatcacttgaggctgggaggtcgaagctgctgtgagctgtgattaagccattgcactccagcctgggcgacagaacaagaccctgtcttaaaaacaaaaaacaaacaaaaaaaaaaaacggaaaaaaagtttaaggcttgaagtttctctctctttcttgatgtcaaccaaaccaagaccatgagggatttagagttccctagcagaagcaatacaatccttctggaagcaatacaaacagtgtagcatagagaaaggatcttttactctcacggacatctgagtcccagggaagcaccctgaaaagacagagatgccttggccccacccttggatagttttattttgtagttctggagtgaggcccaggaatctgtatctttggtaggtgcctttggtgacttttttttttttttttttttttcaagacggagtctcactctgtcacccaggctggagtgcagtggcgcgatcttggctcactgcaacctctgcctcccaggttcaagcacttgtcctgcctcagcctcctgagtagctgggattacaggtgcctgccacctcacctggctaattttttgtatttttagtagagacaaggtttcacgatgttggccacgttggtcttgaactcctgacctcgtgatccacccacctcagcctcccaaagagctgggattacaggcgtgagccaccgcactcggctgcctttggtgattttaatgcccctggaatctgagagctcagacgttggtgtcccatacctgaggcccagttctgactctgctgcccaccggccacatgactttgggcaaattgcttcatctcaccaagcttcagtttccttgtctgcaaagtggaggcagtaacagttcctacctcatagggttgtctggagggttcactgtgatgttccatgaaagacaaggcttatcttttgggtttttgtttttgtttgtaatggggtctctgtcacccaggttggagtgcagtggtgcgatcatagctcactgcagccttgacctcctggtctcaagcaatcctaagcaatcctcccacctcagcctccagagtagctgggattataggtgcacgccacaacccctggccaatttgtgtatttttagtagagatggggttttgctatgttggacaggctggtcttgatcttgaactcctggcctcaagtgatctgcctgcctcagcctcccagagtgctgggattacaggtgtgagtcattgcacctggccagcaaggcttatgtttactaagtgactgacacattgtaaacatgaaaaaatactaattcttcatattattgcaatcatcttgagttttgaggtgtttcctttaaaataaaggcgaggctgggtgcggtggctcacgcctgtaatcccagcactttgggaggccgaggtgggcagatcacctgaggtcaggagttcgagaccagcctggccaacatggtgaaaccccatctctataaaaatacaaaaattagccgggcgtaatggtgggcacctgtagtcccagctactcgggaggctgaggcaggagaattgcttgtacctgggaggtggaggttgcagtaagctgagatcacaccactgcactccagcctgggtgacagagtgaaacttcatctcaaaaagaaaaaaaaaattaaattaaaaaaataaaataaaggtgaatcccaatgtagagaattgaaatttttctcttcccctactagagttcatactcagtccctttccttgacttttttggttcccctgttttatgaattccacctgcatggacaacaggcaacatatatgagaatggtttttgggtcagtgttgtttttaaagtcatttagcaaaatggaaaatgaggttttacttggatttccttttttttttttttttttttttttgagacagagttttgctcttgttgcccagactagagtgcaatggcacaatcttggctcaccgcaacctctgcttcctgggttcaagcaattcttctgcctcagcctcccaagtagctgggattacaggcatgtgccaccattcccggctaattttttcttttttttttcttttttgagatgaagtctcactcttgtcacccaggctggagtgcaatgcgagctccacctcctgggttcaagcgattctcctgcctcagcctcccgagtagctgggattacaggggcaggcccagctaatttttatatttttagtagagatggggtttcaccatgttggccaggctggtcttgaactcctgacttcaggcagtctgcccgcctgggcctcccaaagtgctgggattacaggcatgagccaccgcgcccggccaaggggtggaccccgccgtggttccaccgcggctcaaacctaggaccttctgcatgtaaagcagatgtgataactgctacactatagaatcgcatgcttttttttttttttttttttttttttgagatggagtctcattctgtcacccaggctggaatgcagtggcgcgatcttggctcactgcaacctctgtgtcctgggttcaagcaattctctgcctcagcctcctgagtagctgggattacaggcgcccaccaccacgcccgggtaattttttttttttttatacggagtcttgctctgtcacccagcctggagtgcagtggcgcgatcttggctcgtggcaagctccacctcctgggttcacgccattctcctgcctcagcctcccgagtagctgggactacagcgcccaccaccatgcccggctattttttttgtatttttagtagagacagggtttcaccgtgttagccaggatggtctcgatctcctgaccttgtgatccgcctgcctcagcctcccaaagtgctgggattacaggcataagccaccgcgcccggcctacgcccaatttttatacttttagtagagacagggtttcaccatgttggccagggtgatcttgaactcctgacctcatgattcatccgccttggcctcccaaagttctgggattataggcatgagccactgcacccaacctcatgcccggctaattttctatttttagtagagacagggtttcttcatgttggtcaggctggtctcgaactcccgacctcagttgatctgcccacctcggcctcccaaagtgttgggattacatgcgtgcgccaccgcgcccggcgacttggatttccaaagctgctattccttaaggcctcacattatcccaggttcaaagctgcctgctctagacatcattcctgcctctgccacaaacactacccagacacccccaacccctcagcagcctgggggctgagggcatatatttctcaggtccttgagcctagtaatcttgggctcatggtgtcaggaggatgccaggtcccctcactgatcttgccttccttgctctccacccctgacccctagtaaactgcatggttggttcaggaaggggaagccatgtcatgatcacagcctgctccatctcccccaccccagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggactgtaaggggcccaggtggagggaatagagccaggtggcctggggtggggatgagttctgggagggcagcttccttccagggtaccctcagagcccacagggcagagtggcaatccagtctaggtcagaatgttcagtgtcttggtccttgctgtcctccttcctgcgcaaaaggaaacaggatccctgtgtgggccccaatgcctacctgccttacaacactcgagggccttagagagggagtcgtttggtagaaagagctcctgggcacccactctagcacactgttcttgactcccagcgaaggcaccccacttctagatgagacagggcatcttccattggctggggattgggtggcaggatattcgagtaaccaccgtcaccataatccgttagaccagaacatgatattcatctggatcagcccaaactgttgttgacatggtcccggggattaatcatgatccgggttgtgctgcccaactgctaggtgatttgggaagtcatttagcctccatggccctcggtttctccaacctgtactctaggaagagtagtttccgggagcattatggaaaggggatggagggtgccatgcgttagaccttgtgcctctctgttcacagtggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctggtaaggagaaagggggcatggggagagcagtagccaggtggcagggagaagagagtgagctcggagtcttgcctcctccaggaagtcttcttagtgtaatccaacccaaaatacatactcttcacacttttgctgtccagattttatacacttgtgtttgtgtccttgctgtctggactgtctactccatccaactgggagctcaatgaggacagggccttgccttcctcatcgaatttccagggagcgggagcgacctttcttctttttcctgcccttagtgactgggaggagagggtaaggatacagttatgtcacagtatttttgagcacctgctgggtgccaggcattatgttaggccctggtcaagctagttgctaagtaaatgatgagtttgggaccaggtgcagtggctcatgcctgtaatcccagcaatttgtgagaccaaggtgggaggatcgcttgagcccaggagtttgagaccagtctgggtaacatacagagatcccacctctatgaataattttttttttttttgatacggagtctcactctcacccaggctagagtgcagtggcacgatctcggctcaccgcaacctccgcctcctgggttcaagcgattctcccgcctccgtctcccgagtagttgggattacaggcactggccaccatgcctggctaatttttgtgtttttagtagagacagggtttcaccatgttgaccaggctggtctcgaactcctgacctcaagtgatccacccgcctcggcctcccaaagtgctgtgattacaagatgtgagccaccatgcccaccctctatgaataatttttttttttttttgagttggagtttcgctcttgttgtccaggctggagtgcagtggcacagtcttggctcaccgcaacctctacctcccggcttcaagcgattctcctgcctcagcttcccaaatagctgggattacaggcgtgcgccaccacgcccggctaattttgtatttttagtagagacggtgtttctccatgttggtcaggcttgtctgaactcgcaacctcaggtgatctgcctgccttggcctcccaaagtgctgggattacaggtgtgagctactgctcccggcctctctacgaataattttaaaattagctgggcatgggggtgtgtgcctgtggtcccagctactcgggaggctgaggcaggaggatcccctaagcctgggaggtcgaggctgcagtaagccatgattacaccgctgcactccagcccaggcaacagagcaagaccctctctcaaaaaatatgatcagtttgggaggagatggacagttggctatacgtggtgaaggaaggcagaaaaccagcacctggttcatggtggagcatgccggggggtggcacagtgcacactgttaagggcacgggctctgattccaagcagatgtgtaacagtcacgagtcagactgcccaagttcaaaccctggtcctaccacttgctggtcatatgactttaaccttattatttagctgccccatgcctcagtttccacatctgtgaaatggtgattattataattattccttttaggattatggtcaggatgaaataagacatgtaaaacatgtagcctgatgcctgatcatatattaagtattcagtcattatagctgctactactgttactaccgttgttattattagctgacttggagctctggttctggtctattctctgctcaagatgaaggaaaagctttgggcctgggactcaggcacgggcggcccctcttccccaagctgccttggagctccccctggtgggcagggagcctcagtgagaggctgaaaggggtctgcggccccagctgacccccgtctttctctctagcccgatgacattggccagtcacccattgtctccatgccggacggagacaaggtggacctggaagccttcagcgagtttaccaagatcatcaccccggccatcacccgtgtggtggactttgccaaaaaactgcccatgttctccgaggtgagtggcagaagtggggagagatgtgatgctgtgctggagggaaacctgctcccccggtcacccagtacaggctcatctgaggttctctggacaaggagcaattcctgtaggtcaacatacacagataacatacacagacacacacacacacatgcatacacatacacccagcacacaggcacacatgcagacacatacacggacacacacacacacctagcatacagatacgtacacagacacacatacacacacacatacacccagcacacagacacacacacacctagtacacaaacacacacacagatacatagaaacacacacagacatatacacccagcacacagacacacacacacacacagacacacacccagcacacaggcacacacacacacacacctagcacacagccacacagatacatagacacacacacacagatacagacacacacacacacacagacatatacacctagcacacagacacacagatacatagacacacacctagcacacagacacacacacacagacacacccagcacacaggcacacacacacacacacacctagcagacacacacatagatacatacagacacacacacaaacacacaggcacacacacacagcatacagacacacgccaaggtctggctgctctaagaaatcagccggctccaagtgctcccctccacagcccctcatccttcaagtctatgcggccacccaactccaggcagcctgaaagttctcattttccagagcactagtgctggagacaggctgccctactagccatgtgacctggggtaagttacctccatcccctgtgcctcagtgttcccatctggagtgggctggggataatgatgggtgctaactcacaggcataatttttttttcttttttgagacagattttcgttctgtcacccaggctggagtgcagtgacgcgatctgggctcactgcaacctccgcctcctgagttcaagcaattctcctgccttagcctcctgagtagctgggactacaggcatgtgccaccacgcccaactaattttgtatttttagtagagatgggtttcaccatgtatgttggccaggctggtctcgaactcctgacctcaagtgatccacccgccttggcctcccatagtgctggcattatagtcgtgagccactgcgccgggcctcacaggcataactgtgaggcttaaatggaatagggcatgcacatggcccaatacaaggtcagccgttcagagtccatgggggccttgcgggcctcacggctcccgtaggacactctaggggagactcaaggacgcggggaggggtatgctgagtgctcctgtggccctgccgctccacagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacaggtacctgctgattagtcgggagggctcagaagcttccaggggtcccagagattggctggaccctgggcctgttgctcaactccctcctgaatcttcttctgggctacctctctgtcacctgggccatcccctatcccctgttccttgctctgtcacacacttctcactcgttccccaggcccatcccttgcctccccatccctgctctgtgccttttcctgtctttgtctccttccttctcgctgccctgtccctctgtcactcacattcccctttgttccccactccccactttgttctcagccaccttccatcccctcatccctcctctgtctcccagtcccatctcttacccctcagtcccctccctaaccccatctgcaccccgcctctctgaccaccaacctcagtcctccccactccaaggctcctctctctcccccagcccccggcctgtccctctgtcctccttgcattgccccctccccccagtacccccctgcccctctccacttcccagctgcctccctctccctgtgcttctcctgtccacgtctctcagggggagcttctcccctcccctcccccagcctctctgcctctatctcccctctagtcctttcttcccacgtccccacacctcaccctccccatctccaggccttcggccagcccctcgcccctcacgcccctcttccctcacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagacaaatgaagaaaaactagacagagagaaaaatacaaaaaagagagagcgagcgatagagagagatgatattaagttattaactgaggctgaccagaggggaggaccccccctttaccaccccatgcactttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactgtggctccaactcctaccctccttatatcctgcagtattagctagaaaccggatgctgctgcattggttgggtcgggggtaggagggctgtgcgtgagcgtctcccagaaccctccacccctttagcactctgtttccctgtttcccatctgtcttctgggctctctctaacctctgccctcctccccagctcctactcactgcactaactctgggcgggcaggtaccagaatgggggtgtttagataagtgacacttagttggggccccaggggaggggtggtcggtgctcctttttctttaaagctcttttggccagctgcccctctgccccgggaccccttcccctcttcttttctctaattcagggactttggcttgagcccctctcgccctcctggtgagggtgctctgttggtctgcacttgggtgagctgtcctcctccccctccctgtggctgccgcccactcctcaggggagagagggagagaggaggtggtcctcccatgggagcaggaggtggggtgggacagagcagaccagagggtgctgggctcagggctgcatgtcggcagggatggatgggtggacacagatgcccccggaagccatggggattggggcagggggtggggggaggggtgccagggcttcctgcgctttgcactattggggcaaaaatgtcttaagcagtggggaacctgccaccccaccctgaccctcagcctgccacagccccctacacacacacacacacacacacacacacacacacacacacggacatgcacacacggacatgggaaggcaatgctatgctgcccgtcagggcactgtccttccccaatcgttcaggtgttccaacaggggtggagggcctggaggagcacccgctgtcacctgtgcatgtgcctgtcccaccctgctggggcctcgggctgcccgcgctgtctttgtctctatcctctctctctctcctggagtactgaatcctgtattactccagtcccatgggtaggccctcttgtaccttcctaccacgcctgggggcccagtggaattcctgacctgtctgctgtcttccccatccctccatccccaccccaacccctccatccccattctcagccatggacacggcagagaaaaggccttgaagagccttagcctcttataggcacttgggactcccccaccctccccaatcatatgagctgtgatcccatcctccccggacccctcccttccccctcggtgatgtggggtgtatgtgtgcgttcctctgcgtgaatgtgtgagtgagtacacatggtaggggaggagccagggcgactcaggagtgccacgcacctgctctagagcggcagctgtcccagtccctgctgtggaagtgggggacagggccctctcctgggggccattggtgctaatgagggggatggccttgatgtgggtgctcagcatgcctcccccagtattggcccggggcactagggcaggcagggtggagcagcaggtgcagtatcggtgggaggacgggttgctgggaataggacgagggggccaggccaggacaaggggttgccagagccatgaccactaccccgcccccaccacccgcctctccatctcagtattgcccctcccatcactcataacacacatacctcatccagcctcctccctgctcagacttggggagggtgggggaggagcccctaccccttctcctggtggcgggtctgcagggctgggagagggcagggcgttgtgagagagagaccgtccataaggaggacagtaactcctgccctgggaactcctgggcgggggggagggggacactgcccagaggcgctactgaatgtatgagaagctggtgctgggctggggggaggggggttgtggccagaaacagggaaggaggtaggtctcttccccagggaggggtgggaccggcaggggtgacttgaggggctcctactcctgccccacgttgacaatcagtatgtctgttatgtgcgatttttcaccccgttgtgttttgggtcaggattttaaagaaagatatttttatggtaattgttgctcgtctattttactatatatttatgtaataaatatatgatgaaaataacccccttgggcaccccccttagacttgtgtgctgtttccctatatcctcccatctgctggcagagtacccaccccacaaactgaccagatggagaggtggccccccccagccttggcagtatttccaccccaccccccaaacgagcacacaccacagaagccagctcagctgtgaactattggatttgagacaggaacagaacaaatcagagggccaggggagggttgtgggggagacagagtggtttaaataggggaggaggggaagttcggtgatgggggagggaggcaggtatttacaagaaggctcagggggccagaggctcatcttggaatattttataacaatataaataagattctggtttgcttttccttttcgtctcgtaaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaactgcgtctgcctcctcccccgggtcaggcgagagcctgacctacctgcagagacaagcaccaccgcggtgaagaggcccagctcctcctcggtaagcgccagggagttgagcttctcgctgaagtcgaacatggcactgagcaggtctcccatgcccatggcaccaagctcctgcaggctgtaggtggtgcggcttaggaacatcactgtctggtccttcacgttgaacaacgaagcaaagcgcaccatcagcacctaggagggaaggggaacagtcatcctgggtgtggtgggaggagcactgaccaaatcgcccctgtagtttgccagagggtttagcggtgctgccttcgatttctcagtagagtgggggttgtttctgaatggccaatgagggagcccaggtggaaggatggctttgggatccaataagcctgaatctgagtgtcagctttgtcactacctgtgaccttgggcaaggcattcaccaaagttaatctgctcttgtctagaatgggggcagcagtgcacccaaggcattatttcagtgtaatgggttgtgattaaattccagctgagatgacagaagtcccagccatcaagaggaagcagcaggagccgctcagcccctttcaccaatcaggctataaggacaaagatactgggttccaaaacctttcagaggtcctgcccaccccagacagcagggctttctgttggatccttcccaaggtcaaaagcaggaagcgtctgggtgcaatggctcacgcctgtaatcccaatactttgggagtccaaggcgggcagatcacctggggtcaggagtttgagaccagcctggccaacatggcgaaaccctgtctctaataaaaatataaaaattagccaagcgtggtggcgggaacctgtaatcccagctacttggaaggctgaggtaggagaattgcttgaacccaggaggtggaggttgcagtgagtggagatcgcaccattgcactccagcctgggcgacaagcgaaactctgtctcaaaaaaaacaaaaaccagaagcataaacggtcactcacctcaaaggtgccagccttaagcagggtgacttggtcatgctgagaaaggtcacggaagcccgggatgtgtttggcaaactctaccacctcccgcacagcgggcgtgaagctcatggagaaatcctcccagatctcctgcaccgttcgcccactgcgtccatgcgggtacatgttcataggacatgcctgggggaggaaaagattgaaggaggggagtgtcagccaggctgggtcagatggacgccccgagcagagctggaccccagattctgcctgggctaggggctgtggccctgaaggatgggtctttcagataaagtagcaattaggtgccaggtggagattagggattcccaggcagagtccagactgcaaggcaagacattttctcctgggaagatgctatccccacactcagcctccaggaacccccagctgccctacactaagtccattctgccaggcccccccaatcttcttaacgcactcgcccgcccccatgcccttaccagcagaacattctttgagttgccctgccggggactgttggcaggtgccttgccttctggggctgcatacacgtgggtggggcatagacggtgcccgttgctgttggactggtggcagctgtggtgtgcagggccaggaggccaggtgggagggtaggaggagggagcctggcgcagaccatttagggcctcgttatgacgctgggcagccaaggtgttgttgtcattgggggcaggtgggcagccctgattttcccagcgatgtggggtggtggctggagggctacctgatgcatggttggcattgaagttgccaggtgagctgcccagcttgtcatgggcgtaggtgaagatctctcgatgggcccgggccacctgggatatcacatcctccactgtgggctcagggcttggggatctgggaggcgtcagctgttgtggaaactgggagaagcccaccaggggtgaggggaccggagcagggggtggcgaggggcccatggggcctggggtggggtgctgggtgggtgaagtctccagcgggcactggctgctcaactggttgttggccaggttcatggcactctgcatctcagcaagcatccgctgcttctctcgtttggggatgcgcccaaaacgcacagctgcaacaggatgagaacagcatcaggaagttctcaaccatgctcacgtgcttctcttccttccttcctcctgaaagggcaaggccctgaaggcttggggtttcacatcaaaactaaaaccagcaagtccccacccatcaagggggtttccctaggagggattgctggtaggaggtgacccgagggaccaatgggatagaagtatatgttgacccaagcaaatgaaggatggacatcccctggcacatgtgattcacagtatgatgtgtctccatttgtgacttttttaaagggaaggattaattcagaaactttgggcggaagaaggggggaggatgtggggatgctgcctcaccgtctcgagacatgcccacagagagacacttcttgaagcgacattgctggcagcggttgcgattgatgcggacgatggagcaattctcattcttcagacaccttttgtactggatgttctgctggatgctccgacggaaaaagccctggagggcaggggtggttagtgaccacctccatcatggctgggcctctgtgtccagggggagggggccacctgcccctgcccttacccccagtccgcctcaccttgcagccctcgcaggcgtgcacaccgtagtggaagcccgaggcaacgtccccacacactttacacagtaacaccatgccattcagctctgtggaagagacgggcagcaggtgagcaggagaggccaggctgagtggccacaggtgtggaggctttctgggccggagatccagggagggaaaagctaaggaggaactccagtgttgaggggcactggagtgacaaaactgggctgaagaggggctggtgccactctaggagaaatccctgaagccagaataggtcctggcaagactggtgtcacgtaaaaacccattcccaatctggccctggcctgcttcccttcccccgaatcagctggaaaggtactcactggtgatgttgctggtgctcttgctgggggacactcggctgctgtcctccatggccacttgtagactcccaggggggctcccattatagaaggaggaggaggatgacgacgaggaagatgaggaagaaggggagccgtcatcactcaggctgggtggaatgctcccaaaggagcgagccgggtcttgggtgagggagccagtgggggatggtgggaagtaggtgggacagccttgggtcagggactggaagctgccattggagttgtcactatagagggattcagggctggtgcggcttggggaggagccactggagccaatgtaggtgatgacgccacctggagagagaacaaaaggaaagggggtgtcagccgccatgtctccggacctagggtgccactgtgctcatccccacctgtctgcccaaaacattgctggccactcagttcaccatgtggagcccctaatcttggagttaataagcaattccccaacacacagtagacatggcatggccaagcaacacctacgaccctttgcaggccaccttcagcttctgctttcagtatgaggcatgacccctgtggcatctcgcatatgtgccccccttccttagttgccttccttgggaatatcgactgcagctaatgacttagttgtcagttgaagatctggggatgggatgggcagctgagcaccattcaaagtgcccagtcctccaaaaacaaaaacccagctgctgattttaacactaagaccattccaggaatgagaccatggaccatggagagataggtagccaacagtaaagagaatggagggtttacaaaagtaagacagtcacattccccccagttggggacatatattctctgaaggaaatgaagggaaggaatctgcccagcctggttcccctggcctcttaagagagtgagccacagtggagtctatccctgtgtccaaaaaggacttcgaggtgcgagttgcaggaggtggaagtacaaactgtccagcctggggctctaaaattcccccttcagatctcagcctggtaacaatgaccttggctctctggccattcagggactttgaccctctggttacattgccaatgaggtggctgtgctcccgtggtattagcaggagaaaaaggtgacctgcctgccacacctccggcaagcacctagattggtctgccatgggcggggtgggagaagggaggatcccaggacacatgtgacctaacacatgccatgccactgtgtctgcagaggcacatgtcttgctcacccactgacacacactgaactgggcagggcggccctaaaatagctcaaggttggtcagggtgaacccagctccttggaaaatagttgcacaacagatcagctcccccggtttcagggctgaggtgggggatggaatcattagttggcagtaaatgaagttgacctagttcacccatcccccaaaaaggagtgagaccttcatgcagaggcttccaacgtggaagtgaggagcatactcaagagtctaggtctaggtctagacccatcactaccaacttattttgtgacctagaggacatcaactcccctctttgggtctcagttttcctttctgtgagaaaaaaaggacagtatcatttcagctatgattgtggggtgcagttgctttggggagcccttagtaggcaaactgcagcttgtctggtggagatgggggtaagacaatgctcgcagaactaaggagagagaagcttggggaacaggaatttgtaatgtggggaagctgagtctaaatgcagtacggtgaagtaggtgcaaataagagtgaagtggaaaggagtgagaagggtggttaggggtgaggtctctttagggagtgtaaaacagaaggccatgaaaggtcaggaatggctccatgttactttgttttggtgatgggggagggggccgggcaggcggaccggaaaaggaggcaggcgggggcggtgagtcagcccagcttcacccagatctcggcggggcggggcagggcgggagctgggccctcagccggcctcacgtccctgctccacgtgtgcctctcgcacgtggctccccaacgaggaaccccggaactcgaggccccgccctcctcgcttcccgtcaatcgagagcagtcgccccgcctcctacccgcccttccccggccaccaggtcgtgggctggaccccgaacgatagcagggccaggacaacctaggggaggagagaagggaacacgcgttgccggggcgaccgggggggcggagctcattatgtaacgaggccgggaggcaacgaccaatggggtggcagccacggcttctgctgaatgaaaacaaacgcagcacgtgggcccggctctagagccatgtgagccctcccggcggccggagccctgtaggtgccctccctcgggccgggcaccacgctctggactcctcaagtgtcgctccctcctgtcactgaggattccccagtgagatccgaacgattctcccagcccctccttccctgaaccccatcgcgccactcttctcagattccctcgcgcctgcaggaactagaggagggggaagacaagaggggagggggtccgttttctgaggccaggcatactacagctgcaggtagtggacagatggggccgtttcggggcactgttccaaagctcccagtccccctaaattcttcgcttcaccacccgtacctcctctccatttcctcctgcccagggattcgaggctcaagggagctttgggactctgaggggtggtgatggggcgtttctgagagcatttccagcccgaacaagccgctctggaaatcccacactaaagcaccgcagcacgttagcaaatctccgggccgagggacaccccagtcccttacaaagttcctctttttataaggcgtagatggaggtggggagacagtgacagggaaaagatgatagtaaagaaatctcagtacctgtgttgttgttggagtccagggtcgtcatgtcttcaccagctgagagcggtcattcaaactggaccttgactcaaactagaggttgcgatcgccgctgttgccccctgggcactggctaagggcggggagtggaccccgcgactcacgatcaggatccgaagcaccctgcagcaaggtcttggggtggccggactgcagccctgcagaagggttggacgttgaggcaacggagttctgctttgcatgggaagagcagagagagtgtgtagggggaatcagcctgcagtagttctggctagaaggtagcaaggagggtcgggtctctgcagtgtacggggtgcctctgcctgccggctccgcagcgctgcggggtggcgaatctggagctcccggtgcaaaagtcccagaggaagagaggttgcaaccaggaagtaagtaggtgatggggagaaacggggcaccgagtcgcaaagaggcgagacgtgtgccctgctacgttccctcggcagtaatatttcactctgccaatctcagccgccttttgcccgagcctttccctgggacagagggctctgcgcaggcgccagcagcccagggttcccgggccgcacgcggcactggagcaggtaccatgtgatcccagggagcgcctcgtgccccagtgacacacttttccaacagccggcacgttgagctcttgcgcgcctgcgcaacgacaagactgtcgggatttgtagtccaccgacaaagtgggcggactgcgtgcctttcccctttctgcctggcaaagcgcttgccgggacctgggaggagctgagagtggggtggggtggggtgcgctgaagagtcagggtggcgtgtttagaaagcctgtatggcaggggcatgtgaatttctggggagggactggcaagcttgtttgctgtctgggagatcaaagctaagaggccctttctgcaaaccttgcaaacgtgagggcttcacgtgattgcaggactgacctcgtcctgaggttactggtgaccgggagagagagaagccggggagggagatttccctggagtcaggagcttaggctgccctctgcttcagggcaaagtccagagaaggaaaggaaatgtgaccccctttcccttctactcgccttagggagaacacctccaggggaaggagttcccacagaggtagggatgtctgtagggactccctgtttgcttgtatgacaccattccacccactccagttgactttggggtgagtcatttccctttgtctgggaaataaaaaggacaacagaggggaactaatagtgaaagtgctttgaggtcctaaagtaatggggaagaggtgaggcagggggtgggggcagagtgacacccctgcccctcggtgctggaggataaaatatgaattccacagaagattactactcagaggggaacatgtagatcatcttaagcctccctctttttactagtggggaacaggaagcttaggagaagtgaccgacccaaggtcagacgtccattgctagtttcatctgcccaccccgaatgggaaggtgggtagatgtacaagtgaaatactgaacaggggttagaaacagccagcattgccgggtgctttggctcatgcctgtaatcccagcactttgtgaggctgaggtgggttgatcacctgaggtcaggagtttgagaccagcctgaccaacacggtgaaaccacgtctctactaaaaatacaaaaattagccggatgtggtggtgggtgcctgtaatcccagctagtcaggaggctgaggcaggagaatcgctagaacccgggaggtggaggttgcagtgagccgagatcgccattgcactccggcctgggggatagagtgagactctgtctccaaaacaaacaaacaaaaaacagccagtatttcgcttcagagcagcaactgtcccatgagtaataacagatctcaagtagaggagatctatcatgttagagggcttgggtcatggaggggatggaagcttcttaggcagcgaagggagagggagcctgagccacctgctgctcccgctaattcctccccagtcccagtgcttctagagagggttttcttcacataggaagcccttctccacaggcagctcctgggatggtattgatggatgcctgggaaacatgaaagccaccgaaaaggtagagaaaaagaatatgggagtccgggggtggtggctgacacctgtaatcccagcattttgggaggctgaagtgggcagatcacctgaggtcaggagttcgagaccagcctggccaacatggtgaaaccccatctctactaaaaatacaaaaattagctgggcgtggtggcgcacgcctgtagtcccagccactcgggaggctgaggcaggagaattgcttgaacccaggagatggagattgcagtgagccgagatcatgccactgcacaacagcctgggcaacagggtgagagtccatctcaaagaaaaaaaaaaaaggccaagtgtggtggtggctcacacctgtaatcccagcacttggggaggccgaggcaggtggatcacccgaggtcaggagtttgagaccagcctggccaacatggagaaacctcgtctctactaaaaatacaaaaattagctgggcgtggtggcgcacgcctgtagtcccagctactctactcgggaggctgaggcaggagaattgcttgaacccgggaggcagaggttgcagtgacctgagatcgcgccagtgcactccagcatgggcaacaagaccgaaactccatctcaaaaaaagaaaaaaaaaaaaagaataataatatgagcacaggagtaaactgggtagtgaggacagtgaggttgactgcaggagcttgaccactcaccctctgactccttgtagaagatgagcttcctggaatgggctaggctttagctttgttctcctgctcccaagaaaagtgggagagagagggcagtgggctcttctctggccctttggcccagagttgggaagctgcagcagagtgtgggagcaactgggaggggctaaaacaaacaaggaaagaggcttttcaggaaaacttggttctcagcctccaccccctctccctccaccctctgggctctggagggaaagctaggaggtgaattgccctgtcctgcccttgcctgctctctgtgaccttgactccaagtcagagccagggccagagcccaggtgtctgtcagggctggactcaaaatcaggacccctggcgtgcatctagctccccacagcacagcaccaccactagcaccctccctttacttggccggggtcctccccaaggcccacagctctgtttgctgctgtggaggtcctacccaccccctgtatacttgctggatgtttgttcttctaggagtgggagctggggtgggtcaagactcctcgcctgctgcaatcagtgagaaggaggagggagcagaggtagagagagctgaaattcagtcagcctgactctcctcttggcaaaacctgggtggttctgcagtctgtgtgtggtgtgaaggcagaggctgggagggagggggcaaaggagaggggttacccccttgctccttccttccttcctttccatttcttatagggcccttccttttctccctcacaagtaattcgggtgtctttcttctacagctggtgagaggagtacagaatgaaaaggcagggttctctcttggccccagaagcttctagtcagtctgtgtaccctgctcctttctctgtcagcagctgctgggagaagggcagaaactctgagacccaaagccaccaaagggaggggggaaaggctgggttgtctggctctgggtgattcggagtagaatcttggtttctctttgacctcaaccttggctgtaagaccttaagacaacaggtgtatctcaacacaaccttcctcacctatccctccagctggacattgctgttcacttctttttttttttgagacagagtcccactctatcgcccaggctggagtgcagtggctcactgcaacctccaccttccgggtttaagccattctcctgtctcagcgtcccaagttgctgggactgcaggagcacgccacaatgcctggctaattttttttatatttttagtagagatggggtttcaccatattagtcaggctggtcttgaactcctgacctaaggtgatccacccacctcagcctcccaaagtgctgggatagcaggcgtgagccaccatgcccggcctgctgttcacttctacacacacacacacacaccccatttctcccatagcccagttcaactcaagaaagcacttaactcttcataaatagtactcagattggatccaggtagaaaagatgcatattcacaacctggtacagcaaggcactgccctggttctgcatacacttccacttggattcccaagtctgggattctggggacgaaccttcccattaggggcagtgttggatcctgcctgtgtgtttccaaatatgtctttaattttccttgatttatttggactgcagaggacagcagacacagaggagaagaaggaaaggtattgagaacactaagctctggtcagttatgtatgtgtgcacgtgtgtgtgtgtgtgtgtgtgattctatgactatgagtgagactgcatgtttgtgtgtgagtgtgaatgctgtgtgtgtgggtgtgcatgtttgatctgagatctgttctccctgtcagtaggttgttctgggtaacagggcaacaccctgtgcaaattctgggtggcctaaatcttgggccaactgcttgactgactgactgactgactgactgactgactgagggtgggtccttgctggaaacaggtcaggcttctgtagatgccttcccatccccctcctttctcaccaagaaaccattgcccagagtagaaacctgtctgcccaggtgatgcaaacctggtatagaaatgctggggatgcccctgaatcagggaaccagccatgtgcctgggagagactcactccctgccctcctaaatccttttctttgtctctaaaaggccagctatctttcccaaccccacccaaagcctggatgttttggggagaactttaagaacatgccacaggaaggacagagtctgagctaacttgtttctcagtgtggtggggggagggggatggagaaagcaagggcgaggcatgagccagggctgggttccatggatgtgttttgcctcagattctatctttacctcactactgctttttccaaggaaaggaaaccataaatatgtattaagtaccaaccgtatgccaggcactgtgcaaagtgttttgtacacattatctcatttaatattcacaacaaccctatgctgtaggtctcattcttattttagagatggggaaactgagacttagagaactttattaacttgcccagggtgccagagggtctaggtgattagtcttgaagctgtaatttgcatagcacttaagactgagaagatgtccatcaaagaatgatagcgcggatggagattattggaggggctaaatctcccctctagctatctcttgaactaccactgtcagcgtcacaatgaaaatggcaatgctggggattcaaccccaggcgtgaagatgaaactctttctgctagcaagactgcccctcctagagagattactgccaccctaggggaacgtctgagcagcaaactcatcctggtgtttcccaagcaatggtgatgcttggaagtgggatatatcaccaagaacagaagcctgaagcaccccttgtccctgtcccagggagtacctcagctttccaaaatctctcttttaaccccaggcacatttcctcttcccctaaactcttcccactccccgtcctacatttccctcatctggttctaaaagtagaaggggcaggaacagggtgcacaaaccacagactgctatagaggtgactaacagaaacaggcgtctgaactctcttctctacccaaaccctctgaatttggggtctgctgctggtggtgaggagagtggggcaagtaggtcagggccctctgaagtcccatggtgcttcattccaggagctgtattaagaagattggttgagggagcgtgtggaaggccaccaaggaccaacaaaagttgtgtccaaagccttaaggaaacagcatcccacttccccatttacctgcttgagcaacgtgcacctctaaaaccagcccttccgaaagccactgtcctgggccaatgcttcttcagcagatgctttgaagaacctgaagaagggtcccctctctcagaacctaggatctcacccacatcacaggatcctggaggaggcatggattgtccttggcagtggagactaagccccagatgaccctttttctggcatccagtacatgctctgctaaggcctcctgtccaatctttgccatgctgctggagccacagtggtatcatcttccaggcccctgcacctgcccattggctgcccttgagcctctgtagaactcagatgcagggagaatgtgggggaggtggaggaaagggagagggggtgctctgcatctgcttccatctctaccctttatcccaagctccatctcaaaccctctccttatccagtgtctctccatcctttgggcctctgcagatcaccattagctgcctggggaggccagaggctcatgacagtcctcgtgagcagaatggacctcggaggagcggtggcctgggcaggcattaggggccttgtgtagcttctgggaggcttacataaacactggctgggatggggaggaaaggggggttgcaatggctgcccagggaaaaaagcaacccccgcccggccggctcagcctgagtggaaagaaggaacaaggcttactttccctcctctcactcctctcccctggtctgcagctgttagtcgggctggaaagactgcggtatcttgggggagggggggcaggagaaggagagagagaggatgcgacttcacaaatttgggatccctcctcctcttctaaattggggggagggcgagtggggaagaagcagtttgccaaagagattttcaatgccgcaggaaggagctttggctcattagaatgcgcagtttgcaccctggaaaaaaaaaatctgtgctggttgcaaaaatgcagacgtgtgtaggggcccagcggagattaaaaaaaaaaaaaaaaagcgctagctctgcaatgcaggatctgcgaagttttggtgcgatgaggaaatgtgggtcgtgctcatttcatttgcttgttcctgctaacctactgtccccctgactctagcatagtctcatagcccagcaagaggcaccgcagcttagaaatggggtcacgagtagggggcagaagcagagagccagaagtgggggtctgtggttagagtgcccagagaaggaccaatggaggttagagggccaggcagatggaagggggcacttcaatgagggatggaggctgaatttgccttttgcacacgcatttgttctgcagctacacaggggttattgggaaagcccttctaggtttcctccagccctcggctcttccccatctccaagtagcagagggactttccccttccggtccactaacctcacagaccactgttgcagaacctttgcttcatgtccccaaacacacaaatccctgaactgtccttgttctaaccctggagggggcacttgctgcgtgtgtgtgtcatcctccttcctagaaagaggggacagggtagcctgatttggggagcccaggctacagggaagccaagtcttggctctgggcagacatcaacacatcaccatgagggctggggtgggctgttctgtgttcttggcttgggaaggtcctttgttcttttgaggcttagggttctgggttgtgaaaacaccaaggggctgcctgggaggaaaatatgcttggggagaccatgtttcttttctgggtgtttgctcccctggtggctcaggagagacaaaaggagacagaagcaggataaagcgcaaggagacaagaagggagccccgcgcgctttccctccttcctcatcttgcctcctgtttctctggcccacggaggaaggggcccagtgtgtttgtgccggctcgaggctcacgcgggctgccggggtcacatggcccgggcatgtgcagcctgctccatttctaccacaacaactcgctcataaacagcccggctgctgcggcggtggcggtggagacatgtgcaagcgagggggtggggcacgtggccctgcccgagccaagggaaggcgctcgctcagcactgcctccacccctccccagcactggcgctgcctcgtcacaggaaattcctagtgctcctgttgctgctgcaaaacatgttttggggaagtgactttcaataaggatggaatcaatggactatttaaaaagagacagaatggataatcagttagagaccgacttacgcctgcccttaccctctcttaagatctctgtactggttagggtggtaccagttccttcctcctatataaaattggaaccatgtaatcccagcactttgggaggccaacgtgggcggatcatttgaggtcaggagttcgagaccagcctggccaacatggtgaaaccccatctctacaaaaaataaaaaaaaattagccaggcatggtagtgggcgcctgtaatcccagctacctgggaggctgaggcatgagaatcgcttgaacccgggaggcggaggttgtagtgagccgagatcatgcaactgcactccagcctgggcaacagagcgaggccctgtctcaaaaaaaaaaaaaaaatggaaccaatcaagtcctcatggtaaacagtggggggaggggctggggttctctaagacagtggttctcaagataagcatagggatctggggtcacctgggaacatgttagaaatgcaaattcccaggccccatcccaggtggattgaatcagaagctctgggagcaaaacccagcaatctgagttttaacaaggcccttgggattctgggaagcctgagacccactgctttaggtcttcggtccctaacaatcagtcctctaggagaatctagcccaagatctggggacatgtcagctgggcgtggtggctcatccctgtaatcccagcactttgggaggctgaggcaggcggatcacttgaggccacgcattggacaccagcctggtcaacatggtgaaaccccgtctctacaaaaaaatacaaaaattagccgggtgtggtgtgtgcctgtaatcccagctgctcaggaggctgaggcaggagaattccttgaactgggaggtggaggttaccatgagccaagatcacacactgcactccagcctgggcgacagagtgagaccctgtctcaaaaaaaaaaaaaaaaaaaaagatctgggggcatgtctaccttccccctttgtgctgcttcatctcaaagtccagccacagggcgtaatcagatttagtttgactcagagtaaaaagcatttattgagtgcctcctgtgtgcagattctggaaatgcgggcaaatggcacaacagtagtaggctaatgagtagctgagatctcaaagaggagtggaaggtactgggtgaggggagagtgaaagaaagaaaaggttagaattttatttgtttatcctttctccatcttacctacttttcttcctgtcccgaggctcctattagaacaaatgattgtggcttaaattgttttgaggctggaggtagaaattaagcccttatctatttttgctggccatggggaccccaagttagttaacagccataggctcttgacttcccatgagtaactaaaagaagatgaggaccatgcacacaggcacacacaaacactccctgcgatctcagatgctagggtagggagaccaagagaaggaatgaagtcccagaaggttggaagttccctgggtaaaatgagtttagcagataacaagcaggaaaagtctttcaataggggagggcggggtcatccctggcctactccaccttcctgagacccagaaactgtggccagaggaaacaaagggtccctaaggcaaatcacaaaagctcctgagaatgaaacctgagcctggaaagagagtagagaatgagggatggacaccagatccaaagggttcccttacacaggcaaatgggggttagggggttgggagggatgtgagccatgcccagcccctctccttgggccttctctccatcacaggcagttctcaggagcagaactcctgttactgtctcagtctgagcagctgactcctggcctctccctgcttcattttttgaggaataagcttttctctgattctcacagagccctttcttttgcttctctgcaaggctttctctctgtgcctgaaaggctctgggctcaaggagcagacagccctgcaggctcaactgcagtgacctacattggctctcccctaggccctgggtgcgggggctgagatttcaagataggaacctgggaatctggcacaggtctacagatgatgacatcaggcagacaggctgcaaaagtggcattgagggactggaccctgaggcaggggatgccataggactatgttctcactttgtcatttgagggctttttatggacaagagatcagaagagatcaaatgcaaaaacacctgagcagtgaccccttggagaggagccagtggtccctgacaggcccagtctctattaatgagatttgggagtggtttctgcctgctccctgttcttgctgaacctacactggtctgctgcaggggactggaaagatgatgtggaagaatgagttcggatttcagctgatttatttcagggaaacgaaggctgggtaaaagtcagatatgcagaaatccacgtactcccaggcttaactataatatagagaccctgtatttctttagactcaatggttctgagaaggatccagaaggagccctcaagattaattaccatttacaaagtccttacctcaggaccctggcaactgaatccctccttccagctaccagccttctggaacagagaaggcagcttctgaaataggtgctttccctctctcccactataagccacagtgtttaggatgaccactgcttccagattgtgtgatttgccctggcaaggaaatcctattgtggggggaggaaatgaggcagtcgtgacacaaagtgatggatgagccttttgcttagcagagagagagagaaagccggcaggctgtgcagaactgagtggctcttgggtccaaagggcttccccttggccaagtcccaccccaaagcccaggaagtccacagcttggcgcccagtcaaggcaaaaacattcctcaggactctgacaggctgggggatggttcccaccacgaggatgggggaggggaaggaaacacgcgggggaggaaatgaccacaaagaagggggtgagggtaagaggtggggagtgagttctcagtgccctgagtcccttttagagagaaaggttgaggctggactcattggcttgtgaaggacttgcagcttcagagcacatgacttctgggtcacccttctgctcagggtcatccctgatgacccaaggtgtcctctggaggcttgttaactcaatctccctccttacgcaggggctgtggttgagcttgggagcccctgagtggctaaaagctggaattgcagttgtgctgggggaggagcccatcgggtctccctctgcctctccacctccgcccctccctttccctctccctaagcccaggactctggaaatagcacctggtaatgggagcgctgacagatgctgagttataggagagcaaatgtcctggctagagtcctcaacattctagtttgatcgcttttgggctgtttcccttgaaaacacgtgccccagcaaggattgaaaaactacctattggtactatgctcactacctgggtgacaggttcagtcataccccaaacttcaccattacacaatatacccttgtaacaaacctgcatatgtaccccctgaatctaaaataaaagttgaaatacacacacggaaaaataggtgccccaggactacttccattgtcttccataaattactgtttaacatgcccctgggtagtgtgcttcctggctactgagatccccctcctagggctccccggcttgtagcttctggaccattcactgtccatgacccctatgaccttggagggagaaatggccccacaataattctgattttaaatttacccctccctacctgcactacttagtcctagttttcctcctctgagccttgcccacaactccttccccaagtcagcctccaaccttgaatgttccctcacccccagttccctacccaatcccccaatcccacatctcctgtaggggataggagtgaggtgaaaaatggacaaagcttagaaatttttccaaggaaactagttccctctgcatggcttcctttgacctattttctaactttccctggttagcccccttgttccatgtaccaaggcttcccactggactaatttttgctgccccgccctactcctccttcctccaacatgatctcctggggctcttcccatccagggaaaatgttccccagtgctgagagagggagagattccattttggaaactatgtcagcttgaggagtccgagctcttaaagagacaactagagtgttgctggggaagcgggtagtggtagtgagcaaaaagcagctcacccacccagaggaggccctgttcccatcacccagcccataattagggcattcttggctcttgtctggaatgggaggatctgagtgctctgccaacatcatgaagaactcaacgggaaatggagttggagtagaggtaaccaactttgcagctggaaattaaaattttattcaactccacccccaagtaattttatttgatgacatccttctcttgcatttgtctcatcgtttgattgtgtaatccttagccagggagctatgtagatatgaaatcattttaaacagaggcagctgcattcccctattgtacctgagccctcatcagctttcctcctctcaagctgctgccccacattcaccctgaagggggcacttttgttcagtcgttagctggtgccagctgaaagcgagctccaggaaggaaacataacaattggtcacatgttggggtgagggttctcgcaggggctgctgggacagggaagggaggtccacgtggagtgggcggaacgcgctgaaagttttggcggggctagcagagggagaaaaatacccaaatttgagttgtgatttttaatagggggaaaaaaaaaaggcaaggagggtgtgtcctaccctctgagaggcccccgcagaggggagcaggagagcagcacactagcatcctgctcgcggaagcctggaacgcaggacatggtttctgccagaaagagctgagccaggccaggctgcggagctggaagcctctgtggctccacgctggcttcccatcccccatcctcccggagaaggcaaaggtggcctctccaactgtggtgtcctttcagtgtcacaggactggggtaataccagtcacacaactccagtctctatttacctttccgagagcttcaggaaaccacccagatgaatcctctttccctggggagtggccaaaacaagtctcctcttttttctacctacttctgccccactgttagctggaaaacgtagctttatacagtcataaagctgcaagggaccttaaagatgatttatttccattttattttttggtctgggaaaaccaagcccagtcaagtgaaaagtcttgctgcatcctctttccacgacataggcattcccttcaaagaatgtaggtcatagaaatggaattctgccattctataagccttagaggggtggtgaaagtattggcttttaactctttccatactcttagccagaaggcaaaaagaatggtcattatctcattagggacagaattgcttagggaggcccgacactgtggctcaatccggacacggtgactataatcccagcattttgggaggctgaggtgggcggatcacctgaggtcaggagttcgagaccagcccggccaacatggtgaaacccccgtctctactaaaaatacaaaaattagccgggcatggtggcaggcgcctggaatcccagctactcgggaggctgaggcagaaaagaattgcttgaacccaggaggtggaggttgcagtgagccgagattgcaccactgcactgtccaacctgggtgacagagcaaggcttcgtctcaaaaaaaagaaaaaaaaaaaagacttaaggacttgatttatggtcctaaacacagttttcctaggctccctcacagctggcaactccactttgcccctctgggcctttgagagctcccttctttacatttcttagttcagggatcaccacagcttaaaacttaatggtttggaaacaagaattcctttcccttcttagaagaccttctcttctcaggtttcagttttctggtggtttagccaggtcatcctgtgtattgagatcaagatcagacctccaatccaaaaattccagctttggctttggtggggaaaagcatgtttacttagtctggagcagtgaaatcctagactttggatttcagagctgtaaagtttccagaaaaaaaaaatgttgagaccaggcacagtggctcatgcttgtagtcccagcactttgagaggccaaggcggatgggtcacttgagcccaggagtttgagaccagcctgggcaacatggtgaggccccatgtcatgtaaaaattagccaggcatggtggtgcatacctgtagtaccggtgactcaggaggctgaggtaggagtatcacttgagcctgggagttcgaggtatgataatgtctgtgaacagctactggactccagcctgggcaacacagccagaccccgtttaaaaaaaaaagtcaaccaaccccagttgtagagtcccaagcagtggttctcaaacttgaagtacatcagaatcacctggagggcttgttaaaacaccacgtgctgcatctcaccccacagtttcttattcattaggtctaaggtgggaagccaagaatttgcatatctaacaagtttccaggtgatactgaaggtgctggcctggaaccacaattgggctagagaggaagaaaacatataatttattcatggaattgccagctggttagtcttagaaatttgacggtaaagccctccttctccctcaccccactttctattgatcaacaaatgctgccaattagtaataatgtgataactacattatcaagcattactaggtgccacatgctatgataaacattttacatggattatctcatttaatcctcacaataaccctgtgaagtaaggtattagtatagtcattttacagataagcaacctgaggtagaggttaaataacacacagccactaaacgggagaactgtgattgctatttgcagtttcacaccagaaactttgctcttaacagctgagtctcctcctgtcattccctctatatccccatactactagtatcttaaccactcatcatctcacacctgcactaacagccttcaagttggcctccggcttttggtgcagagacgcaaatattgaagttagctttcagatacacaaatctaatcattctatactttggtggaaatcctctgatgtttcaccaaggctgataaattatacattccttaactgggccttcagaccttcataatctggtctcaatctgttttatcccctacatgccccactatccagaactacactccaatgaacttctcccattttctacagttacatcctattttttttttgaaacggagttgcgctcttctcacccagactagagtgcagtggtgagatctcggctcactgcaacctccgccttctgggtttgagtgattctcctgtcttgccttagcctccctattaggagggactacaggcacatgccaccacgcccagctaatttttttttttgagacagagtctgtctcccaggctggagtgcagtggcgcgatctcggctcactgcaagctctgcctcccaggttcatgccattctgcctcagcctcccaagtagctgggactacaggcgtctgccagtacgcccagctattttttttaatttttagtagagacggggtttcaccgtcttagccaggatggtcttgatctcctgacctcgtgatctgcccgcctcggcctcccaaagtgctgggattacaggtgtgagccactgtgcccagctgcaatgttcttacctctgcctgaaatgtcctttgatctcaaccttcaaggcccacctcagttgtcacttcctccttaattccttccagatggtatgttcaaatttgttcctagacaaatttactcttctctaggtttcactattttattagagacagagtcttgctctatcaaccaggctggagttcagcagtgtgatcatagctcactataacctcagcctctcgggctcaaacaatcctcccgccttagcctcccaagtagctaggactacaggcatgcaccacaatgctcggctaatttttttttttttttttgagacagagcctcactctgctacccaggctggagtgcagtgacttgatcttggctcactgcaacctctgcctcccaggttcaagcgattctcctgtctcagcatcctgtgtagccgagattacaggtgtgcgccaccacatctggctaatttttgtttgtttgtttgtttgagatgggagtcttgctgtgtcgcccaggctggagtgcgatggcacgatctcgactcactgcaacctccgcctctcaggttcaagcgattctcctgcctcagcctcccgagtagctgggattacaggcatccaccaccatgcccagctaatttttgcatttttagtagagacggggtttcatcacgttggccaggctggtctcaaactcctgacctcaggtgatccgcctgcctcggcctcctaaagtgctgggattacaggcatgagccaccgcacccgaccaaacgttatgaccacaaagggactcaaaccctcaatcttctgatctgaagtcagacaccttatccattaaggccacacggtctcctactctaatttttggatttttagtagagactgggggtttcaccatgttggccaggctggtctcaaactcctcacctcaagcgatctgcctgcctcggcctcccaaagtgctaggattacaggtgtgagccaccagacccagccataatttttaaattttttgtagagacagggtctcactatgttgcccaggcttgtcccaaacgcctggcttcaggtgatcctcatgccttggcctcccaaagtgttgagattacaggcgtgagccaccacacccggccctattttttaatagaactgccaccctcagtcaagctaaaggtcaaaggtaggtagatgctttctcttaatatatctaaacagctcatttaatcatttaaccaatatttattaaatgcctactttgtggcaggtatggttctaggtgctgaggatatggcagtaacaaaacatgaagcagcccagtgctgtggctcacacttttaatcccagcactttgggaggctgaggcaggtggatctctcgaggtcaagagtttgataccagcctggtcaacatggcgaaaccctgtctctactaaaaacacaaaaattagccaggcgtggtggtgcacgcctgtaatcccagctacttgggcagccgaggcagaacagtcacttgaacctgggaggcagaggttgcggtgagccgagattacaccactgcactccagcctgggtaagagtgagactccgtcttaaaaaacaaacaaaccccccaaaactatgaagtttacattgtagtgggggaggataaggtaataaggtaaattagaggtaatacatgctaaggagaaaaatcaagcaaaaaaagggaagaggcggtttggagaaggctgtgagtatacatagcgggggccaaaggtctcagctgacatacagtaaagagctgaaggaggtgagggaggaagtcatgtggacatctgaaggaagagggatctaggtagagggaacagcaactgcaagggcctgaaggggccaacagaaaggagtgaataacagtagaaactaaagtcagagagcagtaccagggagccagatcctacaagccttaatgattttacttttactccaagtgagatgggaagccatgagagggttctgagtagagaaagatcatgatcttactcccatcttaccaggaccactgtggctgctgagtagacttaagtgatggaaggcaaaggttgaaactgagagaccaattacagttactgcaattaaaacaagtgagataggattgtgtggcagaggccagggtggaagttgtggaggtgttgagaaactgtgggattttggacatacatatacatatatatatatatatatatatatatatatatatatgtatttttttttttttttgagatggagtctccctctgtcactcaggctggagtgcagtggtgggatctcggctgactgcaagctctgcctcccgggttcaccccattctcctgcctcagcctcccgagtagctgggactacaggcccctgccaccaggctcggctaaatttttttttttttttgagacggactctcactctgtcgccaggctggagtgcagtggcgcgatctcggctcactgcaagctctgcctcctgggttcacgccattctcctgcctcagcctcccgagtagctgggactacaagcgcccgccaccatgcttggctaattttttgtatttttagtagagacggggtttcgccatgttagccaggatggtctcgatctcctgaccttgtgatccgcccacctcggcctcccagagtgctggggtaacaggcacgagccacgacgtccagccttggacatacattttgaaaggcaatggggtgacaaagagaggaagactgggctgggcgcggtggcttacgcctgtaatcccagctttgggtggctgaggtgagcggatcatgaggtcaggagtttgagaccagcctgaccaacatggtgaaaccccgtctctactaaaaatacaaaaattagctgggcatggtggtgcatgcctgtaatcccagctactctggaggctgaggcaggagaatcgcttgaacccgggaggtggagaggttgcagtgggctgagattgtgccactgcactccagcctgggcaacagagcaagactccgtctcaaaaaaaaaaaaaaaaaagagtaagactgtagaagtggtatttgggtgtttgggtgggaggaattcgggagcttgatttttagatgtaagtttgaaatacctaggccgggcgcggtggttcacacctgtaatcccagcactctgggaggccgaggcgggcagatcacgaggtcaggagatgagaccatcctgactaacacagtgaaaccacgtctctactaaaaaatacaaaaaattagccaggcgtagtggcaggcgcctgtagtcccagctactggggaggctgaggcagaatggcgtgaacccgggaggagctcgcagtgagccgagatcgtgccactgcactccagcactccagcctgggcaacagagcaagactccacctcaaaaaaaagaaatacctattagacatccaactgggtatgtatactagacagttggatatatgattctggagttaggggatgagtccagaaagaaatataaattacggagctgtcagcgtagagatggtgcagaaagtcttgacgctgaaggctgggcacagtggctcactcctataatcccagcactttgggacgcccaggtgggaggatcgcttgagcgagttcaataccagcctgggcaacaaaggctggtattacaaaggcccgtctctacaaaaaaataaaaagttagccaggtgtggcagcccaagcctgttgtcccagctacttaggagactgaggtgggaggatcacttgagccctggaggttgaggctgcagtgaaccataattgtgccactgtactctagccttggggacacagcaagaccccagtgccacaaacacacaagccttgacatggaaagagatcaccacattctatgtgccctctcatccctgctcactccattacttggtgtccctaagctcaatacttcccttgctgatctgaggccatacagtctggtgaaagagggccggactcttggcttcttaacacattcacatacgtttgtttaaaatttccagtgtttcatgctttcagcccacaaagcacagacacagttttaatgagaggttttcacatcaggccagagaatgtcagtcttctccatctccatagagattttaaaaagcacacctcagacaaaaaagaaaaacaagcaattaagactatttcagggctgggcacggtggctcacacctgtaatcccaccactttgggaggccgaggcgggcggatcacctgaagtcgggagttccagaccagcctgaccaaggagaaatcctgtctctactaaaaatacaaaattagctgggcgtggtggcgcgtgactgtaatcccagctactcgggaggctgaggcaggagaatcgcttgaaccccggaggcggaggttgcagtgagctgaatttcaccattgcactccagcctgggcgacagagtgagaatccgtctcaaaaaaaaaaaacgtttttttcacaaggaattctgaggacttgttggctcaattgcttggacataaagacacacatacatgaagctggagagataggaagaagcgctcaacacagaacaccctaagtatccctactccctttcaaggactaaatcccttcagagatttcctttgcttcagtccttcaggagcctcccgaagatgctaggagtcgtttaagaaggctggaagatggccgttgggaaggaactgttggtagctggcaatacttcatcccaaggaggcggtggcaatagctccctgggcagcagacatcatggattttcctccctctgggaaccagaggtccctccgtttctggtttgaatcccttagagacaaagaacttcattctctcccatacccgcgtgggactgctggggaggagagggggtggaggggttagacttctacccccatgaaacacccgcgggctcaaagaggagcctggatcctgactggtccaggaggcgtgcggggccgcggggcccctccggcttgggccaggcgcgttgccaagatgcccggggaaggggccgcccggcgcaggccggggacgtggagcgctcggggcgctcccacgtaggccacacattggccgcctgtatcctccttctttcctctcaactccattctctcgcgcttttttcccggggagcctccgctttccccttcttcccgcggccgccctcgcccttcttccccctccagaccctcccccggctcgcccctccctcggcagcccaccttcaccccgctcctccgcgcgctcctcggtcctcgcccctcagccccggcctcccctcgccggcccccggcccccgcggtcccctccctgcccccctcgaggcggcggcggcccctttcacaatagcgcggcccgcctccctcctctcggctcccggtgcactcccgcccgctcccctccccgcgcatgcgtcctccggttggcggcggctgcggcggtggcggctacgagcggctccgtttttttaaagggaaacgctgaggcgccgggggtgactgtgggggagggggaccccgagccgcggagacccccgggagaggcgacagaccccctctcccggagtaggagggctttgggcggacccagccctccaccccctcctgaggaggaggggggggaaatggaggctcggggcggttgaggcgagctccggggcggggggccggggcggggaagggggggtgcggggtggggagacgaggcgggcccggccgggccagggggggccgaagcgagctccggggatgagctcgggggcggctgggtgcgagctcctgcctctgaggcgaaggcggcggcggcggcagcagaggcggcggcgaggcccccatgggccggcggcgggcctcagccgcggcctccacgtctccgcacgccggcgggatggcgcccgggccccggaggagccgcgctagcggaggcctgctgccgcgctgctgaggcgagcccgccaaactcccctcccccccctcagtcctcgaccccccgcacctcgccccttccccaccccctcctccgcctcggtgcccggcgctgctccggaccactatgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacggtacgggaggggttaatctgcattcgggccgaggagcgagttgtgcgcatgctcgggggaagggggctgtaggaggttaaggcacccccgggttaggggtaaaggaggttggccaccggcaaaggagtatcttaggcgctgggtctctgggagccaggctcacagacacgttgggttggagggaagggttaaagggcaacctctcagggggagggggaggggtttcaggtgccaaagggttaatttaaaatgacagccccagacgtgtgggaaagacgtttagtggaaaaagacgtgatctgtgaggggttaaaaatgaaagggtggggtgtaggtgttgtgtccttatggaagggttaaattaaagagctattgcgttagaaatgcacggtggaggagagggctgtagcaagcagctgttgctttcaccactgctgcagcatctttagataggagggcagtaggccttttagtgggcacaggggtagaggtgatttacgtggaatcctattttagttttcttaaatgatattaagagaatcactgcctttgatttcagacagcttttaataggaacctgagttctaatacatgacccactgaccaggtcccttttataagcatggtgtttgaaactggaagattttagggcatcaggggaaagtaagcttattaaatgtattaaatagacctccccatccttattttagaatcttagggagtaggaaagtcgtttattatttctttacttctgaggagcttggacgacacaggcttgtttttactgcagcagtagttaagggcatctctgcgttaaaacatattccttcagatatgagggaagctggggtggggggtattactgtgctagcataccttacagctgcctaaaaataaacatggtttctacaattgttgtgttcaggctgcagcagtctctctctccctctctccctccctcttcctccctccctgtctctttccctttctctctctctctctctccctccctccccgccgtcctcatctctccctctctcctctttctctctggcgtcgtgtgcgctaagagctgagcaagggagcaagcggctattcattttgtttgctttccaaatgaatctcatcgggtggctgttttattggagaatgcattctgcaaggtggattgggagctggggcaggtctcattaaaatatctcatggtgttgatttgtggaagttactcaacatggaggtggcactgctcagactgtactgcagtctaggggtgtgatggtaccgtaattacaacacatcatatccttgtatggggggagtgggaagagaaggaccagtgaaggagaaaaaaatcaaggaaatgtcacccacaaatggtggttaagggctgtgaatcaaaacatatacaaggagatgaaatgagagtatggctgataggggggttctctgctgattgtggaggtttctgctcagttcctgaggtaatggcccctttgcaggctttcctagtcaggaaaagtggggtgagttaaggatagagtgtcagtctgaacttggtactcactgcttctgttgtgtattgcaatcttaatattgcttaagcttgtttcacttattccagttgttgtttggccttgtctgaaatctatgcaatgaatgtaatgaaggcagcgttaaacatcactgtctaacccagataaaattcttgtaatagagtataagtagcacaacaccttttctcaaaactaaactaacacaaagttttcaatactaatagagttccattttctgtttagttttttagtccttccttttaactaaaactaaaggaactttgattttaataaatatttagatgaataggtataattttttgtgttacctcaaattcaaaggaatgtgtttatgtcatgattgttggaattatgggtactgatttctattttccaaatgaaatgttcattgttttaaaagtaccccctcccacacatacccctttcaaataacactgccattcctggtggcactgtatgagctcttaattccttctcaatgtactgtttgcactttgctgttgtgtatagagctttggagtagaagtagagaggatagaatttggacaatctcagggcctcttaaaagatcatgtaggctgggcgcggtggctcacgcctgtaatcccagcactttgggaggcctacgcaggtggaccacgaggtcaagagatagagaccatcctggccaacatggtgaaaccctgtctctactaaaaatacaaaaattacccggtgtggtggcgggcgcctgaaataccagctactcgggaggctgaggcagggaggcggaggttgcagtgagccattgcaatccagcctgggcaacaagagcaaaactccgtctcaaaacaaaaacaaaaacaaacaaacaaaacatgtatacaattaattctggaaactcccgaaccaacttggagccacacaggtagcagtagcagagaccatgccattaaaaggcatgttacggcccttcccagtggagaggatctccctacagaagaatgaactacaaattaccccatgcctcttcccatctaggttagcccttaaaatttaacagtataccttctcttctctattttgtttaaggaaaactgttcagattaatgtctgcctatttaaaaagttgagttgatgtggtccatagaaagaggcagaagactatactgattcctaaatggggctaagtatctgtgtgtttaattttttatgtgttaagtctgcattttgctactctctcttttagctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggtgtgctgataactttgtttgatgaggacccttgttaccagtgattgagagtaggagattgggatttatgaattggttttatagcaatcataacttgctttagaagtcttctatgcggagggccgggtgtggtggctcacacctgtaatcccagcactttgggaggccaaggcgggtggatcatgaggtcaagagatagagaccatcctggccaacattttgaaaccccgtctctactaaaaatataaaaaattagccgggcgtgatggcgggcgcctgtagtcccagctactcgggaggctgaggcaggagaatcacttgaacccgggaggcggaggttgcagtgagccgggattgctccactgcactccagcctggcaacagagcgagactccgtcaaaaaaaaaaaaaaaagaagtcttctatgctgagaaactatcttgaaacattcttatgcagactgtaaaagtctgtttaggagtattttggtcacagtaataattattgaatgcagcttacatcataaagagaatgggcaataagtatgacagctgagtttcttaaaactatagcagttcacttcaagttaggaagtgttaaattccttcattgtgtcgtgcattggtagacatagaaaagtaaaatacaggccaggcgtggtggctcatgcctgtaatccctttgagagggcaaggtggggaaggagtatggaacgtatggaaagtggggaaggagggatcgcttgcgcccaggagtttgagaccagcctgggcaacatagtgagacctcatttttacaaaaaatccaaaaattagccgggcctggaggtatgcacctgtagtcccagctactcaggaggttgaggctacagtgagctgttactgcaccactgcactccagcctgggtgacggagtgataccctgtctcaattgaaaaaaaaaaaaaaaaaggtaaaaatggaactgtccttggactcaaagaaattagcccaactgtaaggataggcatacattttgaaaactcagaattcaaatgcagtaaaatacgtagatgtacaacacctgatataaactaaggctttttgtttgtttgagatagggtctctctctgtcacccaggctggggtgcaagtgtcgccaacatggctcacttcatcttccacctcttggactcaagtgatcctcctacttcagcctcccatgtagctaggaccataggcactcaccatgcttggctaactttttttagtttttgtagagacaggctctcactttgtttcccaggctgatctcaaactcctgggctcaagtgatcctcccgaagtgctgggattacagacattaaactaagttttgtaagattcagggatattaaaagttattctgggttagaattgtgaaactttaagtagaaatcagtcttgaaaaagaagtatagccgggtgcggtggctcacgcctgtaatcccagcactttgggaggccgaggcgggtggatcacgaggtcaggagatcgagaccatcctggctaacacggtgaaaccctgtctctactaaaaatagaaaaattagccgggtgtggtgcatacacctgtagtcccagctacttgggaggctgaggcaggagaattgcttgaacccaggaggtggaggttgcagtaagcagagatcgcaccactgcactccactctgggtgacagagtgagactccaaaaaagtattaaaatttaggttggtaaagaggaagggagatgactttcttgggatgtggtgggggaagaagggaagaagaaagaggctagagaatgccagcagacagtaagaaaaaggaaataaaggttacaattaatgtggtacagggttgggggaaaaggaaagagactgatctctggattacaagaagtaggtgcacctaatgtgggttgtagtggtacataatgttggctaaaggaccttgaatattctttttttttttttttttttttctgagacagagtctcactctgtcgcccaggctggagtgcagtggcgtgatctcagctcactgcaacctctgcctcccagggtcaagcgattctcctgcctcagcctctcaagtagctaggattacaggcatgtgccaccacgcctgactaatttttgtattttttttttttagtagagacggggtttcaccatattgaccaggctggtctcgaactcctgacctcaagtgatccgcctgcattggccttccaaagtgctgggattacaggcgtgagccactgcgcctggtggaccttgaatattcttaagcatggaaattccttgttcaacatttactggccaggtgcagtggctcatgccggtaatcccagcactttgggaggcctaggtgggtggatcacctgaggtcaggtatttgagaccagtctgaccaatatggtgaaaccctgcctttattaaaaatacaaaaaaaattaaccaggcatggtggtgtatgcctgtaatcccagctactcaggaggctgagataggagaattgcttgaacccgggaggcagagattgcagtgagccgagatcatgccactgcactccagcttgggtgacagagcaagactctgtctcaaaaacaaaacaaaacaaaacaaaaaatttactatgggcctattttatatactgctaagcctgggctgttcctgctcatgactgctaaatgagcaccagacatttaggtacctgaatacttgtcattttggggcaaaagaaccagcttattcttttgctccagaatgtgttcaaattagattttattcaagtgtcaataaattttataatgttttcttccctatctaataggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaagtaaggcatagagaacacttgctcttataccctagtggtggcggtcaagctaacaagtgtgaaaatgcctttggcatttttaaaaaagtgcaatcaataaagcagagttctgtcaagaatgagtaagttaacagccagagacagacactgtgcaggcattgcaaatagatggaattacagcaaaatgtgctcaatgtatttgcctgcttacaacactgggagatgtgtttgccagtaagttgctcatcacaagagcaccagacttgggggtgtaatctccggcaacttgcatgccctctgaaagaagggttttctgtgctgtgaaatgcatagaactatactttgccatgcacgactgttcctgcaattgatattgtgtgaaatctgggagggtggtctttgggtgttctcaggggccaatggtaatttttgggttggggagccagcttggggtggggaattttcacctgggcctccgctctttaactatataaacatttatctgtatatctatgtccctgtctggggggcaggaggaatctgccaaagaccaacagtcttactttatcttactatacttcacaaaggttctaaaatgtgaagagtttacttggattgcagtagcccattggttgttcatatatttaaataaaatggtctacaaactatttttcaaacaataaggactatcttgggatatctgagctgcttggggagggtgtggggtgtgggaccttggtcttcattcccttttttttttctttatggcttccacacagagatgctcccctatcttctacatcaaccagtaactggaatgtgccttcaatcatgtaatattagtctatgtcagtcactgcggttactctggggtaatggttggggaggccttctaggatagagccgcagtcccaagtttctaccactgtgtcttgcctagcaggatggggatagaaatccattccagtgagacaagagcgttctccaggctttgtttggctgttctggtgacaaaattaagtgggaaagctagattagtcgtcttaatgatctaacctctattaggcctcacacttgagtacatgagatagatcaggatcctgatctaggttcagatttttgttggttcagtcagttgaacaggttcttccttaatggttaacctcttttgctgccatggcaatgctgcgtaacaacttaagagaaacgtgaagcaacttcccatccgggattgggtaatggcttggtccagagctgttctgtgtgactggctatttttgaaaatcctttcttccctagtacagacaatttcaaacacctctgagattgtgggcatagtgaaacaaaggagtctaattggggagatcccagccccttgaggagcctgagttgtgaataaacatgtgaatccttattcttgatgcccctatctcaagaggaaggctcaatggcttgttctaggggagccaaagtctttgtgcatgttgttcaggctggaccagcaaggtagtttgtttggagggaggagggagctgtttaagaagactacatatgtaagttttgagaacactgatcttttatttgaaaaatagggtcaacttttactcacctgccatgttctgagtttaaggtttgatatccttggccatcaactgttgcagggaaaccaccctaaataatgaagaaaagaagtcgtctcagtgtaaaaaaaaaaagtggtgggcttattttcttttcttttgtctgttgttccctcttcccctcccccagagagaaattctcaaaagaacaactcaaaaaacaaaatggcttcctagtgagaacttcagtgatgatcctttcctccatttggggtatgggctttttttctttttacactgagattattcttctttcctgcattatttagggtgtctgatgccatcaagtgttgcaggagaaacttcagtcttggctggtgagtagaataggaattgtgctggctgggcctggggtgggggttggtgggatggtggatggttgggagctgcattccccatccactggatgtgggagactgagatttcttggtgtatgattgattacactactatagacttcaaaatgacaacaaatttcagttgtttttcaggaactgctatagcatcattatatgaattgtcaggtattggtttagggtttttgtgatcctgagtttggcagactgcaatggcattttaggttcttttataccatagcaaggacactgaatatggcttcagggaggccatagaatggattcctatcacttggtaactttgtctcttctggggagagacctcttatcctagtgaatagttgtgcaactttggatttaagggtggttccacccctcctccctttctttttctctctcttttttttcagttccttcttggagggaccactcagtagagcctctaagggacccaaatccttcagaccttttggaggtaggtaaccaagagcactcaattgaagagagtaagagattaaatagaatgtgagggtataactggaaaatgtcatagtactatggatgaattaaataattttaaggccagacagaaacttgagaaattatctagtccagctccttcattttatagattaaaaaacaggtctagagtagttaagtgatttattaaaaaataaatagctaggtaatgttcaaaacaaaggtagattttatgctaagtagaaaagttagggctgggtgtggtggcttacgcctataatcccagcactttgggaggctgagacaggtggatcacctgaggtcaggagtcagagatcagcctggccaatgtggtgaaaccccatctccactaaaaatacaaaaattagccgggcgtggtggcgcacacctgtaatcccagctactcgggaggctgagacagggagaattgcttgaacccaggaggcagaggttgcagtgagccaagatcgcaccactgcactccagcctgggtgacggagtgactccatcacacacacacaaaaaaaagcatgtacccctcaaccataaaattacatattccaagctcatttgactcttaaagttttgattattttaaagtcagactcttacaaagtatggaggcagggagggtttatgacagtctgggggttttagtttgatgtgatgtttaccttggaaagatatggaaatgattttgaaatttggagattctaaaaggatgtggatggggaaaggagtatgtgttttgttgattctgttaccaggaggttcccatactgtccatggaacccacagactcaggtagaaccggaaggtgaaagattttacgttcctggaagctggaaattagttagtatatgtgtgtaactaatatatggtgataaatagcttatcagctgcttttctttacacagaacctggatgacagtgtgttttcgaagcggcatgcaaaactggagctggatgagaagagaaggaaaaggtgaggccagagatgtccatcctggaaacaactgagccctaggacctaggacagagtatcagggaacctgacctccctttttcatgctgtggagaatcttggagtgcttaacactcttacattactggcttcccagttggttgaatatcttagttggaaatggtagttgttgcggtaaacatgtttggcctctttttgtgtatgaccttcctcaattctactttctgtggaacaccaacacatgatctaaacggtagacctaaacagctctcccttaacaaggcagtcatttctctttaccctgtctagaggagtcagcaagggtcttcctagcatctggattgtgtgagttgcttttatagagcaggttttgggtaaacagtaatgttgggtttctttgttttgtttggtttgtttttcccagatgggatattcagaggatcagggaacaaagaattttacagcgactgcagctcagaatgtataaaaagaaaggaattcaggaatctgagcctgaggttacctcatttttccctgagccagatgatggtaagttgtgtccatctaaaagagtaggtttttgaaagaaggaggagggtgcaaggctccagggtacaacttgctctgaatgaatgaagtgtattttggagcagatatagcttctagacatttcccatctgtattactaatacgctcccgtttgactttctcccatagttgaaagtttgatgattacccccttcttgcctgttgtagcatttggacgaccattaccaaaattaactccacagtaagtatacattttttttctccccttccaggtaacctgcacatccttttcagacttcatggaagcctagatatgaggtggaaccaggtggcttagggatagccatgggtctttgacagaaatgaggctacctgggcaactagcttttgtaataagattcccaagccaataattaggagtattgctttttgagttagaaatagatgattccatcactttaatggtacacagttgctctggctttgaggcaggaaagacactccaaactagtcagggataggagtggtaagggacatagtgacttttttgtagttgctatcatgtccacactgaatcccttctagtcttgcaagttgatttcctcatccttttttgccaggaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaatttttgaacttctgcttcaatttattatatttattggcaaacaaacaattctgcttgtatatttgaaacattggaaaaagaaatccattttctcaataaaaaagaataacacattattttcccctttataataaggtactcacttccatttgtgtataagtataatgtatgtttcatccctctttgtccagtgtacttccttaagtataatcagcaacttggctgggcgcagtggctcacacctgtgatcccagcactttggtggctgaggtgggcagatcacttgtggtcagaggttcaagaccagcctggccaacacagtaaaacatggtaaaaccccatctactaaaaatacaaaaattatccagatgtggtggcatgcacctgttatcccagttacttgggaggctgaggcaggaaaatctcttgaacctgggaagtggaagttgtggtaagccaagatcaagctgctgcacttcagcctgggtgacagcgagactccatcccacccacccccaacaaaaaaaaagggtcgggcgtgttggctcacatttgtaatcccagccactttgggagactgaggtgggtagatcacctgaggtcagaagttcgaaaccagcttggccaacacggtgaaaccctgtctctactaaaaataaaataaattagccaggcttggtgacaggcacctgtaatcccagctactcgggaggctgaggcaggagaattgcttgaacccaggaggcagaggttgcagtgagccgagatcatgccattgcactccagcctgggtgatagagggagactccaactccaaaaaaaaaaaagtataattagcaattttagaaacgagattataggatacttcgtaagttaacaaaatcttatagctggaaagacattagaggtcatctagtgtgaccccgatatgtgatttacccttgataacactccagacaagcaaattccaggctgtgcttcaacactttttctacatacatttttccccctaagtgtttgaaaattcttgcttgttgacaaaaaatctaacttcttgtaacttaaactcactggtttttgctttgccttctaggatgatgaaaaaaagaccaatccctcctttcttcatagtccctagttaaagattgctgtgggctccaggcccggcgcggtggctcaggcctgtaatcccagcactttgggaggccaaggcgggtggatcacgaggtcaggagttcaagagcagcctgaccaacatggtgaaaccccgtctctactaaaaatacaaaaattagctgggcgtggtggtgcgcgcctgtaatcccagctacacaggaggctgaggcaggagaatcgcttgaacctgaaaggcggaggttgcagtgagcccagatcgcaccactccactccagcctgggcgacagagcgagactccgtccccctcaaaaaaaaaaaaaaaaactggacccagactaaacaactgaaggacaaagtggcagactatcactttccttatttagacactaaacttggcagccttatttgcaccaatttagtctgtgatcgataagatcctccaggttctttttctttaacacttattaaatcatattatcctccattttgaactcaggcagttggcttttggagctggacttataagttgtcacgtttggccacttgtctaattagctgagattgtttgaattttctttttttcttttttttgaaacagaatctctttgtctcccaggctggagtgcagtggcgcgatctcggctcactgcaagctccgcctaccgggttcacgccattctgcctcagcctcccgaatagctgggactacaggcgcctgccaccacgcccgtctatttttttttatttttagtagagacggggtttcaccgtgttagccaggatggtcttgatctcctgacctcgtgatctgcccgcctcggcctcccaaagtgctaggattacaggcgtgagccaccgcgcccggccttgaattttcctttcatctctgaaggcattcataattacttccagtttcatgttatctataaatttgataaacatcaggatccttaaccatgtcatttataaaaattttactcaggaaaggccgggcgcggtggctcacgcctgtaatcccagcactttgggaggccaagaacggcggatcacgaggtcaggagatcgagaccatcctggctaacacggtgaaacctcatctctactaaaaacataaaaagttagtcgggcctggcggcagacacctgtagtcccagctactcgggaggctgaggcaggagaatggcgtgaacccgggagacggagctttcagtgggccgagatcaccccactgcaccccagcctgggcgacagacagagtgagactccctctcaaaaaaaaaaaaaatattttactcagggaagaattctatgccatggtggcctttgtttgataacatacattattaacgtgcactcctgtaggtgcactaaaaacttagctcatgcactttgtatatccttataatggtccaaagaaaacacactgattcttttcaatggtggccaatgccttgccaaaatgaaataatttccataaaccttaagaaggaaataatgtcaggattttgaatcaacatctgtttctactgaccatttatttttaaataggttctaaaatcctgacaagggcagtagctcatgcctgtagtcccagcactttgggaggctgagacgaaaggatcgcttgatcccagccaggagacaagcctgggcaagagcgagaccccatctctacaaaaaacagaaaaattagccgggtgtggtagtgtgtgcccgttgtcccaactactaaggaagctaaggcaaggaggtcacctgtgcctgggaggtcaaggctgcagtgagccgcgctactgcactccagcctgggcaacagagtgagaccctgcctcgaaaaagccaaaacaaaaccggtaatactggcatcataccagcctgcactttgggacaggtgatggctggggtgggaagaaacgtgaagaggaaatgagaacacagagaaaacgctgcaacaagaagtcctctggcttcactgcagacaactggtttctccttcgcccgttatcttaaacaaggctggtgcagcaaatctgacgcagcactacagcttttaagatttaccttgattcgtgattttaccaagcaaaggaatgcagtaaattgacctgcttcaaacgtaggtagaagtgagaaatggaaacagaaaaccatgaaacagccctagtgttgcagtgaagctgtgacaggttgactccttccactcgggaagcccaagatggccgggccaggaacccgggaggctgctgaagtctcaattcccctcgccctaggcctgcccaagggaagtcaggagccgcgccacgcccccttacatcaccgatagacgtaatccgggtcggccgcaaacgtgccgcaggcctaggccccgcccagtgccccgcccctcccccaacacacacacacacacacacacacacacacaccccaacacacacacacacaccccaacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgtgagtgcgcgcaggcggggcggggtggggaccgggcggcgagccggccgggggcggggtgtaggtgatgctaggtagtctgtgagttgatagtagatactgggacttttttttgtttttgagagaaaaggggagttatcccaatgcgagtttgcatccggagttccaagggaagaagaaggattgggggtttctgggaggatggtagagccgctggagatggaaagcggatgttttattcagaagtcggggctggagggaaggagaccagacctgccttggctactacttgataaagatttacctatctctgtctccctctccaaccattttgtgctgaatcttcagcttttcacccacatttctttattgggctccccacctctggaaatcacagaactaacccatgtcttctgctttctttcaggagagtgaagatggcattgaaggtgatggtgagtagcatcttttaccccattaggacaagagttttttttaacataaactcaggtcatctatttccaacatcgacattctcacacactgtcacggatttagggccacagagtgcctttttgtaacatagtggttaagagcataggctttagcagtatagtcttcagcaagttaccctctgagcctgtttctccttttgtaagtggggactataattttatccacgttgtaggttgatgtcagaattaaatgagactcttagtctgacctgtaataagcagccaaaaaatgtttctgggtttctttttttccacatatttctgttttatttcagctgttctctcggattatgaaagtgcagaagactcggaagtgagtatgacaggttttttcctatggtatagatcagaaatgctttttaaaaacgtgtacacaccttcgttgcaaacgtaccatgacctccgtgtttatcctcttgtgtattcttcatttatgcttctgaaaaagtgttacagaaggtcttgttcactttagacctagggaaaacttggggcacgccgtctcaagccacaggtgttatactgttagttggcttctcttcctgtctgaagaatatgaggttctaaataagagagtgaggatatcttgaagtcctctgaaagatgtttgacagtttgttttatgcagtgtaggttgagaagccagccaattggttatttttttccaaatctatctgaagactttgaaagggtaggattcggaatgttttgtgccaagagcatccatcattttataggtggggatttttctgtttttaggagaaagtttcctgtcttttggataaactactagagatgccatcagagtaagtgtttgtttcctgggttgttgagtggactcctgagttctggtaatgggattatatatagggggaattggatggtggatcaaagattttgtctatacatttttagaactgttactacattttagaatctgttaagcccttgaggatggaatagtgaacactataacaaaattcctatctttagagatcttacaactcaataaggaagtcagacaaacattcaagcaattgtaccacttgctgataggggatagcactgggatagggctaagtagggtgttacagctgggtactgaatccatcttaggcagtcgggaaagattaaacagttggctgggtaagatgtgttctaggcagagagaacaacagtcaagaaagcccacaggggccgggagcagtggctcacgcctgtaatcccagcactttggaaggctgaggcagacggatcacttgaggccaggagtttgagaccaacgtggccaaaatggtgaaactccatctctggcccggcgcggtggctcacgcctataatcccagcactttgtgaggcccaggcgggcggatcacgaggtcaggagatcgaaaccgtcctggctaacatggtgaaaccccgtccctactaaaaatacaaaaaaaaataataataaattagctgggcgtggtggcgggcgcctgtagtcccagctactcgggaggctgaggcaggaaaatggtgtgaatccgggaggcggagcttgcagtgagctgagattgtgccactgcactccagcctgggtgacagagcaagactccgtctcaaaaaaaaaaacccatctctactaaaaaatacaaaaattagcttggtgtggtgatgcatgcctgtaatcgcagctacttgggaggctgagacacgaaaatcgtttgatcccaggagatggaggtggcagtgagctgaaatcatgccactgcactgctacctgggtgacagagtgagactctgtctcaaaaaaaaaaaaataaataaataaaagaaaggctgtaggggtacaaaaagaatagtaattagaatgaataagatctaaacccagcgcgatggctcacacctgtaatcccagcactgtgggaggccaaggtgggccagtcacttgaggctaggaggtcaagaccagcctggccaacatggcaaaactccatctctactaaaaatacaaaaattagcagctcatggtcccgcatgcctgtaattccagctactcaagtggctgaggcaggagaatcccttgagcctgggaggtggaggtggcagtgagccataatcacaccactgtactccagcctgggcaacagagcaagactcttgtctcagaaaatttaaaaaataaaaatgactaagatctagaatttcatatttgcaacatggtgactacagtcaaccagtaacttattgtacatttaaaaataactattggctgggcacagtggctcatgcctgtaatcccagcacttcgggaggctgaggtgggtggataacaaggtcaagagattgagaccatcctggccaacatggtgaaatctcgtctctactaaaaatacaaaaattagctgggcgtgcttgcacgcccctgtagtcccagctactcaggaggctgaggcaggagaatcgcttgaatccgggaggcagaggttgcagtgagccgaaatcaagccactgcactccagcctggtgacagggcaagactccatctcaaaaaaaaagtatatatatatattaataaaagaacgtaattgaattgtttgtaacaaaggataaatgcttgaggcgatccataccccatttacccttacatgattattacacattgtatatctatataaaaatatctcatgggccgggcttggtggctcacacctgtaatcccagcactttgggaggccgaggcgggtgaatcacctgcggtcaggagttcgagactagcctggccaacatggcgaaacccattttcagtctctactgaaaataagaaaaattaagtaggcgtggtggcaggtgcctgtaatcccagcgactcaggaggctgaggcaggagaatcacttgaacccaggaggtggaggttgcagtgagccaagattgtgccattgcacttcatcctgggcaacaagagggaaactctgtctcaaaaaacaaaaacaaaaacaaaactcatgtactacataaatatatacctactgtgtactcaacaaaaattaaaaactttctttttctttttttttttttgcttgagatggagtcttgctctgtaacccaggcaagagtgcagtggcatgatcttagctcgctgcaacctccacctcccgggttcaagcgattctcctgtctcagcttcccaagtagctgggattacaggtgcacaccaccacacccagctaatttttgtatttgtagtagagacggggttttaccatgttggccaggctggtcatgaactcgtgaactcaggtgatccgtccgcctcagcttcccaaagtaccgggattacaggtggattacgggtgtgagccactgtgcccagccctcttttttttttttttttttttttaaaaaagaggcagggtctcactctgttgcccagtcacccaggctggagtgcagttgtggggtcacagctcactgcaacctcaaactgctgggttcaaccagtcctcctgccttgacctcctgaagtgctgagattacaagcatgagccaccatacccagccaaaaaaaaaaaaaaattaagttttttttttttttattgagatggagtattgctctgttacccaggctggagtgcaatggctcgatctcagctcactgcaacctctgcctcctgggttcaagcgattctcctgcctcagcctcccgagtagctgggattataggcgcatgccaccacgcccgcctaatttttgtgtttttagtagagatggggtttcaccatgttggtcaagctggtctcgaactcctgacctcaggtgacccacccacctcggcctcccaaggtgctgggattacaggcatgagccaccgtgccccccattttttttgttttgttttgttttgttttttaagacggagtctcattccgttgccaggctggagtgcggtggtgcaatctcggctcactgcagcctccgccccgcctggttcaagtgatttctcctgcctcagcctcccgagtagctgggactacaggtgtgcaccaccacgctcagctaatttttgtatttttagtagagacggggttccaccatgttggccaggatggtctccatctcttgacgtcgtgatccacccacctcggcctcccaaagtgctgggattacaggcgtgagctactgcgcctggcccaaaatttttttaaaaagagaaaaagcccagatagagaagatagagagcgtttgggaacttgggagtaattaggtgtgactggagcattgttgggacaggataggtattagaaataaagacaaattggtgagcaggggccactaattggtgaggtgggaggattgcttgagcctgggaagtgaaggttgcagtgaatcaagattgtatcactgtactccagcctgggcaacagagcaagaccctgtgtcaaaaaaaaaaagtgatgcgattggatttatttattcattttttaaaaatttttatttactgttttttgtttgtttgtttttttaatttttagtagagatggggtttcaccatgttggcaaggctggtctcgaactcctgacctcaagtgatctgccggtcttggtttttcaaagtgctgggattacaagcatgagccactatgctttgtctgatttaaattttaaagatgtgtttttcagatccagagaacacttgcatcagaaaatccaattagccattctctactgaaacagactcttgggaggggcattggagactcagacatttatgtattaaagaatatcccaggttgatgctatgtactgtaaaatttgaggattcttttatagcagttattttgtccacagtgaagagaaacaagatcagagacagaaaagctagttaagaaagctattgtaggaatctagttaagtagtgagtgtggcatggaatagagtggtgatagtgaaaatagaagtggacagaattcagagttagaagtggttttgggatggggaatatttgctgcagtacagatgctttttgatttatggtgtagttacatcccatcctggtaaacccatcataagttcagaagttcaagataacttcttggctaacttggagcagcaactctctgttgctatccagcatctcgagaagtacgatttctttttttttttttttttctttttttaagacagagtctcactctgtctcactctgtctgcagtggcgtgatctcagctcactgcaacctctgcctcccgggttcaagcgattctcgtgcctcagcctcccaagtagctgggattacaggcgcacgccaccatgcctggctgattttttttgtatttttagtagagacggggtttcatcatgttggacaggctggtcttgaactcttgacctggtgatccgcctgcctcggcctcccaaagtgctgggattacaggcatgagccacagtgcctggcctcttttttatttttttaaaaatatttttaatagagatgaggtcactctgtgttgcccaggctgatcttgaactggactcaagggatcctcccaccttggcctcccaaagtgctgggattacatgtgtggtgagccactgcacccagctgagaagtacagtttctactgaatgtttatggctttcataccaccataaagtcaaaattataagttgaaccatcatacatcagggaccgtctgtagtcactagagaatggaaacgttggagaaactgacaggcaatatggagtgttcattgagttttggggattgtgaatttatagcagcttaccattctatatgtaagggagtttggatgttttcctaatggctaggaaagaagtaccactgaaggcttaaatgtgggggatgaattgtgggtgaggcacaaaggaagactagaggcagaagagctgtttagaggttgttaggatagtccaaggagcatgacgatggtgcccctaaagaaggttcatacttgttggaatggcaagatgtgggacagattagagagagattctagtgtactaacaaccccttcattgattgaatgtggaacctaaattaaggagtcaaaggaggccaggtaccttggctcatgcctgtaatcacagcattttgggaggctgaggcaggtggattgcttgagcccaggagcctgagacccacctgggcaacatggaaaaatcctgtctctacaaaagaaaagtagaaaaaaaaattatccggtcttggtggcgcaggcctgtggtcccagctactgaggaggttcaggcaggaggatcatctaagcccagggaggtcaaagcagtagagctgtgatcactccacagcactccagcctggacaacaaagtgagaccctgactcagaaaaagaaaaaggagtcaaaggaatgtgcaggttgatgaatggtgttgaatggtgttaactgttaaggaagggaccccaggagaagagttctggaaggacagttgtgggttaggttttggatgttttgagatcgagaaggtgtgggacttttaggtggtgatacctggtaaatagtttttgattcctaattgctcatacctttctgagttctcatttcatttttgagtttttccaattctgattgatgttctttcatgccttatataattttcttaatgtctttttagcttattttgaaatagaagttgcaattttgatatgatatgcggatgtctttctggcatgctttcattgtctgtaggaatgctattattttttcttattataactttatgggatttaacttctgtattttctgttcatttttatgtaaaattagttttcctggtcttttcgaaggaagcatgatttagaatagctttttctaacttcacagagctgcttctgttgtttttctgtggtggtgagaaatatggtggcttgctttctgagatttgttgcttttgttccctttcccagcttgttctggaccatccctgtcctactgaatttggtcctgctctcaacagtttctcttctaggaactcccttctagggacagtgtagggccctgtccccagaaggaagccctggcagccaggtcagcttcatcccttcagaccttttttttttttaagacagagtctcactctgtcgcccagactggagtgcagtggcgcaatctcagctaactgcaatctccgtctcctgggttcaagcgattctcctgccttagcctcctgagtagctgggacctcgtgtgtcaccgtgcccagctaatttttgtatttttagtagagatgaggtttcaccatgttttccaggctggtctcgaactcctgactcagatgatccacccaccttggcctcccaaagtgatgggattacaggcatgagccaccgtgtgtggcccccttgctagttgtaagtgctgttctcagttttgactgttgtgctttcccttgactgcctgttgattatttcagtgttctcctgttctcaggtccatttgctttctctctgctttctcctgcgtggacaccagtactatacaggtcctacagctgttggtgctttgttatgcacttacattttgggtcttgggggatacctggtaacttaactttgttgcagtgttgtctgaaggttttggtttcttttttattttttgagacagagtcttgctgtcgcccaggctggagtgcagtggctttgccttccagattcaagctattcttgtgcctcagcctcctgcgtagctgggattacaggtgcgtgccaccatgcctggctaatttttgcatttttagtagagacgcggttttaccatgttggccaggctggtctcgaactcctggtctcaggtgatccacccacctcggcttcccaaagtgttgggattatggacgtgagccactgtgtctggccagggttttggtttgggtctcggttttgctgtccagagctctcattccatgtggagatttgaagagagataaaactgtgccactgccattttctgagagtcttccaagaattcttttttttttttttttggcaaatgggtctccttattttgcccaagctgagcttgaacttgaacttacaatcctcatcagcctcttgaatagctgagacaataggttcatgccactgtgcctggccaaaaaaacttgttaaagaaatttgactgagggaaggctgaagagatggtagttggagaggtagctttgagatcaagaggtgatttggatgttttttaaaaagttaggagagtatcaaataaggtcaaagattgaaaaaaagaaaagaaagggggaaaaaagagagggaatagataatgatattgagtactggtatttttgactgagtatatgagaaaaagtaggaaccagacaagattaacatcttccattgtaattacagagaagtgggaaggaaaggtatgtgcaaaggaagattagaaaggagggaaaagctgggtgcggtggctcacgcctgtaatcccggcactttgggaggccgaggcgggcagatcacgaggtcaggagatcgagaccatcctggctaacatggtgaaaccccgtctctactaaaaatacaaaaaattagccgggcatggtggcgggcacttgagcctgggcgacagagcgagactccgtctcaaaaaaaagggaaaaaaaagagggaatagataataatattaagtactggtattcttgactaagtacatgagaagatgtaggaaccagatgagaagtatcttccattgtaattacaaagaagtgggaaggaaaggaagttagcgttcctttctgtgttttgtttttgtgaaatagaaggatagagcaggacaggcacggtggctcacacctgtaatccaagcactttgggaggccaaggcaggaggattgcttgagcccaggaatttgagaccaatctgggcaacaaagtgagaccctctctctacaaaaaatcaacctggcgcagtgatgtgtgcttatgtcccagctacttgggagcttggagtgggaggatcccttgagcccaggaggtcgaggccacagcaagctatgattgcaccactgcactccaccctgggtaacagtgtgagactctcgaaaaaaacaaaagaatgacatctgcttcaaaaagtaagagtgtgtgcgtgtgtgtgtgtgtgtgtgtgtgtgtgtgtaaccccctttggcaatggagtagtctgttgtaggcctggagaaagcagacatttgaattgatccagttccaggcatatgggagtggcaagagaaatgggatgttactagtagtgattgaaatgaatgagctatggagtctagagagagaagaaagtgaatgtgagaaaggactgataggcagaagttagaagcatcaagggaatggatgcattgaaaaattagagacgagacagtaaggaaacaactaggaataagaggcatttttttaaaaaactgctttattgtggcaaggcgccgaggctcatgcctttatcccagcactttgggaggctaaggcaggcagatcacgaggtcaggagatcgagatcatcctggctaacacggtgaaaccccgtctctactaaaaatacaaaaaacttagccagatgtggtggcgggcacctgtagtcccagccactcgggaggctgaggcaggagaatggtgtgaacccgggaggtggagcttgcagtgagccgagatcacgccactgcactccagcctgggcgacagagtgagactccctctcaaaaaagaaaaaaagaaaaaaaactgctttattgagatacaattcacagaacgtacagttcatttatttataaagtgcataatttagccaggtgcgtgcctgtactcagctactcaggaggctgaggcaggaggaatggtcggcccaggagttcgagaccagcctgggcaacatagtgagacctcatctctttttatttgtttgtgtgtttgtttttgagacagagtcttgctctgtcacccagtctggagtgcagtggcacaatcttggttcactgcaacttgaccctctggggttcaagtgattctcgttcgtcagcctcccggatagctgaggttacaggtatgtgccatatgcctgcctaatttttagtatttttagtagagatggaattttgtcattttggccaggctggtctcaaactcccagtctcaagtgatctacccacctcagcttcccaaagtgctgggattacaggcgtaagtcaccacgcctggcccgtaagaccttatctctataaaaaataaaaaatttagccaggcgtggtggcgtgcacctgtagtcccagctacttggcaagctgaggcaggagaattgtttgagcccaggaggtcaaggctgcagggagctgtgatcataccactgcactccagcttgagtaacagagtgagaccttcatctcaaaaaaaaaaaaaaaaaaaaggaaggaagaaacccagttctcccatccttcccgtagcctcaagcaaccgcaaatctactttctgtctctgttgattttcctattctggcctttcatatgaatggaattatgtaatatgtagatttatgtgtctggcctctttcagtataatgttttcatctgacttgtagcatgtatcagtacttcattccttctttctgcctccccaccccagctttattgaggtataactcacaaataaaaattgtatacatttaacacatacagtgtggcatcttgatatatgtgtacattgtggagtaccacagttaagctaattaacgtatctatcacctcacctagttaacctttttgtatgtgtgtgatgagaacaccgaagagctactctcagcacatttcaagtttacaatatgttatttatttttattttacatggtttaaaaagagacagaacctttgtcacccaagctggagttcagtgatgcagttatagctcactgcaacctcaaactcctgggcttaagcaatcctcccacctcagcctcctcaatagctgggactacaggcgtgcactaccatgcccagctaatttatttatttgtttttatttttattttttttttgagacggagtttcactcttgttgcccaggctggagtgcagtggcatgatctcagctcactgcagcctctgcctcctgggttcaagcggttctcctgcctaagcctcccaagtagctgagattacagtcatgcgccaccaagcccagctagttttgtatttttagtagaggtggagtttctccatgttggtcaggctggtctcgagctcccgacctcaggtgatccacccactcagcctctcaaagtgctgggattacaggcgtgagccaccatgcccagccgcccagctaatttttaaacaaattttttgtagaggcaaagaatcgctgtattgcccaggctggtcttgaactcagcttcaagcaatcctccagcctcagcttcccaaagtattaggattacaggcatgagccaccatgcctgaccaagtatacagtacgctattattattattattttagacagtcttgctctgtagcccaggctggagtgcagtgttacaatctcggctcactgcagtctctgcctcccaggttcaagcaattcttctgcctcagcctcctgagtagttgggattacaagcgcccaccaccacgcccggctaatttttttatttttagtagagacagggtttcaccatgttgcccaggctggtctcgaactcctgacctcatgatctgcccacctcggcctcccaaagtgctgggattacaggtgtgagccaccacgcccaaccagtaagttattattaactatggttaccatgctgtacattaggtctccagaacttataactgaagttttatatccttttaccacgatctcattttcgctacccttaagccctagaaacccccttcctactctctgtttctatgagtttgacttgagatcatgtggtggttatctttctgtgtctagcttattttacttagcatagttccgtctaggttcatccatttgttgtcacaaatgtcaaaattttttttttagggcagaattagattccattgttcgtgtgttccacattttctttatccattcacccaacaacagacacgagttatttccatagcttatttccatcttttggttattatgaataattctgctacaaacattagtgtacatgtttttatggggacatatgttttcacttctttttgactatgtacctaggaatggaattgctgagtcatgtggtaactctgtaatcatttgaggaactagaaccgccatactgtttccaaggtgctgcaccattttacgtgactagcagcagtgtatgagggttccagtttctctatatccttaacagcacttgttgtgttatttacccaggtgcatgcctgtactctcagctactcaggaggctgtggcagtaggatttcttgggcccaggagttcgagaccagcttgggcaacatagacctgtctaaaactttttttttttggcggggcacggtggctcacgcctataatcccagcactttgggaggccgagtcagacggatcacttgagatcaggagttccagaccagccttgctaacatggcgaaacctcgtctctgctaaaaatgcaaaaattagccagccactgtggcacgcgcctgtaatcccagctattcaggtggctgaggcataagaatcacttgaacccgggaggtagaggttgcagtgagccgatttgattctagatgtcctattaggtatgagatgttttctcattctgatttgcatttccctgatgactaatgatgctgagcgtttttttttttttttttttttggtgcttattggccatttgtgtatcttccttgaagaaatgactattcagatacctaggcaattttttaaaaattaatttttaattattgtttttattttttttagagacaaggtcttgctgtattatccagagtggtctcaaactcctgggctcaagcaagcagtcttcccacctcagcctcctcagtagttgagactataggcatcagccaccacacttgatctttgcccaaagtagctgggattacaggtgtgcgctgccatgcccggctaatttttgtatttttagtagagacgaggttttgccatgttggccaggctggtcttgaactcctgacctcaggtgatctgcccacctcagcctcccaaagtgctgggattacaggtgtgagccactgcgcttggccatttttttttttttaattgagatgtaagagttctctatatattctgtattctagatgtaagtcccttatcagatatgatttgcaaatatgtgttccctttctgtggattgttcactttctttatagtgttctttcaaggacaaaggttttagttttgatgaagcctggtttatgtttttccttttgttgcagatgcttttggtgttaggtatctaagagtcatttgccaaactgagagtcatgagtatttactcctgtgttttcttctaagagttttatagtttcaactcttaaatttaggtctttgattcattttgagttagtttttatatgtggggtaaagtaagggtctaacttcattctttttgttttttgagatggagtctcgctctttcacccaggctggagtgcagtggcgctatctaggttcactgcaagctctgcctcccgggttcatgccattctcctgcctcagcctcccgagtagctgggactacaggcacccgccaccacgcccagctgattttttgtatttttagtagagatggggtttcaccgtgttagccaggatgatctcgatctcctgacctcgtgatctacccatcttggcctcccaaaatgctgggattacaggcatgagccactgcgcctggccaacttcattcttttgcacgtgacgattttggtccatgactcgggtgtttatacgtaaggttttattttgttttgttttgtttttttgagatggagtctcattctgtcacccagcctggagtgcagtgtcgctatcttggctcactgcaacctctgtctcctgggttcaggcgattctcctgcctcagcctcccgggtggctaggattacaggcatgagccaccacgctcagctaattatatttaaggttttaaaagtggagcagttttacttataataaagcatagcagttctaggtaagactggtttggagtgcagccatggaaatggatggctgaagtgcaggtgaagactgacctcagtgctaaagtcttcctgtcaacgacaggcccgtggcctcggaggagccggggtttattaaaatgaggctagaggagttagatctgaaagagacattgagaataaggataccaactccatctcttagtctgaaatatgtgggaagtagaagaatgagctaaaacttctgtattagaatttttcaaaggaacagttccttcagggtggagctagtaagaattggaaagagtacactgaaatggtgggtgatgtaggggagtttgtctcttctggaaaaaggttttgatgacatccctttgccaaagcagtgtgaccgtgtggtagcaccttggcttcagttagactaagctttgactaatttggagcctcctcagtactatgctatttgtatctgttctgccctggaaacaaaattagtttttcacttaaaataaagttgccttatttgacatcctaccacagatcagagggtggagcataaaacaagctttccttattaatcatgtgataatactatttaaaggtatttgaattaaatcagtacgtgtgtgtagggagatggagaattaaagtcacatacaccaagttattgtaatttctgcttgaaaatcttcagggaacataggatcaaggaaagaactgaatgattgccacctacccatcctagtcttgaggaggaaaaacttcatgtaattaagggaaatgggaagaatcaatggtgctcagttgttaaaaagctataggtaaaggcttgattctgatagtgtgggtatagtcaaacagtctccctctattctgttacctttctgagagtcctaacccaaaacactcaaggccaaaatagttaacctttgaacggccaggcgcggtggctcatgcctataatcccagcattttgggaggccgagacaggcggatcatgaggtcaggagatcgagaccatcctggctaacacgatgaaaccccgtctctactgaaaatacaaaaaataattagccgggcatggtggcgggcgcctgtagtcccacctacttgggaggctgaggcaggagaatggcatgaacccgggaggcggagcttgcagtgagccgagatccagccactgcactccagctggggcgacagagtgagactccgtttcaataaaaaaaaattaaaaaaataaaatagttgacctttggacaacatgggagttaagagtgcctatcctgtctgggtacagtcactcatgcttctaatctgagcactttagtgggccaaggcaggaggatcacttgagtccaagagtttgagactagcctggacaagaaagcaagaccctgtctctacaaaaaaaaggacaaaaattagctgggcatgatggcacgtgcctgcagtcccagctactcaggaggctgaggcaggaggatcactcgagcccgggagtttgaggctgcagcaagccatgatcacaccactacactctaccctgagtgatacagtgagaccccatctgttaaaaaaataaaagggggttggccgggcgcggtggctcacgcctgtaatcccagcactttgggaggccgaggcgggtggatcacgaggtcaggagatcgagaccatcctggctaacatggtgaaaccccgtctctactaaaaatacaaaaaattagccaggtttggtggcgggtgcgtgtagtcccagctactcgggaggctgaggcaggagaatggcgtgaacctgggaggcagagtttgcagtgagctgagattgcaccactacattccagcctggacaacagcgagactccgtctcaaataaataaataaataaataaataaattaattaattaattaattaaaaggggctgggcgtggtgcctcatgcctgtaatcccagcacctcaggaggccgaggtgggcggcttgcctgagctcaggactttgagaccagcctgggcaacatggtgaaaccttatctctactaaaagtacgaaaatagctgggagtggtggcatacgcctgtagtccctgctactcaggaggctgaggcataagaattgcttgaacccaggaggtggaggttgcagtgagctgagatcgcgccattgcactccagcctgggcgacagagcaagactctgtctccaaaataaataaataataaataaaatataaaggacacctatccctgttgcagtaagaattccaagtataacttttgactcacccaaaacttaactactaagtcaactggaagccataccaataacataaacagtcagtgaatatgtattttatattttatgtgtattatgtactgtactcttacaatgaagctagagaaaagaaaatgttattaagaaatcattcactattaaggaaacatactattcagtggaagtggatcatcataaaggtcttcatcatctttgcattgagtagacttcagaagaggaggggttgatcttgctgccttgggtgacagaggcagtggaaggagaggcaggcatacttgctgcaacttctattgaaaaaaaatttgcgtagaagtggacctgagtagttcaaaccccttgttccagcgtcaactatacccagatgctgagcagggaaaaatgaggaagagggattaattggcttgtctgggccaatcaggctgactcagctctatttgaagagatggcagaaacttagagtttgagagtttctcaatcaggaattcaggaatctcatgttgagcctctttgaccagattattggggccagcctgggtcttgagtgacagggcagtctggttcagttcaagtatcagacccagtaggtgagtgagagaccagtgtacatacatctaccaggtttcagatgtaacccaccaatgaagactagaccacctttccttgaacccatttctctgtgttctcgtaggcctccctagccatagctctgcctccttaggtccaaatctggggaggacaaggagaggagagtaaccctattctaaagccagttcccttatcatgagccttagctgctgccttttcctacctagaactagccacacgtccatttcctggccctttctaatggcctaatgatcctttgtgtgtagacccagcactttctgtgtcatgaacagtgttacccaatcttgatgtggtaaaagagggaagaagatagtaaaaagagagagagagcacttggactaatttttttcatttctgaaatgtgatggttgtacaagttgtcctttaaggttttttaggtcaaatttttgtaattatgtgattctggatatgttctggctgcaggaattttctgctgcagaaaaccagtactcataggcattaaaaaaagctaccattttccagcttgaggataagtgcattgggaaatcatggagtcattatcaagagtttgcacatctggttgggcgcagtggctcatgcctgtaatcctagcactttgggaggctgaggcaggaggttcgcttgagctcagaagtttcagaccagcctgggtaatgtggtgaaactctgtctctacaaaaaatacaaaaattagttgggcatagtggtgtacatctgtagtcccagctacttgtgggggctgaggtgggaggattacttgagcccaggaagtcaaggctatagtcagttgagatcacaccactgcactccagcctgggcgacagagtgagaccctgtctcaaaaaagagttgcatgtctactcattcagttctcattatctatagactaaaatatacatctccccccttatgtactactatttttgaatatatgtaaattaataaaatgtaaacttaaagtgttattgaatgtataacagtttgttgttttttgtttgtttttgagacagtctctgttgtccaggttggagtgcagtggtgcgatctcggttcactgcaacctctgcctcccaggttaaagtgattctcccgcctcagcctcctgagtagctgggactacaggcacgcacgcatcagttcattgtgtgtttttttttttttttttttgagacaggatctctctctgttgctaagactggagcgcagtggcacaattatggctcactgcaacctctacctcctgggctgaaatgatctcacacctcagcctcccaagttgctgggactataggcgcacaccaccattcctggcgaatttttttttttttttttttttttttgacagggtctcactcttttgcccagactagtatcagtggtgcaatcttggctcactgcaacctccacctcctgggtttaagcaattctcttgcctcagcctcccaaatagctgggattacaaattcatgccaccatgtctggctgatttttgtatttttagtagagacagggtttcaccatgttggccaggctggtctcaaactccggacctcaagtgatccacctacctcggcctcccagagtgttgggattacaggcgtgaaccactacatccagcctagcagttgtttgtcattgtatgttttctcagtgaatatctcatggggatccatgaaaatttttagatcctaaaaaggggtccgcataatcaaaaaggttgggaatttctgctctaagccattttgagatgggagagttcacaacttacgtcaaagtatagttattaggcactgcatgtttaagagacaattcatgggccaggtacagtgttcatgcctgtaatcccagccctttgggaggccaagggaggaggattgcttgagctcagcagtttgagaactgcctaggcaacatagcgagacctcgtctctactaaaaataaaaaaaaatcagccaggtgtggtggcatgtgcctgtagtcgcagctacttgggaggctgaggtgggaggatcacttgagcccaggagattgagattgcagtaagccatgattgtgccactgcactcctgggcaacagagcaagaccctgtctcaaaacagaaaaaaaaaaaaagataattcatggagagagagattatcaaggaagattaagctcctcttatatgttaggtatcgtatagtaagtctcccttccattcttatcctctgggcccattagaggctgccgctgtttttttgtttttttgttttgctttttcgagatggagttttgcttttgtcacccaggctggagtgcagtggcacaaacttggctcactgcaacctccgcctcccggctaatttttgtatttttagtagagacagagtttcaccatgttggccaggctggtctcgaactcctgacctcaagtgatacgcctgcctcggcctcccaaagtgctgggattacaggtgtaagccactgcgcccagcctgccacttttaataattcttgcatatgttccaggaatacctatgtggatatatatgtatgtatgtgtgtattttttttaatgtgatatttttaaaatagtgtcttttttttattattactattttttgcgacagagccttgctctgtcgcccaggctgaagtgcagtggcgcagtctctgctcactgcaagctctgcctccctggttcaaacgattttcctgcctcagcctcccgagcagctgggattacaggtgcctaccaccaagtgcggctaattcttatatttctagtagagatggggttttgccatgctggccaggttggtctcacactcctgaccgcaggtgatctgcctgcattggcctcccaaaatgtgattacaggcgtgagccactgtgccaggccaaaataggatctttattttctagaaatatgggtaagaatattgatttgtttgcttttcagttctatgttgtactaaaaatttattgataaatgtattcctaaagagtagaaaattgaaatgcagccaggcacggtggctcacgcctataaacccagcactttgggcggccaaggcaggcagatcacgaaatcaggagttcaagaccagcctggccaacatggtgaaacctggtctctactaaacatacaaaaattagccaggcgcggtagtgggcgcctataatcccagctatttaggaggctgaggcaggagaattgcttgacccctggaggcagaggttacagtgagctgagattgtgccactgtattccagcctgggtgacagagactttgttttggggttgggggcaggggtgggaattaaaatgcaccgttcagatcttatatgcatcgctgacagggaaacttttttcagggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggttagtacattccacagtcctccattttagaggctggaatagagattcttgaggcttggaagagtaaggatccctttatctgtcctctaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcaggtaaaagccacttgctgctgctgctgtctaacatgtattttacacatgtaggccaggtacttcgatttgcctgtatttcatttattacagcattttaagataagtattatgattatccttatcgtacaaatgaggaaagtaggcttagaatatttggtaactcttggtgaggcagctaagatacagacctaggacagtttgtttccagaactcatcttctcttaattattatacttttgcttttcttagtctgaggtgtaaggcgtctgagaagtgaaatacttgcataggttgccttttaggagaaaggagatgtttcaaaggtactgaatggcatgaaatgaagtctttttctcatttctgtgtctgttatatttgagcccagcaggccctgaggttctgtgattcacgcttgctttggggaggcctgttttttataatctctttgggatgatgaggagactacgtaaagttcctattgtccccctgcctccctgacccattttgttcaagaacatctctacttggagaattctgctgacccaagacacttttccttcattttatccagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccggtgaggacattttagaacataagaccaggctgggtatggtggcttacggtggcttacacctggaatcccggcactttgggaggctgaggcaggaggattgcttgaggccaggagttcaagaccagcctggggaacatagtgagaccctgtctccaaaaaaaaaaagaaaaaaaggaaaaaaaaaatagagtgtagactcttgatatcttttagaaagaattctctttgcttttctttttatttatttatttaagacagagtctcgctgtgttgcctaggctggagtgcaatggcatgttctcggctcactgcaacctccacctcttgggttgaagtgattctcctgcttcagcctcctgagtagccaggattacaggcgcgtactatcgcgatcggctaatttttgtatttttagtagaaatgaggtttcgctatgttggccaggctggtcttgaactcctggcctcaagtgatctgcccgtctcgatctcccaaagtgctgggattacaggcctgagccaccgcgcgtagcctccttttgttaatttcctaacagtttcttcattccattttttgtagatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtaggtatcataggattggtggctagctttttcccctttgcatcatcaggtttaggggcatgggacttctgtctcaggaaggtggtgtctgacaaatgtctacttctttttttttgagacagagtctcactcttttgcccaggctggagtgcagtggcgcgattttggctcactgcaaccttcgcctcccaggttcaagtgattctcctgcctcagcctcctgagtagctggggttacaggcgcacaccaccacgcccagctaatttttttttttgtatttttatttatttatttgttttgagatggagtcttgctctgttgcctaagctagatgcagtggcacgatctcggctcactgtaatgtccacctccgggttcaagtgattctcctgcctcagcctcccgagtagctgggagtataggcgtgcactaccacgctgggctaatttttgtatttttagtagagaccgggtttcaccatgttggccaggatggtcttgatctcttgaccttgtgatcctcccaccttggcttcccaaagtgccgggattacaggtgtgagccacagccaccgtgcctggcctttttttttttttttttttttttgtgacagagacttgctctgttgcccaggctggagtgcagtggcacgatcttggctcactacaacctctgcgtccagggctcaaacaattctcctgcctcagcctcctgagtagctgggattacaggctctcaccaccacacctggctaattttttttttttttttttgagacagagtctcactgttgcccaggctggagtgcagtggtgtgatctcggctcactgcaagctctgcctcctgggttcacgccattctcctgcctcagcctcctgaatagctgggactacaggcgcccaccaccgcgactggctagtttttttttttgtatttttagtagagacggtttcaccgtgttagccaggatggtctcgatctcctgacctcgtgatccgcccaccttggcctcccagagtgctgggattacaggcatgagccaccgtgcctggcccacacctaatttttgtatttttcatagagatggggtttcattatgttggccaggctggtctcgaactcctgaccttaagtgatcgacccatcttggcctcccagagtgctgggattacaggcgtgagccactgtgccagccccagctaatttttaaaaaattttttgtagtgatgggtcttgctatattgcccaggctaatcttgaactcctgggctcaagagatcctcctaaagcgctgggattacagatggaagacactgcacctgcccggtcatcattgagcctcctgagtacaggatcattttccacaaaaagtagaagaagacaacgttattatttgaactaatggttaaatatttgaaggcagaaatttattcagttgaattttgatcaagatcttctctaatatatttgaaaggcaagcctcccttatttccttaatcttctagagacagattgcccaatagaactttgtgtaatgattgtacttttgtgtttttgttgttgttgtgtttacatagatatagtttttttttttgtttttttttttttttagatgggtcccactttgtcacccaggctagagtctggagtgcagtagcgtgaccttggctcactgcaacctccgcctccagggctcaagcaatcctcccatctcagcctcctcagtagctaagatcataagcacacatcattacacctggctgattttttttattttttgaaaagacggggggtctcactgtgttttccaggctggtcttgaactcctgggctcaagcagtcttacctctgccacccagagtgctgggcttataagcatgagccactgcatccagccggaattgaacttttaattaattgaaacttaagtgtccacatttggttagtggatatcatattgggcagcatagttttagagagtaagacctacctattacccattttgcctattgtggtttgtttttctccagccagatagatcaaaggatcttcccttagtctgaaatctaacttaaatattggaactcctcaattggagttgcagcacccttcttactattggaggacaatctctagaacattcctttttgtcttgagtcattttagccagaggagaatctcctttcaaacttccaacccagacccctgtgaatggatataatcaagtagatttacaaagcatccctcccttgtccagctgttgctcagaaactcttgggctgagatttttcaatatgttggataatgtaatgtgctaattataatctctcagggattctatgcagggaacaatttgataggaaaaaatttgaatttgattttcttcactgaagtcattttatttttcattttcaagggctttattgctatattaagatggcagacagtggggacaaatttctaaatgctggtgttgacagaaagcagagatagtttatagagaattttattagttaaaagaaaaaaggcattccttatgttgacacttaaacctgtctcttgatagtatctttgagtcccactcacgtatgtctgatctgcagaagtgacttttttggtgtattacaggtatgcccaaccatatacacatgggagcaggacctccacctcagtttaaccggatggaagaaatggtacagaaggggaaaggggtagatgggggagggagctgcctgttacacagcttgttcattgtttaaaccaagataaggtcttttttttttttcttttctttctttctttttttttgagacagagtctcgctctgttgcccaggctagagtgcagtgacgggatcacggctcactgcaagctctgcctcctgggtcccagttcaagcaattctgcctcagcctcccgagtagctggcattacaggcacgtgccatcatgcccagctaatttttgtatttttagtaaagacagggtttcaccatgttggccaggctggtcctgactcctgacctcatgatccacccaccctggcctcccaaagtattgggattacaggcatgagccaccacgcccggccaagataaagtcagtttttccattgattatgcatgtttcttttaatttggatctcctaaatgtaaggtagaaggtttaggttcaaatcttgatatcttttcattatttttcagctcactttgcaaatatccattaaatacctgccatgtaccaagtgtttttcaacacctaaaggaaggtaggacttgatatgagagccctctagaattcttattgtttaggcctctttctttgtctcagggtgtccagggtggtcgagccaaacgctattcatcccagcggcaaagacctgtgccagagccccccgcccctccagtgcatatcagtatcatggagggacattactatgatccacgtgagttttttcttactgttggggtacttttcttggcagggtgaagtgaagtaagataccaggctcctggctcctgaatttctcttctgacctcttatagtggttatcaaacattgtctggttgctgttttcttcgcatggaatattgagaacatcttttaaagggcttggggaacaaggagacttgtccatgtgaagagtaagggtttatgagagtcccaatgtgatatcttacagtgcagttccagggaccaatctatacccatggtgacagccctgccccgctgcctccacagggcatgcttgtgcagccaggaatgaaccttccccacccaggtaagctttgtgtctctgcttatatgcttccagtacctgaggatatatgttgggagtgccacaaaacccatcctcctgagctttgtgctgctagcctgggagtctggccatcctggctgcttgggcaacaagttcctcttgtgtccatcctgaggacttccattctgagcctgattatactgagcagtccagccgggccatcctgtgaaaatgatgttactttatttttcagtttttttcttctccttatccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggtgagatggctaatgatcatgtttttctagatacacattctttaattcagacaggaatgtggtatggggagaatgctaaaggaatttgagagaacattttcagtgccactgatttgtatgtgacaccaagacgcctcttagtggtcaggagctggaaatgcagcttatgtaatgcccatcatctttattcttttcagtttttttctccgttgcccaggcttggagtgcagtggcgtgatctcggttcactgtaacctccacctcttgggttcaagcgattcttctgcctcagcctcccgagtagctgggattacagtgcctgccaccatgcccggctagtttttgtatttctagtagagatggcgtttcaccatgttggccaagctggtctcaaactcctgacctcaaccgatccacctgcctcggcctccgaaagtgctgggattacaggcataagccaccgcacccagcgttcagtttctttaatggtgtttctttcctgtgttgtggtacatcataggtggcaatacctggtttttactctattgcataaagaagctgtattctactccttatcacccctacctctgtcctgcttaacttccaccacgttgacataatcaagtatctgtagtgtcgctactgaactcagccttttccatttgtcagctgatggtaggaattagagaaagctgggcagtactttgaagaaataaaaaccagagcataataatgaagaattaaggcaaaaatgaatagtcactttattttgaagggtgggcagattagatatttttaaaattataaattccccaattctcttatggctgaataatatttcctgttcatcataggttggatgaattcattcctaactttttcttctcctggcttgtggggtcccaggccccatcacaggtatatggaggagtgacctactataaccccgcccagcagcaggtgcagccaaagccctccccaccccggaggactccccagccagtcaccatcaagccccctccacctgaggtatgagagttccttcctatacttaatgcacatgctccgtcagtgggctttccttctccccagaggatttccctcattttctgggtgtgtttctctggaaaacagtctttttgttatgacctgataacaaattccaactttgttatttcaggttgtaagcaggggttccagttaatacaagtttctgaatattttaaatcttaacatcatataaaagtaagtgcacaacttactgtgaatattgttaaaactaatgctcacacttgcttaataaacaaaaatcacttaattaatgctttttttttttttttttttttttttttttttgagacggcgtctcagtctgttatccaggctggagtgcagtggtgcaatctcggctcactgcaacctccatctcctgagttcaagcgattctcttgcctcagcctcctaagtagctaggattacaggcacgcaccaccacacctggctaatttttgtatttttagtgggaatggggtttcaccatattggccaggctggtcttgaactcctgacctcaggtgatccacctgccttggcctcccaaagtgttgggattacaggtgtgagccaccccacccagcctctgattaatgctttaagttataataatcatgggatatctcaggaggcttaaaggagtcctgaaatttgccagtttgtttgtttggcaagtgtattgggcagggttgaagtagaaacgattgttaacatgacagttttcaattgggaagctacaaggaaaaaatacaggaaggcagtcaaggaaaagggaaatctaaatttgagatgttatagcagaaaaaaccagttctaaagatcatagaggagaaggactgggggttttgttgcttttgtttaaggacattacttaaaacacattatttagaagtgtggctttttgaaaacagcttgtgaatgcccagaaggcccactaacactttggtggttcttccctttttccaacccctgtcagagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 36951 - DNA, 38694 bp, Homo sapiens
cccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagaggtgagttggggatgagcggcttggggcgcagggagcgtgggccgggtttgggggttcactggcatgacctgtctttcgcggcccggagtccgcatacctacgcctaggcgcgccccccgagttcgctcacctgcgcgtgtacgcctgggcgcgcttccgagtccgcacacctgcgcgtgcaagcctgggcgccccccaccgccccaagtccgcacacctgcgcgctcacacctgggagcgctccccgagtccgcacacctgctagtgtacacctgggcgctctcctcgagtccgcacacctgcgcgtgcacacctggggagcgctccctgagtccgcacacctgcgcgtgtacacctgggagcgctccccgaatccgtacacctgcgcgtgcacacctgggagcgccctgcgcggcggcatcctcgctaggtggtgctggagcagccttccggggatagcgcgcagccatgcgggggatttaaatgatccctttctcccttgagtttgaatagaagggtgtccttccaggaccggcggcattcccgcagtggccggctggagaccacccaccccgagagctgcggatcccgccggaggggaccccaagtgcggaggtcgggtgtggtccgggcctgcgcttcccgcggcagccactggccgaccttgcggtccacacccactcgcgttcgcgttcacctggaagaggctcggtgttaattaaccttttccagtcacgccttggcagccaggtgccgtgcttgactcctgagaccgcggtgtgtggctggagcaagaacacagaggccaggcagagcagcggacgttctgcgtgggactcgcccctaacagctttggaaggtgtaataggaaacgttggttaacttgaagacattcctttgataagattctttgcattcggttataatttttgccgcacacgctaaggggcgcttttggtgattgtcttagatcctctggaagtgttttactacttttgggggagtctcaatcataaatcttaacgcatgctcacgccccctcccaataatgagaaggtttagtgatgggaattttttacatagtcggggagcaggggacaaaaatagatgcctggtctgagctggatcacagtttatatcagaggactttgtttttgcagaaaatgttaaaatcaaaaggcctgttttaaaaaatgaggctgggccaagcacggtggctcacacatgtaatcccagcactttgggaggctgaggcgggtggatcacttgagtctaggagttcgagaccagcttgaccaacatggcgaaaccccatctctaaccaaaataccaaaattagccaggcctggcggggcacgcctgtagtcccagctactcgggaggctgagacaggagaatcccttaaacctgggaggcagaggttgcagtgagccgaaatcgcaccactttgctccagcctgggggacagagtgagactctgtctctaaataaataaataaaattaaataataaggctggagttgatgtttattggtaaggtatttcactctggagcagtgcccgaagataaagtcatgttaccatttagtaaggaggggtttatgttgggaaatcagagctgacctgtcctctccctcctgcccggctgcagatcttgtcatataacatcaattctcattaactctaaatgtggaattttaagatacagtgtgtgctttgtctatttgtgcttatagaagaagtagcataagagaatattaggatattttatattatgaagcattttcttcttttcttgtcttctcctaaagcgagttttttcaaccctggcactgttgacattttgggccagccgatctttgttgtggcgtctgtcctgggcattgtaggatattgagccacctccctgagttctacccactagatgaccggtaccaccacctcccctatttttttttttttttttttttgagacagagttttgctcttgtggcccaggctggagtgcaatggtgtgatctcgactcactgcaacctctgcctcctgggttcaaccaattctcctgcctcagcctcccaagtagctgggattacaggcgcacaccatcacgcccagctaatttttgtatttttaatagagacagggtttcaacatgttggccaagttggtctcgaactgctgatctcaggtgatccacccaccttagcctcccaaagtgctgggattacaggcgtgagccactgctcccagccctacctcccctatttatagcaacccaaaatgtctccagatattgccagaggtcccctagggcacataatctctccaacttgagaattactaaggttactgtgcatgactttaggggtagattttcagagacgataatagggaagtgaagattattgttaaaatgtactcaaaactatttactttcacatttcattcctgtgagtcaggaaaggagggattgtgcaaaaaattttccgagaaaaactgagagatgagagcaagctcttgagtgggtaaattagctgaaaacaaatttctttattttttcttactcaaagtttttgtggagaatgcatctcaaataaaatgaacaagagggtggctgacccctggaacggctaggaggatggcgtgagtgaggaggctggggtctgggagaaacacaaggagttagtttggttttggtcctgttgactttaagaggttggagggatcttcaggcattgcgagaactgcatgcgtttctgcctccactgtctgccaacatgtggttctgggaacaagcaaggccacttagcctttcactggattgtgtctgacctctgggcacctcccgattcgacctcttatggacgtgtttttccatttgccgtctttattatttgctttgactttctgtgaccatctcttgcttattgcatgtcctggtcattggcttcccagcccccggcaaagcctctgggagcctctctctgggttctatctgagactctagccaggattccttgcaggtgacttcctgtgctcctggggttatatctccaataagctcactcgctcagagctcttcagcacactgccctgccaggtagtttgttatgaggctagtctgtttgtctgaaacgtacttttaaaacagaaatgagtgcagaatgtctctgtctctcttccccgcttgcccgatcctctttcctgtcttctattgttgaaaggctccagaatttcatgaagcctttgtgtgttaactaacaaatattttatctcacctaatttacctaaataggaaagatttatcttctccttctaactctcaaatgaactttcagtcattatgggctagacctttgtttactgtgagatcccccatccgtatggacaggatttctcatggctgagtatttccccttctttcagaatgtcctagatttatgtgcatgtccgtgttcatgttgagaaggtgtgtggtgagatggtggagggatcctgctctgctggcaggtacaagccaagaacacaggttgaagctcacaggtgcagcatgtgctccgacctcctgaaataatggccactaaagctgtttttgttgtttaggcggaggggtagaaacctaagagggaagactggcttattattaatggcagtcgacatagcagcaggtgcttagttactgtctgatacttaaaagattttgagctttattgcctacatattttgaactagatttttttttcaatcctgagttctagtttttgagtttatatttgtgaaattgagtctttgcttgatcatagaactttaagggacagttatttgaaatgaaaacttaggcatttaggaccagggggagaaatgtttgcatttccctttctgtgatttgggcagcagcatctattcagtttttaaaagagctgtggaggggagagagaaaggtatcctgtaattaacaacacttccattagctgttgcttttggttcaagtcagtgggtgtttgattcgtgaaatagatactgtcctggaaaattttataaagcagaatgtctttttgtgaagttgtctcctctccctttacatcataaaaatggaaacttgcttctgtagaacattttctagtgttcctgggattctgatagtcttggacctgagccttaaatgttctttacagcattctgcctcatagaagctattggctcctgactcactttgatttttggagtcttaaaagtgtcctttctagcaggttttattgtagggacttgctctttgttattttccattgaacatggctgcctatgttgcgtagaccagtggttctaaggcttgggaatcgaggaagagagtatgggtgctgaaattcattgcccttaattttgaaaaacatagaacacgtatctttacccttgttaaagctaccatatttagggctaaaatactaaatgcctttgctttttgcaagaaaatttgatagtattctgaatctcatgctactaaaggctgcagttggcaaatatgcctttgatgcatgtaaaatgggaacattattattatttaatatataccgttaggtaaataaaacttagaaattacagagtctgtagaagggaaatataaagttattgttggtagtgttggtggcttaggcatcttgggtaaagtggtagtaaaaccacatcttagaaggccacctggggaatgtgaacccgtgaggcttttgtatatttctatatatatctctatattttttggtaacctgttgctacttttgaaaagaggttccaagaggcaactttgttttgaaacagtaaagaaaacagtaaagaaacagcaaattaacttttgctttttgattatcttaaaggttgatgaaaattgtaaataaggaagggaaaacacatgcaagccggctttggtcaatcaaggaataaataacatgcacaattttactgaatgtgaatgtctggtattctgaaaagtcctcctggtgaagatggctgataagtgcctttgtagttgagtggagtctgaacaaccctgtcccgctgggcattcatgggaaagcactgggctggggttaggaaaactagacctggtcttagacatatcatggaggtgaccttgggcaagtcaggtatttctttcagtcactttccttgttctgaagtgggaactattctgtcactgccatctgcattgggagaaatgatatatgtgagaacactggaaaaaatatgtagagaaggcatttaagtgactatattttgattgaattaaaattttaaaataaattgtttttatgtggaaggtccatttagtaggaacatatctcaggaattatagtgttaactagtaaacaaaatgactcaaaatacaaatattcacatgaaatataattgttcaggaatgtgtgctttgcaagattggaaatcatcccatttcaggagcttttaaacatacaactttattgtgtaaggggaaaataatacatgatcatgttaaggaagtggacagtgtggaaaactgcaaagaagaaactcaaagctgcctggagctctgctccccgaaggtggccagcttgagcagtttgcacactcactactacaacaccttgctcgtggatgtgctttacatccatggaaatgtgctctgcatgctgctctgtaatctccctttttccccactaaactaggtgttgagggaccagtcctgaatttcagtaactcctgttcccaggctgcctccttattgtatagagggatcctaatatacggaatcctctttccttccatgtttttaggttcccacctgcaattacctccttatggtagatctttgtaagtgggattcttgggtgaaaggatgtacacttctacttttttttttttttttttttttgagatggggtcttgctgtgttgcccaggccgtggtgtgatctcagctcactgcagccttgacctcctgggctcaaccagtcctccctctggaatagctgggaccacaggcatgagccaccatgcccagctaatttttgtattttttgtagaaatgtagtctcttgttgcccaggctggtctcgaactcctaggctcaagtgatctgccccctttggcctcccagagtgctgggattacaggcatgagccactctaaattttgatggatgttaccagagcaccctggggtggcacaccagtgtgtgcatttctcggttcttaggagtggaggaacttggttgcgcctcattcacctcccttcctgaatttggctgtgtacttctgttaaaaagggaaatgtatggaataattttttatcccctttagcttataaattctcttaaaagtgaagctgtggcaagtaataccttgtctattctatgaaagaatttcattgtctgaaggctcaaagcatcagaaaagtgaccggaggcagcagctgactacatgggaaactgagtagcaggctcagagccatttctggagtctcaagagtgtcctttctagcaggttttgttgtagggacttgctctttgttattttcctttgaacatggctgcctacattgcatagaccagtgctttccaaggcttggggatagaggaacagagtatgggtgttgaaattcattgcccttaattctgaaaaacagaacattttaatcaagtgtgcttcctttcctattacccttggacctagttttcttgggaacatagtcttgagtgtatatagtaactgggtatctgtgccttttactgagttccaacatggggaccgggagggtgagctgaagattgggtggggacagctccgttcttgctgttgaatagaatctggcctgtgctgcctgttggcttagagctgacggctctgtggatgatggcaagaagttactttcttacatccgtagaattctgtctctagcaggcccatgccaaaatgatggcatctgaaccagcactgacgctggggaggctctggagggggcgagggataagggatgtggacctaagggaagggatggggtgattaacagcctctaggctcagttaagggtcctctctgcctggctggtgggcacgggagcctgtctgaaatggaatcacttgaactcttctgtagttgagggcctggggagtgtcagtttgcagcttgtttctttcactgcctgctattgtttgttcttggcagacctattcattaagctttgtgcagctgtgtccagaattagccaggtcacaaaatatatccagacttctttccctcgtcttcctcagaaagtgttaattaagtaaatgccattcattaatcgtccccaagtaaatgctattctttaatcctcccctccccaacaatccctagtgagctaataagaaaagtgatagcagtggacgttggctgaatgtttatggacattcagtatgtgctagggagtgtgccaagtgctttttgcacataaaaccttctttgcgtttgtgcttttaatctctcttttttttttttttttttttggagatggagtttcactgttgttgcccaggctggagtgcaatggtgcaatctcggctcactgcaaccttccacctcccaagttcaagcgattctcttgcctcagcctcccaagtagctgggattacaggcatgcaccaccaggctgactaattttgtattttcattagagatgaggtttcaccatgttggtcaggttggtctcaaacccctgacctcaagtgatccactcgcctcggcctcccaaagtgctaagattacaggtgtgagccactgcgcccggcctgtgcttttaatcttcaaaacaaccctatggggtcagtggtgattgtgtcctcccttttaaaggtaagacggtatgtcttagggagattttgcagcttgctcagcaagtcccacagacgataaggagcaaagccagggcttcagtccaggctgcgggcgctgcgacccagtgtcttcagtgctgagtctgttgctgaggcttgagatccaaggagtattgatgagaacctagcgtagctttaaaagcaaaagtgcatcccactgatacagagttgctgtcatttgctggagaccttgatcactggagagttctctggaggaaccagggagaaagcaaagggaatttgtgatgcaaatatctgaacaaagccaaaacccttggaaagttaatggacaaaaatatgcctttctttccatctgttgtcagtttactatgttgccttctaggaggtgaaggaaacagccattcctgtttcttgtagaggaatttttaaatagagggagtcggggtggagtcttcacggcctcagtttgtttgtgacccagatgctgctctcacctggcaggggctgaatcatcggtgtggttttggttcggaaagagattgtttgcacgtgtagtgggtatgtgtgaggaggcatgtgttgtttggtgaaaggcatcttaaatgactgccctgggaaggattgtttaaatggaaatccgaggaggttcctgctctgataaatccctcagtgggtcccgctcatctctcgccctccccttccgggtccatatcccctctgcatgtgccacgaggttggttgcagggtggttagaatatctttctcctccaagctgagagcagatgccctggtgtggcctctcttgtatctttgccacctctcatggtggccactgggcagtcagttctcaggatttcattggttccatcaaatgggtggtggttttatgagttttcagcttgagtaataaatgctatttatggcattgaaaagtgtgatttctaggagaagcacacaaaaaaaacttgatcttttggaaacagattgtcctttttctgttcagttcctttcaatggcttcctgttgcatttagaataaaattgtatctctttgccctggtttggaaagctctgaatgatctggtccttacctacctcccccacctcagcaaataacactgtgtcctccctgctaatgcccacacctgatcacattgaccctttctctttgtttctcaaacaagccaaacttgtttttaccttgaaacctttgccctggtttcccctgtgtcaggcttggccctgttcaggtctcagcatggtgtcccatcccgttttgtgcctctgctagcagttagaccctcccggctgtgatatgctgctttttccacgcgatgagggctcctgcctgcccgcctgctgtgcacctggcccatgtccggtgccaggaagtcactcttccggggatggaagaggagagcctggtggaggaacagatacgagcccctgctctgtgactatcttatttttttccccctttttccatacacagtgcatactagtgtgatcccttcttactctgtggcccttgtccggtgccagaaagtaacttcccaggatggaagaggagagcctggtggagaaacagacacaagtccctgctctgtgactatcttattttaccccctttttccacacacggcacatgctagtgtgatctcttcttactctgtaggccttggcctgggattttgtccctgaggattgcacagttagaaactagtgggactgtattgtgaaagtctggattgtgacatagtctcagagcatggaacacaagaatggcatcgagggaggctcccaggcagtcagtagaagggaagaggagaattaaaggtgaggggagcactttggtctgcattttccagtctcttcctgcccagagcccgggcctccacctgtgcctgagatcctgttccccttcccactcacagacattccctaagccacccgatgttccccagtataaaccaggcccctccaggccacaccctgctgggttattctcatcagtgttcctgctgttttctcctttcctgcaaaacacacacacacacacacacaccctcctctcctgcaaaaacacacatattcccttctcccctgaaacacacacatacacacacacacacacacacacacagcctcccttgactcttctgccccctccaggatttcctcatttttctgctcccctgaatagtagaagcctctgaaagggttgttaagcctggtctccaatccacctcctccattcccttttaaaccacacctgttcaccacagcttctcttgccaaggtctcccagggtgccttgtgtcagctctcagttctccaacacagtggctcagcagactctgacatagatgctcaccctcctgggttgccatcctctcctggttccctcctccctccacctcctgtctccttttcccacttctcttctgtccgacctccttattggagggcccccctggggcctgggcttttccgctttggcaggctcacacagtagcatggctttaatgtgctaatgaatcctggattgtcacatcctggccagaaagacctctgtcctgaactggctcttgtatccctgaggctacatcacagttagatgtccagtaggcttctcaccctaacgtgggaaacacacctgctccctctgcatgtccccatctcagcagatggcagttccattctcccagctgctcaggccaaaagcctgggggttgtgctcctctcttctcttgctctcatacccacatccagtccaccaggacattctgtgggcctaactttcataatgtcagaatctcaccaattttttaccatgtctactgctgctcccctggttggagcctccatcttctctcgcgtggtcccctcctgcccccgacagcatattctcaccataatagagtgacattttaaagtcagatggggtcagtccgtatactctgtttaaacccttcaagggctgattacactgccccattttaagacttaggatatggctgcagttgtcaggaaagtgtagttctggcagagggacacatacgtatgtccatgtagcagaatagagaggccagagatagactcgcacaaagatttccacctcattgttgacagagatggaaaagcaagtcgatagaggaaggatagccttttcagcacataattctggaacaactggacatcaataaccaaaaacataaaccttgactgaaacctcacaccttatgccaattaactcagaatggatcatagatctaaatataaaatgtaaaactttttttttttttttttgagacagggtcttactctgtcactcaggctggagtgcaatggcatgatcacggttcactgcagcctccaccacctggactcaggtgattctccaacctcagcctcccaagtagcgaggactacaggtgtgcaccaccatgcctggctaatttccctttttttttttttttgtagagacagggttttgccgtgttgcccagctgccagctggtctcaaacttctgaggctcaagtggtctacctgccttggcctcccaaagtgccaggattacaggcatgagccactgcacctggccgacatgtgaaactttttaaggtgacttaggattaggcaaagaattcttagatgtagtagaaatgtgatccattttcaattctttgcactggaaggttattccccccaaataacatatggttccctgcctcacctcctttgagtactcactcactatcacctcaacactatcacctgaccaccgtatttaagcctggatattaccccagccccctgcactgctgagcccagttatgctgctgagtttttccctgtagcatgtattaccttgtaacatacggtataatgtactcatttattagtttttgcttctctgtgtccttccactagaaatgtatgctctgtgaatgcaggactttttctcttttattcactgataaatccagtttttagaacaatgctggcacatagaaaggactaaatagttatttattgattgaataagaattaaaagtttataaatataaaatactagaaagctgatgtggaatggctgctgggtgacattgaataattttctgataccttattttatttctcctttgtctcacctgcatatttcaacccagtttattatgattaaacatgaaagagaggcctagttatttggcattgagaggaaaaaaaacaaaagagagagatgggcacatgccactgtcaatcctgctttctttccacctctgggctgagcgtaggctattctattatctcttttgttttttatttatttttatttattatttatttatttttgagacggagtctcactctgtcgcccaggctggagtgcagtggcacgatctcaactcactgcaacttctgcctcccgggttcaagcagttctccctgcctcagcttcctgagtagctgggattacaggtggctgacaccatgcctggctaatttttgtattttttagtagagacagagttttgccttgttggccaggctgatctcaaactcctgacctcaggtgatccgcctgccttggcctcccagagtgctggggttataggcgtgagccaccgcgcccggccttgtctcatcttttggccattccagcttaagatagatcgtagttagagtaacagcctctcttaggtcatcactcatctaccactgggcccccagttttggtggcttgcatattcctctgaggacatcgggttgcattgggttacaaagcaggaggtaagctgtggcagctctgggcctggcaggactggtgccacagtgccctcctgctcttgtccctcagaagcaggcctgtccctggtccttccctgtaccccaaggtcatcatgtcagaattggtggcttatgtactcttcagagattagaggaagaattagcacacctgctttattttatccaatgagacaagtgtagtaatggtagaagttgaaatactggtcagggcatagtgaccaaaatttggttaccagtacgttttagaccaaacatttactaattcagttctaaaagtaattaagaagaattttgtttctctttttcaagaagaggaaattctaacagcattctgcaggatgattgccagctcacaggctgtgcataagacctgtctgcccttggcctaactaacctttaagaaccatctcatgtagaaatgtctattatttttatcataggatgtttctgtgaatgtgtgccatttggttctgtgattcaggagaatccagccagttgattaaatccagagataacttttgaagatgaaggagaggtggtgagaagggggtcccttgggtttggtgctggaattggccttcagcaatttacaaaggccaggaactgtgccagggactatacatagtctctgtggcaatataaaatggggatgaggaagaaggaaaagtgaactgatctttctcgaacatctcttacttgccacggagtctgctaattaattcacttaatcctgcagatgggtagctgccagatagactgtgcctgagggactcaggaatcatctggacttagacccctgttagcagatctcagcgaagtggctctcctctcagtacacacagtggtcaggagacttggcgtggagtcaggcggcctgcgttcattccccagggcctcccctaactggctccgtcacctctgtctgtaaagtggggatagtaatggtaatgcctgcctcttgggcttatgagctttagaagggtccacacaagtgctcagaatacttccctatacacagtgagcatttattagatgttacccactgatattcatcattatttgtccctagactttttccctggctgctagagtggaaaggagagaaattgaaggcatttgttcaggctgtgaaatgcagagatcttcggcagaaactccaggtgctctcttccagtctgggctttctgggttaatttctcactggagacccaagccctcacctgagccatataaagttacccctgtatcctccatgacaccgttgtgttctgcctcagggcctctatgtgtctgtgtcccgggcttgggatgcctccccttgctcacctggcgagctcctgctgaaatgttcacacagagtctaagcgttgcctcctgagtgacccctcctgggccttttctctgcctcacactcctgggagagttaatccctccatcttttgtgccatgactcctgcacctgatgctcgccacatttagctatctgtttacatgtcagtttccttactagactctaacttcttgagggtggggccatgactttgccattttggtagcaacagagcatggcttggcattcatcagatgtttgaatgagtttgtgggtcccataggcaagctgggtgactgccagaggggcctctttagtttcatgccatgaccttctaggtgaaatgggaagtaattccatcaaggcttatggggatacagtgagagggtggatatgaagccccgagttggtgccccatgcagatgctggcccctccacagagtccagaatggagcaggacagaagtctgatgaactcaaaccaactttgaggccatcaccctttcccgtcttagaaaaacagcatccagaaatgataggaaatgtttggtcagggcatcttgttatcttattctaaatcttgcatcaattgttcattctccaaactcttttgaattgttttcattttgggcttaactattgcagataagctctttaaattaaaggttgtttttgcctacttgttgtttatggacaatctctgtactccaccttttttggtatgttaagcatttggaatgaaagatcctgtttaaaactccagaatggatggacttcagtcacttagcattgcatttaggtgaaaagggttttttgttatggttgtctttctcgaacttctcttacttgccaaggagtctactaattaattatatgacttaatcctgcagatgggtagctgccaaacagactgtgcctgagggacacgggaatcatctcgacttagacgcctgttaaagtggctctcctcttagtacatacagtggttaggagacctggtgtggagtcaggcggcctgcgttcattcccctgggttcggttcatttttgcttggttaagcaaaccctccgaaggcatgactttgacctgctgcagattgtcatattgtagtgtcgttttgcatacgcttttgactgtttaatagtgacaaccttgtagtcaagtggaaccctgacagaagggtgtgtgtgtgtgtgtgtgtgtgtgtgtgtgtgtgctgaatcttttgtacttcgtaagacccagaaaggcagggcagatgacaaaatttcttgaggtttagaagtctgtgaagttttctcccaaattctcaaaagggaaatttatgaagaaactttatttttaagacatctttttatatttaaagatactttgttcagaaatgtaaaaatggtcactttatttgcatgttcagaaaaaaaggtggggggaactgaactctcaaagtcagaaagcagggttcccgtcccacctccctcgtgagctatcagtgtggcactgggcttcattcctctgcgtcccattttctctgtctgaaaatttaggatgttgagtctctgaaggtcctttgcacctctaagcctctgggatttttcaccttcaccctaccgtttggagtcaagatctccaggtcagttgcctggttttgatgccaggctcacagaggaggtggaggatagtgggctgtgcaggaagctgagggagttaagtattaaggctggagcttgtgttgggtcgagggggagaaatggggttggagacgcctctgggctgggtcagatcccggtgccgcgctggtgttggggtatctggtctgcgcaccgccgggtcctccctggccaccctactgtgtggcgacggctcctccagcatgttcttcaagcctctccttttcagcttcttcatctttatttatctgctctattgatccacatcctaactattctaaaggggctgaggttattttttaatagctcccgcttttccagactctgctgtgttcaggcaacaattcggatgccccttcatgttcctcttgttgcttgctgcatgtcaaaccctgattggtaggaagcttctcgaggctcggactgtgtattcgtgagtttcagatgcttctgcatgtttacacaggtcacttttcttgactaaatgattgatgtagtaattaggattaggctcaggagatcctctaataactggcttaagcgggacaggagtttatttgccctaaagaagtgatctttgccaccagagctgtgtgataactgcatcccgctcccttctcggcctgtcctggggacagcctcatcctggtgctcggaggcggtatctcaactccaggcagcaggatgaaggaagacagggcacagaggatccaccactccagaaggaagacttctggaagattcttccattccatgagccagagtttaaccacatgagatatgtagctgcaaggaggctgggaagtatctgtaacatctttctttgttggccattcccagctcagagttttaagtattagggaggaaaggagaaacagacattggagcaatgaacaattccacccccgtccccctcacctgatttgttcagcgaagggtacctcctgtgctgcacaggtgttgacgctctcttcgagaagttccagaggcatttgatttagctgcagaaattctccaccgtaggtttttgaggagggtacaagaaatggtcaaaacagtacttgaggatgagatcccagcagcaatatatgcaagggacaaaagtggggtaaggattggagtgaggaagaccagctggcggctgcagccagaggccctccctggtttcctttacaggaacggaagcctctgctgtcaattgagccagactattaacctttgactttgagattttataacttgtttctgcaaggccactaaaatgtagcaaatttaggagttaagggcaacgttagacaaaaatattattctgtatcaagcttaagacaatctcatttgacctagttatttgaagaatatagctggcaaagacaattccaaaaatatagtgtatacccatttttactttctgggtagagtatctaaggaactataaaatggccctagaaacaacaggaatgaagaatgggcctggtaattgttttcacccagtgaccagcttctgaataagtaacagttatagactgcaaatttaaacctagagtgactgattttacccacagcattttctttctccttacgattattgccttcacactaagaatttattatttattgaaatcatctgtatcaagtagcatcaaatttattttatcttgccagtttttatagatccacttttagtgtacactcttaagtagaaaatagaattttcttgcagttttaaaaatcctttatactgtggaatctctaataatacatttatttagcatttctctttggcctcattctaaaaagaagtggaaacatcgctcgttgtgtatattttctcatttttggcctcaacatacaaacccatcccaagatcatgtctttattgattgtacttattttacagctgactgtgacatattcgcactattgtgctattataaatcaccttctgctattttactctgctattcattttttcttgtatgggaaagtggactccttattttcatttcagccacgtgtgcactctctcgctgttacttattactgaagtagggagcatttgggaactggagaatggcgtgcaaatgaagaaggccttctagggattggctgtgccatgtgaacagtcctgggcgtgccatccatggagcatgccaatattgcccagaagttttgggtcagcttcttttttgtgtgaccttggtggaaaccactgagctccatggtattaagtgggccacgtgtcttctcagcgaggttcttatgtaggtatgaaggaaggaagcctgttgtgatccccgggggagctgtgagtgtagagctggctctgaaagccttggcatctctcctgcaggaagaatcccaggagcaggtgaatcccacctgcattgagcattttttcagtttaaagcaaatccttactgctagagtatatttagaaagaggcagggccagggccgtggctaggccagcttcgtaggtgatgagctctgtgttggccatcagccttaagtgtgttgatttttcacagcaggtcactcagcagtgtttatctgaaaatactggcttggtgctattaattaaggatgaaatgaaaagcttgtttctgtgttagcattgtctaaaggactgtaaatagtgcttaattcattatggatatttggtgcccagtgaagaataatttaccaagtttgtaagaacagtattttcttcctttttaaactcttttatttcttaggaaaccagggctgtacctcttagatcattgaatagtgcagaggtgcaggaagtgccgtttattgggatgactggtgttgggcagaggggtgaccttaccctccagtcagtcactcagcacacaggggcttcttcccttgactgtcttcctagcaaagatgacctcgtctttccttgaagatattgataccattcagctaacacttcattttctgccatatttgtgttcctttcatttttgtgtgtacgtatttggtggaccgttgaccttgataaatcctcagctttacaagtacaattacaactgtgtttctcacattacatgaagtgtaactgaaaaggttcagacaacagatttttaatgatagtaaaaacaaggactaaagccataaaacactcttgttttgttttgttttgtttttgcaatggagtctcgcttttgtcgcccaggctggagtgcagtggcgtgatctcagctcactgcaacctctgcctcccgggttcaagcaattctcctgcctcagcctcccaagtagctgaggatacaggcgcccaccactacacctggctaatatttttgtatttttagtagagacgggggtttcaccatgttggccaggctggtcttgaactcctgacctcaggtgatctgcccacctcggcctcccaaagtactgggattacaggcgtgaggcactgtgcccggccgccataaaactcttaatttatattaaattagtgtaaataagagaaactctgcttgcaagtgttctttgccttgtcattatccagacaggaacttcttcactttacctcttgttagaaataccagaattgttagaaatagataattggtaccacgaggaaccgtcagcgtggagacaaaagatctctcagcaaagcaatctttactttctgcagaaagggtgctcaatggcagatggaacaatgacgagagcacacctgaacaaaggaaaagcagacatatttatcccttacacatttgggtcgtccttactgctgtgtcctgcatccattggctggagcaggaccacacactcttaaactgatacccagtttgctaatcgcctaaaactttcctaaataggtaagtgcaaagaagaacaaaaaagttgcttaggaaaggtttaaggaagcaataacaattccaaatgagaaaggggcataggctgtgagctggaacgtgtctgtgagcatgtccaacagttacataggatagggcttagcaaagagttattagcacaaagcaaggaggcttgaagaaagttagtctttaaaataatcttttatttctaacacttatgatttattctttaacaagaaggggagctttaaagaggaaactttttactttctacatctctttatgccttagggttggcaagatggtgaaacaggtcaggcttgatcctaaaacctgccacagagtcataggagactcatttggtccttggccatcttcagcttttatgttggcctctccttgcatgagtcagttgacagtagcgtattatgccagagtagttttgtttgtggcaaactcttgttctggagatagtttgcacacaaggtaactacagttaatgttaatgtattgtgtagttgaagattgctgggaaaatacatcttaagtgatctcaccgcacacacagacacacacacacacacacacacacgataagtacatgaggtgatggatatggtgattagcttgattgaatcatttcacaatgtatatgtgtatcaaagcatcacactggattccttacagataaacaatttttatttcttaagtataccttgattaatctggggaacatttttaaaaattaaaaaagataaggtgagaatcatcaaactgcactgtgggatgagggctggagagtcagagaggtacccgtggtagctatggggctcgttcattcctgccctcagggaaagtcactcaaatccacacttcagtgatatctcagctgctgtgagtttaggacccattgggtcatctgtagacagtcagaactacgaggctgtctcagggaaggccagaagtctcttctgtgctatttctttatccccaaatgaactgtatgcttcttcaagattggatcacattgatttctcatgtacttttttctgtcccacacaatgccttgcacatagtagacagtaaaatattttgatgaactgaatcagacagcagttaagtacaaaatcatgtgatctgaatgggaagaactgttagagctccggaaaagtagagtgctatgaactggaggagttggaatgagagggaaagttcccatcagccactgaactggttatatataatagttacaaaaccaatgtgtaagaatgatctgtgcttatctcatttatttatctaatgaatacttatgggtattgaactaagagttagagaaacagtgatgaacgagacagatccatgaatcttagaaacaaattgatatgaaatgtcgctgtcactaggtgtgctccagggagtcctctaggacctccctcgataccaaaccccgaaggtgctcaagtccctgatgtagaaggatgtagtatttgcatataacctatatgcatcctcctgaatattttaaatctagattacttataatacctaatgtaaatgttagataagcagttatactgtatagtttagaaaatattgacaagaaaagaagcctgctcatgttcagtacagaagcagttttttttcctggatattttccatccatggttggttgaatctatgggtaaggaacccatggatatgagagctgacaataattgtaggtagtgacaagtactgagagggaaatacagcagtaaaggataaaggcaatagtgtggggacacaggcagcctgctttcattaattatttaacttaatgaatgatggggtcttgctctgttgcctaggctggagtgcactgatgcagtcatagctcactgcgacattgaacttcttgcctcaagcaatccgcccacattggtctcccaaagtgttgggattacaggcgtcagccaccacacccaggcaggctgctttagatggggaaatcaggggagggctctgaggtgttaacgtttgagcagagcataagtgaggtgatggatgaaatcttgtaaaggtctgggacaccagcatcccaagcagaaggcagatgttgggttctgagatggggaccgagtgtggccagcttgagggcctgccagaggctgtgcggccatgaccatgagcaagggccttgtaggacatggcaaatactggatgtttgttaacagcagtgggaacgtgttactgttagaatatcactgaaggcatctgtttcatctctgaaactcccctactttatcttctacctctgcatcaccattactgccacccctctagactacgcaagcatgatcctttcccagggtaccataatcagcttctaaaagtcttcatggcatggcgatctcaggggaactgatgctagggaggatgggagaccagctcagtgacaattgctgttgtccctgggtggtagcaggggaagtggtgagaggtggttagattctcagtctgttttgaaggttgccaactggattggctgatggaatagatgaagaaagaaagaggaataaaacttgactcctaggcttttggctgcagcaactgggtgtgtggtggcagcatttcccatgaatgaaagactggaaggagtgtattttgggggggaaagtgagacatgccatttggtcctgttacgctggagtgtgcattagctatggagtggaagtactgagtagctgctgtgtgtgggagggacctggggctcttccactgctttccttggctgacagatgattctctaagtggggagacttgataagatcatcaggagagccaacgcagatggaggaggggtgaggaccagggactgagccccagggtgctcctgtgtttagacacgtagacgatcaggagactgtggtggccgagaaggttggatgaacacaagcgcagcctgttcccctggaagtcaaataaagaaggcaattcaaggagaagagaaccactgtgcaaaattctgctgcgaacttttatgtgtgagctgtataaagccatggagcgacaggagctgggagccgacattactgtttacaatgcaggggtgtactgtgtcttcctgaaagtcacttagtattgggtaggggtgtggcagttaatgtcttctgaatttagactgtgccgaccttcaatcttttaaagcatatttcctgtttattttcccatagctaacctttatagatgcaaaaagcaaaagccatttccagttattgtattggtattccctgggttgtatctggggattctcatatgctgtcgagaacaaggtatatttgggtaacttacaaagtggagatttcgcaaaagcctgtgggaggcattaggagctacaagatatgtgggcacgatgagtgagttccagtaagtggtttagccctaaacctggtctctctgcctgacacctgttctcagcatttggccccatcttccattcagttgtgcaaaccaaacattggctccagtggcacttcctgtctctcccaccatccttaccgtccggaagccctctcgtccactctgcctcacaccatgcacacccttgcacctgcagctgcccccaccctaccctctggagtggctgcagagaacagccttccctcaccctctcttgcccttttgtctgctgtccactctgaagcctgggttatattttaaaattaaatctgatcgcgttacctcccccacttagatccttaccatggcctctctcattgctcacaggacaaagatcagaatccttggagaggcgcaaaagcagcacacggcctggccctttctcctaccctggggccctgtgaggccttctctcccaggtcctgaattcgctgttccccgcccctgcaacaccttccccagacacctcttggcccttgttgactgcagctcccaccttgtggtacagctcagcagggcccgtcctgacccctttgtgtgggtgacattcctgtgtcatattcttcatggcactaaactctttcacctgaggacatttcctttcacttgcagtggcatggtcatagttattcatgtttcatctctccggctgtgaactccccgaggcgggagccgtcgctatcttggctccgactgtggctgccacgtggagacgttcatgtgtgtttgttgggtgaattaactcaagtgcataataacaaaaacaaatggaaatcttcctctggaaagacggaagaccgttagggtcagctcacgtggaaacagctttgcatctccatgcccatccccacttctgggtcctccttactgacccgcgacatcctctccccacctttctccctctctctgggcactacagctggtcacttcccacacatggtcgcatgagtagaggcttagcaaggagtgcgttatggaggacagatttctgctactgacttcgccgaagtggatccacagcttccatttggctcaggctctttgggagaatttcacttcttttgttacctctaatcttacctatgtgtaaccacacattttggtctttttcttaaatcttttagataatcatcagataagtttacttacctgttattctactactttctgccttgccttttcttcaggccacccccaagtgctataacctgcccaaaggttaggacataacaccgctgccacacgtttatctctgggcataaccacgatggcataaacaccagcattcccaatttttctttgtctcttcggaatgctgacaggcaaagaagagcattttctttagtctccaaatgtgtggctcacgcctgtaatcccaacactttgtgaggccgaggcaggtggattacctgaggtcaggagttcaagaccagcctgaccaatctggtgaaatcccgtctctactaaaaatacaaaaattagccgggtgtggtggcaggagcctgtagtcccagctactccagaggctgagacaggagaattgcttgaacctgggaggcggaggttgcagtgagctgaaattgcgtcactgcactccagcctgggtgacacagcgagactccgtctcaaaaaaaaaaaaagtgatgtgtgcttattaaaattgctgcatgtatttactaacaagagtgagaagattgacaagtttcaaaacatgatttagattcagtttacttggccaagtgtctctctctctctctccgtaatacatatatttcaaggaaaatattagatattacaaaaagccaccctcatcttttactgtcttatcaagatgagttattttttccaaaatatcaatttttaggatttgattttcctaccaattattaagatagacctttaggatggagtgaaaatattttagtatcagttagtttattctaagctatgttttttttttttttagttttttaaatctttaaaattttacatgagttatcagtgaaaccaatataatccaagatgtttctctctctctcttttttttttttgttagaaaattgccccacaaatggtttaggcaaggtaaaaaccagaggtcgataggtagattcatacatacctatcccttgttgctgttcttggtcaaaaattaaggtgaggagttgccctgttgtacttctgtttcagattaagactgtggaattaccccatgaaattgaatgtgtattttctccattttagcactgtaaagatcagaattctgtatctaaaaacttgtctaagtctgcaattctttataaagggccaagtccatgtttttaacctcactcgaagtcgtcctttgaacatcggctgtccctggcaaataatgattgactctgggcgatttgtctccactgacatatccttaacaggaatcaaaagttacggcagctcctgagttcagcggtccctacgcgagtaacagcagtctgtgagtttacatagttgtgggtcctggctgagtcattttatatctcaccatgtggcttctctctactcagtaggtgagtggaagtgtccaaccttaagcagacttttctggaatcaacaaaaccatgtttttattgctgcagccttggcgaggaatccagaagtttcgggttggctttgaggtagccattctgttgtctgcacatctaacgtgcattcccatgcctgtttaaggtggacttttaataatctaaatggccccagtagaagacatttcagtaaattggggaatgcctatacaatgtaacagcatgtagccatgtcaaagtcccgttgaggaagaatacttagtgactgacatggtttgcacctgttccctccaaacctcatgttgaaatgtggcctccagggttggaggtgggcctagcaggaatgtttaggtcatgggggcagatcccttatgaatggctttgtgtcgtcctcacagtagtgagtgacttctcactttgttagttcaggcagagttggttgtttaaagagcctgggaccacctcctctctcgccatgagatgtgtgggctcccccgggccttccactgtgcgtaaaagcttcccgaggcctcaccagaggccgagcagatgatggtgccgtgcttgtacaggctgcagaactgagagccaaagtaacccctgttttctttgtaaatgatccagtctcaggtatttcttcatagcagtacaaaacagactaacatagagacactggaaagtgtttaataaaaatgctgggtaatagttactgagcataaacgatgtgccagacacatatgttcatagatttcatcctcaaaaactacatgcgtgttttcccaagttcacagagtgagtggtaaccactaggcacctctgcctctgtaccatgtatcacctcctttttattttctaaaacaatgcataggataaccatcacagtttctatccaacattacatacacatacgtgtgtgtgtatgtctggctctctggaggcaagatgatgggtgattttaatttttttctttgtgcttcccagtttttctgcagcatagatggataaatgttataaaaagaaaaaaaaagagtggatgtccttagcactaggtatgtttagaccaagtaggaagagaaacagtttcaaatcagaataatgatccaccttcctacaatgtgatgtgccctgatgtcttcattactgggagaaattaaggactgaccacagtcgactctgcaagggagaccggtttttgtgcagttgttggacacttgcaggtgacttgctcaaggtcaggatgaatctaaaataacattcaagctcagttaaagaagtttttttttttcctacaaaagtacgtatttaggatgctttgcccaagctccgctttcttttttattactctgagagctgcttcccttgcctgagaatccccagacctccttacctctgtcctgtgactaatccccacttgtcaatcatcttggagaaaaaatttccctccctgcatcatgaccatccttgtttcacatattaaagcagctgaaagcactaaaactcttttattccacaagaggctcttcccgcctctccccagtgtggagttgaacccctgcctccgtgcctccattgtgtcctggcagcactgtgtcctggtggcagcatcttcagcaagttacttgttttgttttgtttttacctaccagaaagtgagttctgcaaaggcagggactcatctatctgacagtctgtgctgcccgtgcattgccggcacgcagggtgctttccagagggaagtgacacacgtgcctcttgtgaatcgtcatcttaggcatgccagctcttgaggccacacttagactaagatgtcagagaagtcagtctcaggtgcaggagtcaagaaaaaatagattgggtagagaataagagcaattttgagagcctgatggaaaaaccaagcagacattaccaaaggatgaaggacacgagcctcatgcttttactaagctgtatgagtgacatggggaagcaacttatgttgttagtgaaaggttctttctttctcgctctcttttttttttttttttgagacagagtctcactttgttgcctaggctggagtgcagtggcgcaatctcagctcactgcaacctcggcctcctggattcaagcgattctcaagactcagcctcctgaatagctgggactacaggtgcccgccaccacggctggctaatttttgtattttttgtagagatggggtttcgccatgtaggccaggttggtctcgaactcctgaactcaagtgatctgcctaggattacaggcgtgagctaccgtgcccggccgggaaaggttgtttttaaatttttttttacttttatctttttgagggtctccctctgttacccaggctggagtgcagtggtgcagtcactgctcactgaagcctcagccccttgagcttgtgccatcctcccacctcagcctctcatgtatctgggactgcaggggcatgccaccgtgcccagctaattttttaaaattgtattttatagttatggggtctcacaatgttgcccaggttggctttgaacttgggcccaagtgattctgctgcctaggcctattgtacttgcatgatggaaatggaatataaaggcctgtgttgttttaatccacatttatggacaagttagtctcctgttgtcatctgtgtcttctgaaggagtcacctgtttggttaaataaattctggccgttttctcttaattcatttgcctgaaaaaaaaatttttattctacctctcctttgaacagcatcctggtggggaagaagttttaagggaacaagctggaggtgacgctactgagaactttgaggatgtcgggcactctacagatgccagggaaatgtccaaaacattcatcattggggagctccatccagtaagtacattttgggggccctttcttatttgtatttaaggctatcagatgaccttaccctagtctgtaagcttgcatgtatacacattttaaaaggagtaaagcaaaaacaactcctgattttaggacaccattttttgttataaataaattgaccaaaaatgtctttgcatttcactgttgcttttttttttttttttttgagacaggtcttactctgtcacccaggctggagtgcagtggcacgatcatggctccctgcagcctcaacctcctgggctcaagccatcctcctgcctcagcctcttggtagctgggactacaggcacacacctccacgcctgataaatttcatagtttttgtagagacggggtttcaccgtgttgcccaggctggtctcaaactcctggactcaagcgatccacccacctcggcctctcaaagtgttgggattacaggcgtgagcccccacacctggcctggttgcattgtttactggcacttcgttttagtcagcaggctccaccccacagccatgcactggggagtctgctcagtcctagaaattccatggggcagcacgttttacaaggtggggagaatcaacccagcattgctttctttccttttctgaccaaaatatttttattaagaaccccacttctactttcattaggccaaggatattttagttctaaaaaatgatttaaaaaatataaaaacggagctatgtgaaatgaataagctctgccttctgtagaactagcacattgtccatattctactcactgtaccccagaccttcgagaatatcagctctggaccaattcattgaccaacttttggaaaacactggcctaatttggcttttcttttctttttttttttttttgagacagagtcttgctctgttgcccaggctggagtgcagtggcgcgatctcggcccactgcaacctccacctcctgggttcaagcaattctcctgccttagcctcccaagtatctgggattacaggcacaggccaccatgcctggccaattgttttgtatttttagtagagatggggtttcgccatgttggccaggttggccttgtactcctgacctcaggtaatccacctacctaggcctcccagagtgctaggattacaggtgtgagtcaccgcacctagtcctaatttggcttttctataaacactgtgctgtgttacggttttagacccctctgtggcagttgtaaatgaccatgttaaatgttactagtctgtcaacctaagttatcaggaaaatcgctgaaaacttggaaagaagttgccgagcgctctgagcttctggagtggatcctggggccgcacactcagctgccctgtccacctctgggagtgcctggctccgtcctgccttcccacttgtggtgcatggttagcagcccgccagaaggggacaaagacctgctaggagcccgctctgctctcgtaagaaaaaaatggagaggcaaatagcctcattctaagtgagcaaactgagaaactcttaaagaatataggaaaagtcttatcgtataccactgatgatccctgtaatgactgtgaatgaagaagaggttacattaggttctttgtagaaggctcgaaagtaggaaatccatttgagaacaacttcattgagttgggaggtttgtttgattttgtttttggtggtaggagatatgtactttgagggagtaagcttcattcatctgacaagtttatttgccccgatattttcatcccatacttcacaaaggcaaagtgtcttagggtcatcagggaggcctgccgttacacatgcctgatcccatccttgtttccagctgtgggtcaggtttcaggccctgactgtggcacttctgcttcacctgcccactgggcttccccctggccagcctttaaacacactgtatttttgacagcttcagcctgaagttgaaatagtttatgactctaaaactgggagactgcagggcttaactgaagatatcatacacgtaagagatacatgcacaatctcaaatggaatttgagaggacagaagggaagaatcagtcttcagctcctccctgaattacgtgtcgcaatctgagtctaataaatgtgtgtgcacatcagcatgtacagagagctgtcatgggtgctgttcgaaactttggaactctagatagaaaatatctcttggcacttaatctgctactaatttttgctgttaaatcagatggatcaaactttgtgtttaatagctaaatgttgaatctgaaatggtaattactgaattataattttaaaaagtctcaaagtcagcattttggaagtggtactttcatagatttttaaattccataatgtgccttatcttttcattgcaggatgacagaccaaagttaaacaagcctccggtaagtgtgaccatctcaagtatctctggatgttctcgttgtatttaatacttgtcaaactgaaggcagagggtttttatttacctgactgatgccagcacaggtctttctagataaatgaatatgtaacctactggctcagcaagtattttttatttacggaaacctgtcagtatgatttgttaggatggcgtgtgtgtaatttttttaaggctgtcagtaaactacttttttcatcataattatcaatatataccatttgaagagctactttttatggtagcacgtgcttctgatctaaaagatttgacacaagccttattttcagagaacttaaaatctgaatggatagtggttttattacttaaatctttaagggtgtgtctcatgtcttcttcatctttaagtctcttgggcatagtaggtgttcaataaatacttgtcagatgaatttaatgaaattaaataatacccttttgacttacttttccttgggaaaggaaaataactctggcaatactagttttatgttctgattcactagcctttctctctgaactgaccatctcacttatatttgaagataaatgtagggtgagaatggaagagcacagcctaagttcctgaaaagtacaagtaggcaaaatagtttctagtgtctaattaaaggactacaggggaaagttttgcttaaatcaaatgacaaaaaagaaagtataatttttcgttttggtgtaaattcttggtttcattagagaaagtgcaacagcaagaccccactgagcttgtgtcgagaactggtgagctgattttttgagctgttgctgccaagacatcatctttaatctacaaaaggatcaaagcagttaatccaataatataagcataaaggccacatttacctcaacatccctgatagtacaataaaagtcttgtgtaatactatttagtacaaagcaattttttttatattctctccttattcaagaaagacttaagttcaatgtgaatgatatgagtacttccaggagataaaaagttgacttcagaatttcaatggcctctgtgacaattgcttagaatccttgctgtgagttcatttgactttagcatcttttttgaggctactttttggacagctgaaattctgtgttgcataaagtttttcctttttctctgaagtctcttaagggaagaatatatattttttttatcatgtgttcagcatgttaatcattttggtataagtcatttagctatagcaaaacaaaggtttaagattcattagatgaacttagatgaccgcagggccagccgtctcgctaaccataaagactacaagcagaaaacacttgtaggtgtaagattgtacatgtgtctcctgccataactactttcagtttaaaggacaaagactttcttccttatttgcttttagaacacgtgtattacagcctatactctgttggattaattgcccattactatttattgttcttattttctattttaaagtggcagttactttgatactgagaatattttgggaacagagcaagtttatgtggtaaattctgggactttagcttttagtatcaaagaaagctttcctgacaacattgaggcacagccctttgtgcgttaagacatggcttacttcattccagcattagcagttgatacttgatcagcttgttagatgtagaaggtctcactgaagtttgagaatcacactaactttttaaagtagatttttgtttgtttgtttttgagacggaattttgctcttgtcacccaggctggagtgcaatggcgtgatctcggctcactgcaacatccacctgctgggttcaagcaattctcctgcctcagcctcccgagtagctgggattacaggtgcctgccaccatgcccagctaatttttgtatttttagtagagatggggtttcaccattgttggccaggcttgtcttgaactcctgacctcaggcattcgcctgcttcagcctcccaaaatgccgagattacaggtgtgagccacggcacccagcctaaagtagatgtttttactctcttcagagattttacagattaactaacttctgagtattttttaaacaactcttctttattgtgactttgcttcagtgagagcagaaccggaagaatgtgggacaagaacttgctggcctttttgagaggccataagcagatgaaatgaaaggaaatacatgagcatttttctggatgtatctttcttgtgcttttggtttagtggaagtaaagagtgtccttagggatttcttttgtcatgtgtctgtataaccatcggccgatctccaggttgaagaatgtacactgtggtctaaagttttgagatgttgcctgcttaaaatatctagttgaatagtgaaataaaatgcagtaaagattattagcttgaacctgccctaaggaaagcatagtgttaagttaccaaattaagatatttgtagacttagaaatcatgcattttaatctaacataaatgtttctatcacatttgcttacatagagaatattagtcgtagcaataccccttcttggttatagttttgaaagcattcttgtagaagttatttggtcctcacagtgtctccatgttagacctgccaagggaggtaggtacattgcagctgggaagtgttaagcacccggctcacagacgtgctccagaaccatctagcacccatctcaggctggtcagttgcagtcccttaagcttctcctctaggttctgggcttgccgtgttagacatcactctgtcagtattttaagggagataggcttcccactaaagtttacgttagatgaacttataaatgagatgactctgattcacaaaagcttgttgggctttgcatgcttttcataatttatggagcttactgtaatttacactgattcacatgacttttataagtcattatgcatgacatacttattttacttttttgagacggggtctcactctgttgcccaggctgcaatgcagcggcatggatctggactcactgcaccatccacctcccggggtcaagcaatcctcccacctcagcctcccgagtagctggaccataggcacacagcactgtgcccagctaatttttgtatttttctgtagagacagggtttcaccatgttgcccagactggtctcgaactgctggactcaagcaacccgccaatctcggcctcccaaagtgctgggattacaggcctgagccaccatgcccagactttgacacactgatttaattgttaacctctttttactgaagttgaacctcgaagtcatggagtgaacaggtggcagagccaatcataaaaaccatattctttctccttgttcattgctgacattctttgatagtcacgtccctaaacccaagtgaggccctcagagcactgaccactaaagaccaattacttttccatcaaagtgcaaagtggtaattcaaacttcctttaactgtcaagcatcctgggctacagagccaagaagataatcaacaatcaaaaggtgatacgattatttcaagttcccctctttagagttcatggctgttgctgatgatgctggtgccagagtagtgttttaaccttagcgctctcccatggtaaccacaaaggcagcaggagggcaggtgggaggttccagagttgtcagcacgttggtgaaatgcctgccctcattttaacgacgccgtggatgtttgtgtttgccttccgttggctgtttcaaacttaactttctagtttgacaatcatattttaccttcagtgattcttttgtttcagaactgattgtgtcctctaatagctaactaatatttttgtatattttgattatttctagtaatttttgttaattttattcatatatacacaatttggaaaatcctcttgctgtagttatgaatactttttatagatgctaagattttaaaattgctggaatagataataaatttgcaattttatttttaaatgacttaccttttttcccctactgtgtcaggaaccttaaaggcggtgtttcaaggttggtgggtctcataactgctttgcttgcttttccctgaaaggggtctgtcttttcacgggagtttctctaacgtgctttgcagagtgatgcttgccttactgcaggccgctgattgttttgctaatgctttttatctttgctttgggaaactgcagatctgaagctgtcttatttatggcaacttctgtttgaggccctaatgcttatgttggtgtggaacatcaaaagaatgcttcttaacccattttcaagccccaaaaagttgatatttcactagaccttagcttttcagctgttggagaagtatgcgtttttccagaaccattgtccattcactttagtgctactcaaaagagctgctcccagaaagctctggaggataaaaacagggcttccttatctggggatttgctgttaggctgacagtgaccagctggtgacaagtgtgacgccgggcacagcagtcctgtgaggctggtctggtgtcttgctggttccgtctggtcagaattaaagcagccccccgggaaagttggcctagaatgtagaacttaaaatggcagtcctcttttttctttttggttcacatatatttaatgtaatttaggtacacttttttacatctgtcagatttgaatgaaataactgatgtttttattgaacattgtgttcatgcttttgaagaattaaactgctttttctaaaggtgacgtgggattgtgtgtatgtgaacatgaatgtctgttttcagtttctgcattatttagatgcctagcgtgtgcaagatattttatgtagcatattaattttgaatgtttttaaattattgaggttatgtccttaagtaaatataatgattaaaatgttttactctggaagaaaacaaagttaggcattttagtgaaaagaagtttataattttccctttcgacatcttctgaagaatgcattgcataaaatattgtgttcttattttcaaacaggattttagtcaatgaaataagttcagcattcccttgaacttactttactttttcctctcgtgtttcaggaaactcttatcactactattgattctagttccaggtatgtggtagctttcttttaaagcagtagtgggtgggagggctcatgggtccaggttggacaaggtgcgtcccccaccttctgggttcctgggcctgacactgtgctgtctcagcaaccttctgctgaaggccagactgttcagagcactcagcctcaaactttcaggtagccgactgtgaacactgtccacagccacgtgatctagctggctggctgcatccaccccaaggaacaaacagaacaattgcatttccttttcccccagggcagcatcttaggcggccagtcccacagcacctccctggctcatccaagcagacatttccttcctttcaatccatgtctgtttcttaaactctagtgattacatttccctaaacatgggtcagttttcctttgtcatttttattagctttaaagttgaagctggtaatctatgtgtagcacgactcaattgttctaggcaccagatttgtttatgatagtccaagtgcacattaacatctttggcagctctaccatattgacttcagtagtagccacttttttggacccaagctcaaaaccacacatttgtatttcatcctgtcaaatttaactgcctcagtccgttggtgttctggaatattccctgcctgcaggcagtatttcaccttactcttcattaacaagccagtttctttctaaagtgaaattgaaaaaccccaccaaaccccactaagacaaaagttacacttgtaattcttatgaaagtttcacttgtaatccttatgaaaggattatacttgtagtccctatgaaacacatatgtataccaagtctatttctaaagcctacacattaatttccatttttctaagaaattaagtcaaagatcaaaatctaaagattcaaatctaatttaaagattcaaatagaggccaggcgcggtggctcacgcctgtaatcccagcactttgggaggccgaggcaggtggatcacgaggtcaggagatcgagaccatcctggctaacacagtgaaaccctgtctctactaaaaatacaaaaaaattagccgggcatggtggcgggcgcctgtagttccagctactcgggaggctgaggcaggagaatggtgtgaacccaggaggcggagcttgcagtgagccaagatcgtgccactgcactccagcctgagcaacagagcaagactctgtatcaaaaaaaaaaaaaagattcaaatagaaattatagctcatccctcctttgtccctgatttgatttgtaatctgtaatttatagatcgaaattctatgcatcaggactgtaaatttaggcttttttttttttttttttggtgaatttagacctgtggaccacacaccaagtagtctggccattctgtttcttaaccctttaaatccacttcagcacaggtagtaaagattagattttccaaacctaagcttaaagctgtggtgttaatggcagtgttaatcatcacagggcccatactcttcaactttacagctggtggggcattcattttttggtttgtttatttttgttagtttgtttttgagacagtctcgctctatcacacaggctggagtgcagtggcgtgatctcggctcactgcaacctctgcctcccaggttcaagcgattctcctgccccagcctcccaagtagctgggattacaattagctactgccaccacgcccagctactttttgtattttttggtagaaggtttttactatgttggccaggctggtctcaaacttctgacctcaagtgatccgtctgccttggcctcccaaagtgctgggattacaggcgtgagccactgagcccagccaagtggggcatgagttttctcataaagccagcagggcagagtgattcctagtatagcagggcatgtgttacactcatgtcacttttagcaaatccacgttgccttttcagcaaaattcattacagagttaagaaaaacatgccctggtaattttctgttagaaggagcaaagattttgagtccaccacagtgcacatcatgtcagcatcattgctttttgtgtctttctagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgc

SEQ ID NO: 36952 - DNA, 28848 bp, Homo sapiens
cggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccgggggcgagggcacgggcgctgcggggatagggtcgtcccatggggcaggggcacaggtgcggggtgggcgcgcggggagctgagagacagggcggagggcaccccccggtatagagagaagaccctggccccggccctcccacccatcgacaagggccatgggcactgcctgcacacccctctggggacagcgagcactccctgggtgccccggggagtccaggccttagggtttgcgagccctccagctgccgcctccccatgcacattcccacctcccgcctcggctcaccgttccctttccttccatcgggcaaccctagcccacactcgggaggacagaaccagtgcctgtcactgattcctgggggcatctccccgcccccaacaaaacaagtggcttcccagcttcacagcccctccgcgggctgggagagggctgaagacaggtccccaaccactgcccgcgtctgcgggctctggggccgaggggagctggcgcgggaggccctcttcgtgcatgtgctcagcagctgggttcaggcccgggggccaggacaggcagggcccagcctcagaaacctaaaaaggcactgagcgagcgcggggagacttaacccctgtctgtcctcctcctgcttcagcctgcggtggagggggcttccgcaagtccaggccctgccccagcccaccccctaccgcgggattggctgcagctaacggtctgggctgcggggagggagggaaaggcctgtggaagggaggaagtctttgagtgtaaccagatttggaaggtgtgtagtgcagggtgggggcggggaggcactctagtcttgggagcagagacgccaagggtgggcttggagtggcaggaggctgtcctgccctcagagtcctgcagtcatccctgaggctgggggcctggggaagatccccccgcccacccctgtggagagctcttaagaaccctgctgggatttgcaggacgaggtccttggacggtgcaccccacggccccaggaggggagtttcatgtggggccaggtgggccccacacaggatgttccctgagatttctccagatgacttgatgtctgtcagccccactctcccttggggccatctctaggcctcctgatatagcagctgaggtcagcccagggccctttgccccgtccagtcccctccctagcccttaccccctcctgccccaatactgcccccccaccccacccgcctgccctgtcctggaaatagccctgcctccgtgacacagcagatgtctctgagctttccagaaggacaaggctgagggcagggggtgggggagggagcctggagtgtgtagtgagactgagggctacgtgatggaggctgaggggtcagagaggagtcagtcctgggccggcatcctcagcaggctgggttttgaaaggcaggactgactgtaccaggtggggtctgggggaagagccggaggcttcggcaagacatataggaaaccgctcagccttcccctcccctccagtctgcgggggctctcggcccctctccaggcctcgtccttcctgagcacacctctcccctcccccgtggcggtgcctggctccagcccccttggctcagcagaggaggggctggctcagagcagaggggaagaagcaaaagctggtttgagggtgggagggaagctccctggttcccgctgggaggaaggggaggcagtccccatttgggccaagtggctcactggcgctgatgagataagctgtcagcaattcagctgccggccccaggctgaggctggaggggaggggacaccggcagcgaccagctggggcgccccaccatgaggaggttcaaaggggctgcccacgaggcaggggcatcctgcttctgctagctcccctactccatttagtggtggaaaggggctatccatggggccaccttctgagtattgtctcagcaccgaaatcgagcatctgggcacctcagggggtgtcagaaagactccccacttctctttccaggagggaagtcagggtctggagtagcagctgggatccaagcccacctgaagaaggggcactgagcccaggttaaaggagctgtgcccttcatatcctcaccaccttgtcctggccccccgttgcccctcgttccctccgaacaaagaggcctatgaggcagctctgtctcgcagctgttccccagttgctattccttctcctggagccaacaaccaagggaggggcgggagggggcagcagctgtcccagcacctccctaggcccagccctctcctccccctccatttgaggcctggggtggcctcgggaactagctgtctggctcctcccactcctttgggggtatccctaggcagatggagaagtggcttggtgagccctggtggcgctgagctcctctcctctgcctggcctccgagagggaggagggagagggaggtcattgcttccagagtgggacttggggccccactgcccttctcctgccccaagcctggaccacttgctgtctggcccagggccagttgctggggagaaacttccctctccagcaaatatgaatgaccaccctccccatatacacaccgccccccccaacccctgcagcctcaaggcttcctgcccaggggtctggctccagtttgcaagaagtacttctgggcgtgtgagctttggaggctgtcggggttgtgagaggctgggggcactggggcatccagactgtgtgaaagtgttggagcctgtgtgtttgagagaaagcaccgggaggcagggagtgagtgtgtcatggaatctgaaagctgccaaaccattgtgctgcagtggagccaggggaagggggtgggctggggagctgctggggaaggaaggatgaatcagtgacagggtgggggagcccaggcggccagagccccagccagagggacagggagactgaggcacccctcccggggcaggtgggagtggggcaggggatgccctggatttcccaggctctcggtctcctaacactttccccaagacctggggaagggtggaggggagaagatgtgtaaggggaaggctccactccaccctctcccatctctcgggcaacatcagtaaacaagactgtcttccacccccttccagcctcctgaaagcagtgctttgggaagctgatagatttcagaacttcattgccctttacaagtaagctgaattccaaagatctatctacatgctaggccaccccaggcttctggatatttctttctgattgttaagggggatctaggcgccccccccccccaaatcttgaggaaccagttctggctcaaaggattcctcaaaggaggtgatgggtggagtgtgtcagctcctgaggctggagtccctctggcccccagcctttgacaacatgactttcaagacttaactgagaatgtactggaccccacccacccacccctgccccactatcagaaccccttggtttctaaagccctttctggcattcggggtagagtgtgagtggaaacttgtcctaccccactccaatttcagttcttaaaatattcattcaaccaatatttattgagaccttactatgtttaagaccttcattgtagaaagataaaacctagtgtctagagtgaaaaaaaccagaccaaaaaaaaagagagtatatactgtgtgattccatttatataacactctaggaaatacaaagtaatctatcgtgacagagagcagatcagttgttgcttgggatggagggacaaggacggcaggagggagggctcacaaaggggtgtgtgcaaggaaactttggggagtgatggatggtaccttcgttattctccatctgtggtgacggcttcgtgatatatccatagtgtcaaagcttctcaaacttcattctctagcatgtgcagtttgctgtatgtcaatcatagctcagtagaactgttaacaaaacaaaaaggctctgccctgggagccttacaatcccacaaggccagaaagaaaccaggtaattacatagacaggaggcagactcacttgctgtagctgaggtgagggtaccttccagaaccacaggaacacagagaagcagccttctgaccggaagggccccataaagaacttggcatctgagtggggcctcgcaggagggagagggtcaggtaggcagagactagaggcctgaccccagagctctggcccgaggagctgcgcaggtgagggagggtgctctggggcagtggagggtggggcgcccctgagcccgtctgtgccctcccctctgcagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtgagtgggccagtgagcacagcatggagcccttagctcccaaagacagaggggacaagctggggctgccaaggcgtgtggttgtcagaatgcacaccctggggcctgggggccaggatcccctgcagggtttgtcctcctccagctgtggctctccgctggctggtggcaggccctacctgatgagtgtgccagattccgcagaggcaggaagaggtttaaaacccctcattttacagacaaggacactatggcccagagagggctggtgacttatccaagatcacacagcttatctgtggcagaaccacctagagcccagggcctggactccctgccccatgaattttttactgtgccacgaggcactattcctgccgagctgagagagaggcagtgtggtgaccaggacttgtagcaagaccaggagttagatccagagaaggctcttctctgggagaccctgggatgactttgagaaggggttgaggctcaggatgatgtgggatgaggccagtggggcactgcctggtggcaggtgagccagccttgccccttctccgtgtaggtcctggcctggtcaagtggggacagctcaggggccatgaaaaaagctgaggcatcactggctagagcgtaccccatggacagctccctttctgcccctcatctcctgaaaagataggttttctccaggagtcacagcccctcgggagaatcctcctccaccctggggtcagccggggagcagagggtgggaggcgggggcacagcctcctgggaagcattcccagctgctgagccatggcccataactggtgtggctgccagcagtgagctcagctgttccagccagtcatggattccagccttgagccggccccctccccgaaacggtgtgccgtccccctcctccagctctggcctaaaccaagcgccccttcacctgcaccgttcataggagtgatctggggctgcctcagcgtccttcctgttaggaaggcagggctcctgagggctgcagaggagaagtcattctctcctcacaggccctttaatgcctcagtttccccaagtgagcagttagaaggaatagggagtctcataccctaagactggtgtggaaagcgtttggagttctagagcttcggggcagctgtgaggaggccttctaggggggatgggtcaggggcatatgtgggacaggcactctgacctcctctgcccacccctgagaaagctgaatgaggcaagagatagcgagagggggtaccctcccagggtttggggttcaaggtctgagctggggcctgggcaggcaggaggccggccagcagggctggtgccaggctgcgtcagccagggcagaaaggcttcattgttggtggtggagagggctgtcctgctcctacgtggtgaggggcctcgaagctgatggggtcagcaggaacctggctggtcaaggcctagagctggtgggaaggggtgtaaagccacagcctctgagggtgttgggtgaacaaatgccctgcatcctggccggctggctgcccctcaccatcgtctccctccatcacctctccaggtctctgccccgactgggaggcctgggaccccaaccagcccgtggagaacgcccgggaggccatgcagcaggccgacgactggcttggggtgccccaggtacatgcgcagatggggcaggggggaaagggggcaggggcagaggttgggtctgtaagtttacctggccagggtgcagggggagactggggctgctgggaaaagagggcgccatgtgacatcactcctttccatcgcaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggtatgtgtgagcccctggcggccctcctgggcagctgggcacatgtaggctctccctgagtaacctgggctctgctcctgccccgtaggcatcgagccacagggcaacaccgtgctgcagcctgcccacttcaccgtgcagacggtggacgcgggcgtgggcgaggtgctggtctacatcgaggaccctgaaggccacaccgaggaggtatgcagaggccgctggggacagagggattcacttgggattggaaccagagagcgtggggccaacaacaggaatggcccggaggtgactgccagagccacacactgtgctgtgcagtctggggaaggtgtcaccatgggggctgagtggggctggggtgcataaggcactgtggggtcaggaggggctatggtcattggagaggcttccaatctttttccttcctaataggctaaggtggttcccaacaatgacaaggatcgcacctatgctgtctcctatgtgcccaaggtcgctgggttacacaaggtatctccctctaggcccccctgcctgcgctgctcttcacatccttggttccggctgcatggacccctctctcagcctgtacctcgcgcctgcccagagccccagctgcccgcctctcaccctccttggcctggctgtgcccctctgccccctctcaggactgctctcccctagaagctaacctttgacctctgacccctaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggtaggacgggccccagggggtgcaggtggaaagcccctgaccatgtggggctgtgtgggggtggggggaggctgggacagggatgccagccagagggtgggcagcctcagggtgagggcaccggggcagctgtgtgtgtccagagtggtgctgacagcctctgttttcggcaggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaaggtaagggcccttcactgctccccacggtagcccttaccaaagccagaggcttgcaaggggcaggaggaagagctggggcgggggtctgcagagaccccctccctgagtcctccatcccacccccaaggtggctggagttcctaagagcacagctgggaggccacagtgaagggtcccagaacatgtgccaccctgggagggctgagcggaagtgacggggctgtatgggtgggggcatatctagggagtactgcctgcatgccaagccctcaggtggtgactgccccacttgttctctccctgcactcagtgcccatcgtccaccaggccgagagtgatgccacattaatgctctccagtggaggcggggccaggcatggccgcagctgactggcctcacctgtgctgtgtggcatggcccgggccgtgtggaatcgcccccccttccttggcattctgtggcaggccccaggttccatgccgttgtctgtgttctgtggcaggtctagtgtctttgccacttgcctggtgatttctatgatgaaatctgggctctgagccattgcctgtgttccgtggtaccccttgggcagtgccatcgcctatggtcatggtagtcctggaatatgtgtcgtgtcctgtttcgtagcacctgtgggtcccatgccatttttctggattctgtggcaggctgagattcccattcctttgcctgtgttccatagcaaggcctgggctcattgccactggccacggtctgtggtaggctgatgtccacacgttgcctgtgttgtatggcaggcttcgagttctatgaagtagcccttgttctgtggcattgctggatgttttgtggcatgacttagatcctaaggttgctttggtgccctgagaggcccagagggctctagatggatggccttgggctgggtaaaggggccttccctgtctctctgagcccactctcagcccaggctctgccatgcatttccccagtggcactggctcggaaactttcttgtaacctgcctgatctggggcctgtagccagctccagcccggcagccccggttgtgctggggacacaaagggctccagagcagggccgtgggccactgcctgtgcctgggaggggttagaaggactgtgcacagggaggtgggggctagtggtccaaggcccctcagcacccccaacctcctttctcttcctcccctagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaagtgagtgccagagcccagggtcgtgagggtggggctgggggatcataagggaagtatggccagtggttctgactcccagagggcagtgacagccagcaccacagctccacagtgaccagaggcaccccagaatctcaggctcattgtctcctctctgcctcagtttcttggtctacaagccaggaatgattctctccaccctaagtgctatacggggtgttatgcacagggatgacaagtgttccctgccctgagttgcagcactgctcactacagcactgccctcgggctgggtcggggtcccaatggctccttgaggggattgaggagctgggacttcaaggatattgatctgccttcttccccaccctgcccccatctcctcagagggcacagaggagccagtgaaggtgcgggaggctggggatggtgtgttcgagtgcgagtactacccggtggtgcctgggaagtatgtggtgaccatcacgtggggcggctacgccatccctcgcaggtgagtaccttgcgccccccatgctgtcctgtctaggccatcacagggagggacgaggggcactgggctgcgagggagtttgaggggagatggagtttgggctgcgagggactttggggggcacttcctggcatggacaccagctccctctctgcccagcccctttgaggtacaggtgagcccagaggcaggagtgcaaaaggtccgggcctggggtcctggtttggagactggccaggtgggcaagtcagccgattttgtggtggaagccattggcaccgaggtggggacactgggtaagtggctggggggcaggaggagggagtgctgcgggggagggcagcaggggacactgtgggtaatgggtgcagtgcgcatgctggggagcgctggggtgagcagggagataggacatgagggcagctagaggggagctgggggacggaagggtcttgcctgatgctggatccccgaccctcccccaccttgccccaggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgtggtcccagctcacacacacctgccccgggggtggggcaagctggttctcctcccctccccaactcagccttcttccctccgcacaggtgaaggcctttgggcctggcctggagcctaccggctgcatcgtggacaagcccgctgagttcaccattgatgctcgtgcagctggcaagggagacctgaagctctatgcccaggtaggtcattgtccagtctctgctgcccttactacccatggcagggaccctggaaggcagggccaggccagaggcagaggcctcccagcaggaaatgacagcatcacagaagatcaggcaggactgatactcatgggcccatcagtaccatggaaaattttaaattttgtgttttcttaacgatgataacctaaaaacgtattttaccaaagagtcatttttgtgctaatttgtaattgaaagattgtttcattgaataagacactggtttcccaagtcagtttctcagactggtgtccattgacccctagaggttaatgaacatattcttgaggatctaagagggtgattcttctttgaaaggctcatgattcagttttaggaacataaatttagcccacactcttcctgtccaacacatttcagagttgaggaaacctaggctgggagagcaagccatacagatggccttgagtcaggctcccagggtgggctctggccgccagagcacgtggccctgggctctggtggcctcagtggctggtgtgggggcgggagtgccagtgttgggggtgggaaaggaggcgctgggttcacctgcggccagcagagggcgctctgcagaggccacagctatgaactttgcttgggtgatgcccacaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgcgtcctcccggcctgccccgtgcccaccaccaggggtccctgagggagggcggaaccctcgctggagtccctgttgtccctgggctcaggctgggactgaggcttgggctggtgccactgaggctgggccgggtgcgctgggcaggaggatgagccttgagggagggcaccacgctgagctgcgacccctcccgcaggtgaacgtgggcgagggcagccaccccgagcgggtaaaggtgtacggccccggagtggagaagacaggcctcaaggccaatgagcccacctacttcacggtggactgcagcgaggcggggcaaggtgcgcccagccggaaggggtgggtctgggagggggcgggggtgagtcgagtcgggggctgagcccaactcacagcagtgcccgcttctctgcaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggtacctaagctcctgggtactcacagcgacatgcacctgccagctccagaaggcagctggagatgctgtcactgggaacagggagggatgattccgcagacatggtggagccctacctgtgtgaggcagggtgcctcagaggaagcaaagggggcccttttggaggctgcccctgtccatgctgggtcccctgggtgtgtcctgagccagcatctagctgagagcaggggtgtgttcccctcgagagccctgactgagcctcctccacatccaggagatccccgccagccccttccacatcaaggtggacccatcccacgatgccagcaaagtcaaggccgagggccctgggctgaatcgcacaggtgagtgtctgggcaggggctgggactggctcgaggttggggttaggtggctgccaggccctcaccacatctctgggtgggtcctcaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcaggtgcgctctgcccctcccatgctaccgcccggccggcccgccagagccctgggtctccctcctccagtcccatgggaccagttctggatcctccacgcctttcctgcctcctgccctcactctcatggtggatctgagcttcagagcccatattcaccaccaggatgttgtaggaccttgccttatatccagttctgacctaccattgtacccaacagggcaacatggcagtgacagtgacttatggcggggaccctgtccccaagagcccctttgtggtgaatgtggcacccccgctggacctcagcaaaatcaaagttcagggccttaatagcagtaagtggggcaagagccaccctgggagtgaggggtattcgggtagggtggaccggagtctcctcatggtgtcacttgccctccacgcagaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtgaggagataggagctggttggggctgggagttggggacttgttgggaagatagatgagtcatagggggcagaggccagagggacttatgtgcctggagtgggcacagccaagggtgtggggctgaggccagccccaccccaccacctgccttggagacaacttagctattaagagcctggccttggagtcacacctgggcttgaatcccaggtccactaactggggcaaattgcttcatctcgctgcctcaatgtcatcacctgggattgttataagcactcagtccacagtagcagccacagttggaggtgatgagttgggtgggggccatgaaggctgggatgaggaggccaggtgcagggaacccacaacctgcctcttcccctaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgagtggacaggaggagccaagaaaggtcaagtggcaggtgcaggagctgggtagtccgtgggagggagggaagaagagctgagagctggaagagcaacctggggtgaagggagggctctcggagcagccccagagtccttactggcccagaaaccccagagaaggagtggaggggaagaccgggggtggagattggcctctgctcttgtggcaaaactgcacctgcctctgggcgtttttctggagagatctcttctttcatgtgcttaaggggtaccctgatccaaaaagctaaaactctgctctggacgggggcacggggaaagctttggggtagaggatgacaagagtcagaagacagtaagtgggaatgggccatctgccaggggccagaccctggctaggcatgggccacggcagagggatgcaagacccaggcccacagcctggtgggtgactcaagtgaacagagaatgtcactacatggagaagggagtgaaggcagaggctggagctcacagaggtgcaggggagggtgtggggcccaggctccgattagaggagcagcctgggagttggggagtgggagaggagggggagaggagggtgagaggaggggaagaggaggggaagaggagagggagaggagagggaaaggagggggagaggagagggagcatctgtgtgaaggctgcccccacccctgctgaacacgccacccctgggctccaggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggtgagggccggtgggccaggctagtgggcagggctgggcaagtgggcagggccgggatctgatgatattgccctcggggcaggaggggtggtgggggcgcacactccctgattgatgcccctgtggctggcttccaggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggtatcctccccctttgctagcctaaatctgtgaccaccctttcccagcccctggccctcctcgctcatccctctgcctgggcctcagccccaccccatcctctctcaggggtgaggcaggagcagaccccctccaggaccccagattggcccctgtagctcgtttctcctcagctgggtccccagcggcctgccctctttcctccctgtccccccattcagctactccctcatcctcactcactggtcttatgaagctgatggggggatgttatctctcaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccaggtgtgcagagagagtggtcggggtctcagggaagacaagggagggtgcaggatgctcgccccacaagggggaaactggaaggaagttgggtaagaatgttcatagagaggacagcctagagtgggttggggccggagcccggccagagggaggacgtggaggaggcaggcaatgagggttgatgtgacagcccccctagtcaatcacaggaacacactctggcctcctagccccttgtctggagctcaagaccttggctttgcaggtccaccactcactgtgtgtccagaaactcagacacagtccactcctcttggcggctcaggccagccttgggccttcttgcacgcatcgtctgcagaactcccctgccctctgcagacccagctgcccgggcaggtcatgtcttcaaatattgtatgacttgggactgctgaaattggaaattttttcccttatctaatttcccatctttttattatttcagccacagtgtcagaaatacatttcatttttgaaaacattttattttcacattttattaatttaggaaggccttctcttccaggcctgggacccacatgagtgaggtttgcccagcctcagtctgcagtcaagttcatttattcttgtgtgtgttttcttagcaagttcctagccattttcccatgttggtctggcttccctgtgggcatttcaaaggcagggaaggcctcctcctccgaggctcctcagcatcagggggacccatcagggctggtgggcagggtctaatgtccttctcctcacagggagcccgttccgcgtgccagtgaaggatgtggtggaccctgggaaggtgaagtgctcagggccagggctgggggctggtgtcagggcccgggttcctcagaccttcacagtggattgcagtcaagctggccgggcgcccctgcaggtggctgtgctgggccccacaggtatagaatggccggggcagggaggagggaggtggggcgggacgcccggaggctctgctgaccctgtgccccttgcccaggtgtggccgagcctgtggaggtgcgggacaatggagatggcacccacactgtccactacaccccagccactgacgggccctacacggtagccgtcaagtatgctgaccaggaggtgccacgcaggtgaggaccagccctgggctcctgtgctgcggctgagctctggggtgctcctgctggggtggcactcaggatcactgctggagtcccctgggagagcctctcccagctctcagcctcgtccagtctcgccaccccatcccgctcttccccggggctctctgctgtgaggctttcctgccccaggagcttttacggcaaacctagcgccttaggaagagtgcaggaggcctgggccagggcctcctcctggaccctcccacagcaccttcctggggaatggagacgtaccctggctctgtcgagggagtcccagagtgcccccacccccagacatggaatgtcatcggcttctgggaactggtccctcctccctgccccacagtcctccctcctgcccatgtctatggggaggactctggctcaagatgagatcaccccccaccgccccgtccatgccacccagccaactgtttatcccttctgctcctcaagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggtgagtctctgtgcatcccaccccgcaggtcatgctccaggcacaggcgggccttgacctctgcttctccctcaggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacaggtgggtgcccacccgctgcccgtgccctgctcaccacccagcccctcaaagcccctccagaaccctggcctggtccccaggggtctgctggtcggagagcacacatgccctagccctggcccctccctccctcacccccgcccaatgccccagcccacgttgagcaccgcctggcctcacactcttctctctttccagtgtccattggaggccatggcctgggtgagtgccctttctctcctcttcttggtgtgggccagggtggttggcggtagggggcgggcagcgggaacagagagggctggctccagcccaccagctccctgagcaggatctcccgcatggcaggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggtaagttctgtagccacagcaagactagatggctggggaggggggcctggcccttttagcagcagcagggatcccagataactgtccccaaggaatcccacttctctgagggctcctggggccagagtgctccaggatggagccttaactttccccacagcacccccgaagtgggaggagagcatggccctgccccctgcccagtgctgtcagctgtctctggaggaacccgctgtgctctccaccatccccagctccatctccccagaggctgccctgcaggaggatgaacacccaaattatcacccagcatttcaggttcctgggccattctctgagtcagcccctaggcctgtgaggctgccacaccctgtgcccccgtgccttgcctccccaggcgtgtgaccccctgccgcacgaggaggagccctctgaagtgccacagctgcgccagccctacgctcctccccggcccggcgcccgccccacacactgggtactgcgcctcccaccaggcgatgtcctcctcctcctccccttccttcatttcttctctctactcctctgcagccagggcggggacatggtctgggggcctcttggggagcaggcaagagttaggctgggcagatggaaccccacttgggcacagcactccttctcttgcagctgacgcacctctcctgccacgctggtttcatgattaactaccttgttctttcctcactctccagcttcagtcatagcatgggtcaaactcctgggccttccccagtcactgactgttccctctcacctgctgcaggccacagaggagccagtggtgcctgtggagccaatggagtccatgctgaggcccttcaacctggtcatccccttcgcggtgcagaaaggggagctcacaggtactgccctgtggctcccaggcatgagggctgaggggagaaaccctcttccaggcccagtcctgtgtcttaatgatgaaaacaaaggcccagagagaggaagtgagctctacccagggtcacacagcaagttgggcagagccagaactcaggtgcaagccatctgtccccagttcagggctcaggccactgccacaggctgtctcttgatgcctggcttctcgggtggcagcagaagcactcaggaccaggcctgggacagcagggaggttgcagtgggggaaaccagggtctccacgtaactgtgtctgccctgcaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctggtgagttaggggctgggctgggctggggcttgggtgagaggagcaggccgtagcttcagtcctgccttccctctttcaacaaatatttattgagcacccgctgtgtgcagacaccaggcgaggccccagggaggcttataccctggtgggaagcagacctccaccagctgggtccctacggcacagacggagggggttggcagggaggctgctggaaggtgctggggccaaggtgggctcagataatccctgatgctgacccagccccctttttctctgtatccccagggagccccttacagttctatgtggatgccatcaacagccgccatgtcagtgcctatgggccaggcctgagccatggcatggtcaacaagccagccaccttcactattgtcaccaaagatgctggagaaggtgagggagctgcaggtcgcaggctggggtggagactcaccaggggcaggggtgagggcaggacctctgatcttggccacacctccacctacagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgaggcgggtgtatgggcatgtacagcccatgaggcacacacaccgcatacagtgcactcatgtgcaagcccagcccgttcaagtcactcgtgacattagggcagaggcccttcaaggtgtgaggggtcatattttgataaatgtaaaaacactctgttctccacggcagctaagaagcagtcagccactccttgtgcctgaaaacacattgcctcatttagtctttgaagtcatttgttttgtttttgtttttgagagggagtcttgctctgtcacccaggctggagtacagtggcacgatctcggctcactgcaacctccgcctcccgggttcatgccattcttctgcctcagcctcccaagtagctgggactccaggcgcccgccaccatgcctggctattttttgtatttttagtagagacagggtttcaccgtgttagccaggatggtctcgatctcctgaccttgtgatccacctgcctcggcctcccaaagtgctgggattacaggtgtgagccaccacgcccagcatgaagtcactcttaagaagttagggcacggataatccttttgatagataaggaacccctgtcccagagaggccaagcaacatgattacagccacacagcgaggaaggggtctgggcggtccagtctagtgttttgttatcacaacatcatgtgactcagggttaaaatgcaggaggtttcctttagggatttagcccacaaggactgaggcagccacagtggaattggggtacaggcccctcttagtctctggcagctcacatgtgagtgcagactgcactttccaggccttgggcctccgtgcacctgggagtggccccccgtgtctgttgagtccagggggggctgctcaggagggttcctgagccctgtgagggcagggcctgcctggagtcatagcagcctgatgccccaactcccccaccaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattggtgagcgtggggcctcacggggacctcaggggtgggggcccacaggatgctctgcctaacacccactttccacagggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggtacctcctgccccagagagcccccattccagcgggtgcctcccacaggcacttgtcctcgtcctgcccagcacccccttggccgcactctctcctccctgaaacttcctgaccagtctgcgtcaggattcgcattctggggccccttgcgggaaagtgaatggccccgcatcagttctctcccttttaagagaaagctcagctgtcctgagtttctgtccctcccttgctcactggaatccaagaggcttaccttagggaattttccagaccgcctgtcccgtggtgcccccgctcctcccactgagccatttttgttagtggtcactacacacatcggtgcccattctgggtggagcctgcagtctggggagaggaaagcattgtggcttggccagcctaggactgagggagatgtgttccttgctttcccccaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggtaaggctctgggcagaggtcggtggcgagagacagggaggccaggaggctggggctctgaggttcctgacccaccctttgtccccacttcaggaagccccttcactgtgaaggtgaccggcgagggccgcatgaaggagagcatcacccggcggagacaggcaccttccatcgccaccatcggcagcacctgtgacctcaacctcaagatcccaggtagaagcctggaggaccctgggtggggcgggtggtgggagagggctggcccgggccagagcccacctgtcgggcctccaccctgcttcctcacccctcgcttccctccctcaccctggctcccttgaccacacaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgagcaccgcacactgggccggccgggtcctcacggcgggatgggagggtgctgcggaccaggcttgatgctggcagactggccccgaaggccagggcaggtctgagcagaggaggaggtttaactgatgggggagggaagggccagggctaggaggaatcccagtgttgccctgacatcccccaaaccctgcaggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccaggtaaggggcaggtggccaggagtggggatgaagtcagggcagccagtgtgaggggcgatgatgctgaagtccactaccttgcctgtccccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgggcgtccacactggcagtggggctgggcctgcctgaccttccagactgggtttctgcccactggccaggcaggagatgcttggggccacagaactcccctccccggagccccctgctcttcctctgccccgtctccctctaccccacaccctcagaaacatgtgtctgcctccagatctgagcgctgaccacagagcctttcctgggataaggccagggtggggaggctcccgccctgccaacctccatcccggaacctgtgctgactggtctctctccccaggtgactatgaggtctccatcaagttcaatgatgagcacatcccagacagcccctttgtggtgcctgtggcctccctctcggatgacgctcgccgtctcactgtcaccagcctccaggtttgtgcccagggtgggggtggagggtttctgctatctgagagatgggcaggagttgaggacagcaggtccatggggccagggatttagcagtgaccttggaagggccagttaggagtcccttctcataaggcacgaggcagggcccttggggacggtgggctcccaccctgggggcttgcccgtgcactcaggcatgccacgcctcgttctgcctttctcagggtgtgtctgcctgtcctactgccacctgccatttcttgttacagtttgttccaccttctgttgtaagaatgctagatgacaacatttataagaatgagagcataaaatctatacaaactaagagtaaaccagtttgcacagagggtgtgagaggctcctctaaagggaatgcctatgggctgcagagcctgggctgcatcctcttcaggccgctgggggcctggcttgctttctcttgctgctgacttctagagatgtggtgtgttcctttcattctgtcacagcggacatgtgcaaggaaggctttcagcaagtcacactgaaacatgcaaaccagggggccaggtgtccaggggacacattgtaaaggagcttctgcataaggcgcacagaatgggcttcaccccacctccttctcccacgcgcctcctggctgcccctcagggtggtcacattggcccatccagagtccttgtgcatctcctcctcccactcctgaactgggctccccgatgcaggctccaatccctcccccagagcccttctgtgcttcttctggtcctccctgttggtccaccttctccaggaagctctcccaggccaggccagtgaaactcagcttcctacctcagagctctctggcacccccagcccacacagcccatcaggcacttgccctccgccctcagcctgcttcacacagagtggggcccttccttcctcagccaggacagggcacatcgtctgtcatctcccacacaccaagcacagctaggatagcaggtgcacacatagggttgcataccggaccctggctcctcctgctcccaggctgggctggcaggcaggggccaggctgggcatggggtggcagcagcctttgggctgggcttacagtgagcaccgtgtggggcttcagagaagactgctccagccccggcctcccaggagtctgagcatcctccgtggcctttgcaggagacggggctcaaggtgaaccagccagcgtcctttgccgtgcagctgaacggtgcccggggcgtgattgatgcccgggtgcacacaccctcgggggctgtggaggagtgctacgtctctgagctggacagtggtgagctggccctgcccctgccaactcccttccgggctggggccttctggggaggggaaggatggaggctaagccaccaaccctttatccacagacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgagtgcctggagctggggaacagggtgacttctgggggtgcttggccactagtctggtgctgctttgctccagaggtaggggccctgcttcctaagccaggagtccccacagaggctgtccagggagctggggcccagtccctcttgggccacaagcccttcctgccctcagccttgctacctctggcccccaggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtgagtgccagtttgggggaggtccacccagcctgcagcccagcccagcctggagggctccggtggccacgcacatctaggccatagtctgcccccagacatcatggtcagtttaccagggctagaggtgggcctggctctacacagtacacgttctgtggagtcgggcatgatcacgtaaaaatgccattcttcctctccatcgtggcccctcactccttcagctctggcctgcgctggctcctcaggctctagcaccactttcttccctcctggcttcccatattcctccgctccaagaagacacagtcggtattgagcaagcttcccctcttgaggctgtctgtaggatgagttgggtgggtgttcctttgtaaagtggctcttaccctgtgagttagcctgagttcccagacaaagcctgcaaggatgagggacgcagcatctgaggccccagccctagggtggagcaccagttggagctggcagctcagggccctggctgggaatgaggctgtgctcctagagtggcccttggaggaatttgagggggagcctcaaatgcaggcagtgagtcccacagggtggcagtgctggccgagggtcccctgcctggggaagaacaggaagcccttctgactaggtttgtgccccctccacccacccctcaggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaggtggcggggggagggcgtctcccggggtgtgagcaagaagccgtcagggagcagggtgtgggtcacagtaggggactccctggtgtgagcctgtccctctgcctccctctccaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcag

SEQ ID NO: 36953 - DNA, 5854 bp, Homo sapiens
tttgcataacctcggtaaggggaagtctcagttccaggctcttctaggctatgttctctgtctccacaccttcctctcagacagcagctggagccccagaacctgggagcctcacagagaaagtcctgatgtgggacctggttttccacccgagacccaggatccaataaagaagtgtttccataaatgatgcatcctccaaagaaggccagtgactttctgtgccaagtacctgacagaattgccatttcctagagctgccaggcagccctaggtgcacaggtcacctgtgcatgtgtcagagaccaaatcccatcaatattgaggccttggttaagacaggtacttgcttttagtcgtgaaaagatgcctggctttggcaggagaatcgcttgaacctgggaggcagaggttgcagtgagccaagattgtgccactacactccagcctggtgacacagcgagactttgtctcaaaaaaaaaaaaaaaaaaagaaagaaaagaaaagatggctggcttcaacactgagaaaaccaactctccttgagcaaatgctttgcatattctcatagaaataagggaacacctattaccctccttgcactgcttcctgcacagctgggatactacctttcacaagcatcctgagccacctgctggccttttgtgtgtgtttccttcctggcttcctcccatttttttttccatctctgaacctgctgtaaggtgaagaattgaggcgggccccaaatgtaagacctcatgaatttgacgatgcaacagtgtcctggacagcctggctctcagggctggggagctgggcagagagaaaagagggcattccaggggccagggagctccaggcccagagtaggatttcaaggctaaagaaacagaggctgtgggtgggtagagggtcttgactagggtagggacagagggtgcgtcttaaggctcagctagggacagcttcatccaggaagtagtcagcaattgggggccaagctgcaaggaggaagaggtggggagagagaatggagagagaggtgttcagtgatcaaatgcctggcctggcctgtttcctcaggagacacccctgggagtctgggagcctctcccccgggctgctatccaacagggtgcaagtaatccccccttacacacactaagaacccagggtgagtgtcaaattatatgttagctaagaaatgaagagagggagcaggatttctggttgacggtgaggatatttattaagggtttactggtacaaggagaggggctggatgatttggggtgggaggggatctctgttctgggatcctgcagctccaggcccccatgggtggggtgagggtcagggacctaagaacattcttcaggggccactgtcttctccacagtgctctcttgtgtgtgaccttacagctgtagctgctgcaggacctccactggtcgggtgtcaggctcaggtcgcttctggctgtgtgcttgttgctctgtttggaggtcttggtgacttccgtaccctgggtgacaggggtgctgtttgccttccaggccaccgtcacagctcccgggtagaagccactcatgagacacagcagtgtggccttttggcttggagctcctcagaggaggacgggaacagagtgaccaagggggtggccttgggctggcctgtgggtgggcgagcggcaggaggtcagcatcctgttgtgtacctgggagccccctgacctcagtgtatgaagaggggtcaggccccctcagtgccagtgtaggacccctcagacatggtccacagtgtctcagaagggtgtgacatgaggttcctaaaacaactctctgtcattcagggaacctccgagcctgtcccctgcccaccagtggtggcagttaatttggtattcatttccaaggctggagaaggatgtaattttttttcttttcttttcttttggtgagacagggtcttactgtgttgtccaggttggagtgacctggcgtggtctctgctcactgctaatttttgtattgtttgtagagatgaggtcttcctgtgttgtccagactcgtctcaaattcctgggctcaagggatcttcctgccttggcctcgcaaagtgctgggattacagatgtgagctactgcatccagcccccttttttttttttgagatggtgtctcactctgttgcccaggccggagtgcaatggcacaatcttggctcagtgcaacttctgcctcccaggttcaagcgattctcctgccaaagcctcccaagtatctgggattacaggcgtgtgccaccacgcctggctaattcttttgtattttcagtagagatggggtttcacccatcaggctggtctcgaacttttgatgacctcagatgatccacccaccttggcctcccgaagtgctgggattacaggcatgagccatcgtgcccagcctctcagctcctaattcttatgttcatcaatcagtctcttgctggggttcccctaggaggtggtgaaatgaccccagctcgctgttcctcacatgggtgctgccacgtcactggctcaggctcagctgctgggtcaccaggagaatggacccttcctccacctcagctcagagcacagtgatgattcgtgactttcccaatagaacttcaaatctctgaggacggggggtggggggatgtgcttgagtgtttgtactcatggtcttgttctcggagtgacaaagctggaacacaatacctctatgcatgaaaaggttgtcacttgtcacaactaacaggctttcacctcaaggaaattttcttcccttgtgtacttttcccctggcagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaaggtaaggaatctgtataccctgcccccttcccaagaccagaccaggaaaaatcatctgtgcagttggcccctcattccacatggggattagctgctgtctggcacctaaaattgagatgcttcatcatcacattctcagccctgacaacacatagaatcacctggtgatgtcaaaaacaaaaacaaacaaaaacccgatgtctatgtcatgggttagacaagggattctctaaacttagtgtgctcagattacctggggatcttgttaaaatgcagatgctgaactgggaagtctcaggattgatcccgctggcttggggactttgctgagtagcaaaaacatagagcaactgaatttgaatttctctctagcaaaggttcccatgaatctgacattaagatgggcctggtatttctaatgcacagtgaatattggcacccattgtaccaaacaacctcaccccagggttgagaagagttgggaatggagcacctatggtgtttgtttctgtgagtggggagagttgcagatattggtctcctcatccatgcgccatgggctccaacagtggtcctggctacagaaaatactatcactctccataactctggggaaaagggacatttaaatgaaaaggttatggtcagcctgggcaaagaattacacctataaatggtggtgggcccctataatgtccctgacactggtagcttctgccctgacacccatgatctctactcatccatctacccatacctgactgtctctctgctgaactatggaggacagagattcaccctgtccaagtcatgtttggaaccctcttcctccttccttgtccatgtccattccctaattcaccattaaatagcaatcaatccctagtcttgactagggtagtcttactgtgatctataaaatctatattagtgatcatatcagttttttgacttgaaggataatatattttgtagatttttttttttcagaatgttctggacaattaattttctctaggccagatcacactgcctcctccatgagaattggcggcttcacctgtcagtcacatacccaatgccttaaattattgacctttgtattttctgcccttattctctacaatcagtcagttatgacagacaactttcaaatacctttctcttggctccaaaatttaccattgttttgcttaaggtctcaccttccatgtaggatagaaaacattctttcatctaaaaggtccccctcctccacctggccttagagcctcctaatgtccaggaccagcatctctgtcatcacattgtcagctgcagagataccctatctgctgtcagaactgtgcacaattaatttgtttacaaacatggaaaacaaaagcctggaatcatgctctatatactgaattggagcaataaaatgtggaagcagaaacatatttaatattgaccacttgcattgtcttaattatcatttatttgttcacacatcaaggtggtagaaaggggggcatggtgtctgccttcagagaccctccactctaaatgaagaaaagttcagtgaagcaaacacgtgacgtaaagtaaaataagaattgctactgtgaataagagtcacgtattgccacaaagcatacctatgaaaatttgaaatagggaagtttcctcatgaaaagttttgattttggaggaagaaacagaattaaagaaactaaagtcaggagatatttgggcctttgaagtagaagagaggcatggggttggcttctgtccacttgctgagcaacttgttttccttttcacagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 36954 - DNA, 149247 bp, Homo sapiens
actctgggcggcggatccgagcgggggataccccaggagatgggggtcgaggagagaccccggggagtagagagagagaaactcactccccgagtccccgaccctccccaagcaaggtgaggtcaacgccacccaccttcccccggtcaccctgggaggggtcgctccggcgggcgtctgctggagggtagaagcggggaagggaggcagcggcggcgcccaggcggcggtaggtagccgggcggcgagggcgcccgcaccccccggccgctgcgctgcgctgcggtgcgcacgggctccgccggttgctattccggctggtggcggccgccgcaggaagggccggttcctgcgctccccccgcccctttccctcgccttcggctgacgctgacgtcggatgagtgatccggagggacgctccgaccgcggccgggaggctcctgggggccggggctccgaggtacctgccctccggggtcggggcgggggcgcgccgggcgggctgcaggaagcagcaggagacgcccggcagccgggacggtcggggacgcctggtaggagctgccttctctgccctccgcgggcggcgcgtgataggcgagtcgcctcctcgggtcccggatcccggtgcgggaaccgcatcagccccttcccctcccctcctccctccggcctgggaaggtctggaggatgcgcgcgccgtgagagcgtgcgtcagccccgggggagcggtagggaagcgttccgcgctccggccccagcgctgggagcaccggcacccatgccagcccaccccacccacccaccgcgcgcctcgccttcccggcggctccggccccaggaccccgagctccctggtgggcagggacttgcgtccagggttgacttgttgacaagttcacctgccgcggcgcctggtgtgtgctttttctcttcccctccgtggccctttttttggcaggggcggcagagagcatatgggtacctctttataaccactagtgccaggaggcctgagcttggtcccccgggggcgaggtgctcagcagtctcggactagacggggcgagaacccctaagcaaccccggttccagcaaaccctggcgcgcccgtttcctttgggcgctgctgactccgcctttcctgctccggggctattgcagctcctgcttcctctagaaacgaacatatcctgttgttatgtctgcctttcccccaaagcggctctccaggaacctttcccactgtctttttacttgtagtacccccaaagcacctgagcttctctttggggtcttaaaagtatcgcgcccttattctggcgaagggcattaactgcctggttggggagagttagtttggaaagaatcgcgttctcttcatttagatggcattaaaaaattagcgcaagaaagggttttgttcatgaatcttagtaaccgagatctggtaacggtataaaaattatcaaggcctggaaaatatgtcaccagcttgcttgggagtgatactgaatgtaggaagaaagacacataaggcatttattggccattaaggtcctataaaatatgactcatcgcaaacatgtttttgtccatacgtttcagtgaagtctcttcggaaaatctcaaattggtttctgtggccctctggtttgaatctgagatctgaactgttctgtggttagggagtgaaataagaaatgcttagtttgaaatctaggctcccgatgcaatttcataccccctgtttaaaacacacactctctaaaaatgcttttaagtaagttttcaaaccaaagatatatttttagatttcagtctttatttttgaaacaccctttgtagagaataccacagggacaaaatcaatttataatcctgaatagctcaaatatcactctttggttttatactaatactgtacatacatcttaattgcaggagatgttgctttctaattgtttctgtttgtattacaaagggaaataattgtactgtttataaagatgaatctttagaaaacgtaacagttaagctacagcgggctatttgtggagagacctgatgttaaaaaacgttaaccctgtatcctccacccgtggatcattgagtgctaaagatactggatggtaattgcctgggtggtttattttgtaactattttcccccatttggaacacctgagtaactatctgactgctttctctacgcatctttaccgcagtgcataaagatcaatctcacgaaaagtatagaaaattttgttactcagagccttcaaaatcagtacgttttcaaggtatttgactaaatagtacatttttttcaggtgcaagcagcattagcggtatggaggtctggtagttatgccataacgtagaaggataaacctatgtttggtatgaacttttaagattatagaaacctcatgcgagagagggaggaagttaacaggccccaagtgtcaggatgaatttttcctcttcgttggttgagcctgagggtaggtggcagtgtttataatcagcacgctggtcactagtgtcctttttttccatctgcattactagatttatgggaaccattaataaggatgctatctgcatgttttgtccatgaggcaacatagatcactaatgaatcttatcccccaaccccaccaccattcgcaatctgcctcagcagaactttaaactcaaaaaacacttttcccccgcttttttcttgattcccaagctgatacatttcgtatcacaatcatatctaacactctgagggagtatggaggactcatgggctttggatcctgatggagcaaaatcagaatccctgcggtaacacctaactagccgtgtgaccttgaccaagttacttaagtcaccatttccttatctacagaacaggaatatccacctttttaggggcagggtggagattagagataatgtatataaaatgctttgcacgcttttaaataggactcactcagtagtaataaattattttttcacatgctaaacatatgctatccgtatctaaaaagaatgctgctgctttgcctgtgataggaagtgtatttcaatttggttttgagtagttcaaataattttgtaccaatactaagaccctgggctttatggaaaacactctctgaagttggggggtgcaaccagaaacaaaacaaatctaatttgttccagtggggatagatcttccaagcccctgtcactcaaacgtggtccatggaccagtagcatgtggcctcccctgggagcttattagaaatgcaaaatcttagcgtgcctgctactctcttccagacccagtgaattcaaatctccattttaacaagatctccatgagtatgttaacatttgagaagcaatgctgtaacctgttatttctcaaactttagtgtcccagagaatcatttgggggcttgttaaaataagtgtggattcccggtcaagcttccttcatctgctgttaagcaacatctcaggtagctctgatccctagggtctcccacagactgtccagcacactactctaaaatgagcctctgtcctcttccttcacaaagcactttggcaactatgatcttatgtgatactcaaccccctttgagataagtagatattataatctccatctgtctgataaggactgcaggcatgatttgccctggatagatgcatatggtagaactgccttggagcctctaaaaatcctggctgaccacactttcactattctagcaatttactatttagtattatagcatcaaattaacatagtttttgttttttgacctgtaagtaattttcacaaataactaatgaatctctccaggacagggaagactacatgtgatagggcattttatacctgtttttataacaaagcctgcctactatgtgactgtaggccagttgcttaagataactgaacttaaacttcttcgtgaaatgaatataaatcattatgtcaacttggccgtattgcgaggatactccgtgatgtgggtgaagcatacaccccagtgtctgagaagtggcagttcctcaattagtggtaactccttgtcccagtgtaaacctagtgagctagaatgagttcatgaaaaggtggggaaatgatggcctgcatcactcatgatgggaatcatctgtctctcttgctaagtcagatgacatcatccatcaggcctttgaccaaatcagagaagtgggatgacttagtattgaacaagcattggttgtatatgtgccatgagctacacactgtgctaaacactcagaatcccaagactcagaccccaccatgctctggaggagcgtacagctgagtaaaagagggaaagagaggagtcaactaaccaattgcctttcagggaaagcaagaaggagatagagacacaggtggtaatgcagcccagggcgggggcatcccaccccaacaggagaaagggcagagaaaccctgagatgcttcatggaggagattgcccttgagttgagcctgaaacaaccagtaggaattcagcaggtaaataagggttgggagtggggagaaagagcgttccccactcccaaccatgtgtatgtgtgtacaaaagtcaacaagtaagggagagaatgctaatacaaatagtcctcgtgtctggagcccagtgtctatgtgtgtcccttactagctgagtggccttggacaagtctgatcatctgtgattcaggaggattagatgcactaattagtgtaagcacaggactgattctaaatattcgttgcatggttgtggaggtggtggaggtattagtagaaaataggggactaatattaaaaagtcattagaatcagagaacattgcagagttcaattttagaatacatttagcagaaaatacatgaattaagagagggtgactgaatgcaatatagttctgtggagtggaaaatatgaggtatatgtgttcagtgatggaccactgaatatatagatagtagtcattgttaattttaagagtctagattggagactagaaaggtcctctggttctagttagtgaaagtatttgtacaagaagtgactcttaagtattgcaacaatgttccaagagtatacatattgaaatccatctcttaccatcatcatgatcacactcactgccacatctctgttcccagaacagggcatagacatcagtttctgaaacctaatagtacctaggggaaaatccggtcttctctgtgatatttccagggtagagcattctaagccagaaaccaagaagctgatatttataaatagtgcccctctccttagtcataggaaccctgacaactatcaaggaagaaatcaatcagcaattgcaggttttgttgtgcacagtagcactatattggcagtggatttgggcctaacccagcacctaagcctgtgattgggggagattgtttttattgaaacagccccattaatcaagctcctttcatccaagagtagagcagagtagttaaaaacaggagctcagaagtcaaaagtaaacttgtgtttaccagttgttgactttgggtaaattacttcgtccttctaaactttgtttctcacttgcaaaatgggttgatatccccttcataatgtgtggcgatgacataatgatgttaagtgcttcacacatgtaaagtgcttggtaagtggtagaacataattattgccccttgcccagcacatatgtactgaatggctactgtgctccaggggccatgcttggtgctaaggaggcaaagatgaacttgagggtccctgtactcatgggacctacagtctagtgcaggagatacagatgtaattagctccttgaaggagagtacaggagtgcagtggcaccaccagtatggagcagttaactcttcagtggggaggtctggagtgcaagacccatggggagagggatagagacgagatgttgagttgggaatacttcactgaagaggcaacatttgaggagagtcttgatgtaaattctaagttaggcaatcagacaaaggagggggagggcattccaagtggaaagaatcatctcaagtccttgaagtgcatagtatattcagggaagctcaagcgttctgacatgcgcagagggaatagttctatcggagggtggggaggagagtaagatttggggggaagggagccaggatgtaaaggggcctgtgttttttcaaaaaatgtttggaatttctctagtggcaagagaaagcaattaaaacattttaagtaggagagtggaaaaatttgatttgcatcatatagtgataggtcgggcagtgttgtaaagattggaatggacaggtacacagatagcattgcctcttaaggcctaagctgtgaagatagaaaagataagatgcattcaatcgctttttaagaggtagaatggagagaacctggagactggttgcaaaagatgaaagaggctgggtgtggtggctcatgtctgtgatcctagcactttgggagaccagggcaagaggattgcttgaactcaagtgtttgagaccagcctgggcaacatagtgagaactcatctctaccaacaatttaaaaaattagctgggtgtggtggtatgtgcctgtagtcccagctacttggtaggctaagtaagaggattgcttgagcccagcaggtcagggctgcagtgagtcatgattgtgccactgcactccagcctgggcaacagagcaagaccctgccaaaaaaaaaaaaaaagagaaagaagtgaggttttcaacttaggccattcagtacatttagtgctggtaattaacatagggaccacagaaagaagaatttgagagtgcagatggaaagaggagtttagttttagatgtgctgaatttgaagtgcctgtggaacaatccaggtgaagattaccatctggaggtggaaatgtggatctggtgccctggagaggtgtgtgattttggaagttgttggcatacagctggcagttgaagccatggaagtggcctcacctaatgagaaatcacctaatgagagcaagtaaagttccaagcttggaaccttacagatactgatatttgagatgcagacacagaggaaaagaagctagcaaagaaaattgaaaagatagaaaagtgtggagaatatttcctgaaaagtagaggaagaggagcatttcaagaaaggaagagaacgtggtcaaaagtcatgagaaatgaggacttgagtggggcccatagtgaaagatgttctctgggctggtggagaaaggaaccagagagcatgggcttagaactcttgactgtgaagagaaggaagaggatgggaactgagaaagagtttgaagaatgaggcctgatggtagaagccaagggaggttgattaacatgaaagagaagagacagaaagatggactaaggtgggcaggggtaagagtgtaggagctgtccttcctagggagaaggaagcgaacagcaggttgtggtcatgattctggatagctccaaagaagtgagcaggggtgcacagagagtggaaactgtgacagaaggtgcccagcgcagtgccaaggccatggttccccagagtgcgtgaagagggagactgcctgtcaccaccctgcagggttttcttcccactgctccctgaaggccaggagctaagtgtcctggtgcctaatgctgttgactcagtgttgccatttgcagcattggcatcattgtgaagtatgtaaacattgtgttgtgtttgtgctaagccactccccactttctgcttcctgtttctctcttctctgcactcctaacctggaactcagtaccttcaagcaactttctgggttttctacctggtctgccctagagggtacatgcccaatatccctgtctttcctgacccccatcaaaataaccagtcttgtgctttataagctctgggctttgctgctgtttatttcctgagaaagtagagagaacctgaaaaagggatctttattagttctcaaataacgccaactagatgacccagcagacgcaagtgtggtgctgttagctgagcatacatgatcatatagtgctttcttctgctgcctgcttccctttgctgctgacctctgagatcctttcttgctcctcccttcccctgcctggactgcctgcattccctgctcctaagccagcccaaactcaaacatgatttacctgccacagcttaaccaaggaaagttctggaatatgtgccatttccagataaaggagctgtggtggtttgtttacaggacccgtgcacagcatacacattttataaaccacatattggtgtctgcatagttcagtaatttaagactaatgagacaaattttactctgtgacttgggaaatttccccaaatttccctcagttccttcagtgaaaagaggaggttggactaaatgatgtgtaaattctctcctcactctcagccaggaggttctgtggagtcataacaaattgcttgatcacatcttttggaggcttcaaattatgaatttaatcttaaaggaagagaaccttataaacattagcatctccctgattattctgatggctgatattatgcttacgtgcaatttcatataattatagtccccacattcatactcttggttcttccttcacactgttattattaaccattcatacgtttctatgtacatatgaattaaagtcatccctctgtatacacaggggattggttctaggaccaccctcagctatgaaaatccacacatgctcaagtcctgcagagccctgcagaacccatgtatgtatatgaaaagttgactttccatatacacaggtttctcatgccaggtttctctctttatatttaattataagcaaaaaatgtacttaaatataaaaatatgattataaaaaaatagaagatatattttctatttgcctttggttgaaaaaaactggtgtataggtggacctatgcagtccaaacccattttctttaagggtcagctatatatatttgtgatttctaaatatatgtatacattttacatttgtggatacatattgtatatattacatcacattgtccttacatttttacttctgatggtcttatagtagcccaccacttcacttactattcacataaatctaatttgacacaaatagtacattgtgcacacagatttggacctttttaaacttgtaaaaatatggagtacaatcattttgtaggttatttcaaaagaagatacatatgattttatttttgtaatgacatctctgacagaatgtcagagattctgagcagaaataactgtttaagggtatttgtaactagtacagaatattggtgaccgaagttatagaattaatttctagctcttttttgatttgtttgatgccttagactgaggctctccaacaaaaatataacagcagccacatatataatttaaaacattctagtagtaaaatatttttggcttaaaaactaaaaagaaataaggtgggggctgtggcgtgtgccatgcttataattccagctactcaggaggctgaggtgggaggattgtttgagcctaggagttcaagaccagcctgggcaacacagtaagaccctgtctcaaaacaaacaaaaactaaaaagaaacagcttaaattaaattgataatttatttgatctaacccaaaatattcaaaatattgtttcaacgtaaaatataaaaaagtaataaataagcaaaaaatataattaaatataaagcagaatatataatatacatatgtaaatatgtaatatataaatgtagttatataaaatttagatatatacaatatatcaacatgaaataatttttataactataaatacatggatttattaatgagacattttaattttttgttactaagtcttcaaaatccagtgtgaattttacatttagagctcatctgaattcataccagccgtatctcaagtgctcatattacatgtggctagtgtctgctatattggactgcatagtcttagatgataaagtcaatttatctgaggttattcttccataaaaagaaaatttaagttggtgcaattctttaaagtaagatttgtaagagccttccaagttttataatttgatcccaataaaatataaggataacatttagacctatgatttaataatgttctgtgctgacatcgaagggcgtagtattccttcacagaacttgatcgagacttttatctgattagggtgttccttcattcttcagcttttgaaattaagcttttagagaaaacaccaccataaatacagagtaaaatctgtatgtgaaatttgatttgatatttgaaatttatgtaaaccaaactaaataaaatcaaaggtgaatataatttatactgcaaacttttaaaattacttttttctttagcagaggtaacccatttgttctgtttctagtgttgttttacactttatatttttatctttctagatttcttttaggtttgtggtttgcaaatacctacctctttgttattactgccatgatttttggtgtagcacaaaattcaccatcgatcatcctttgaaaggagggctttaagcaaaagaaagaggagcaagacctagaccacactttttgtgagcagtttgagttttctggtttgtttttaatttgttttacatggatataatatttaaaaattttacaataatattaatgctgaagatgacattttagaaagtagcttggcaattttattttggtttctgttatatttgatattttcctttcagaaacatctcttggaatagatgaagagacagaggagagcaccaaattgttaactggctgatgaatgtttcattcccagcattcctctatgtgaacttgacctttaacctgatcttggacaagtcatctctatttttagaaccccaattttttaatcattgaaaaggatgttgtgttcattatctctaagctttatcttagatgtaaatgtctctgaaaataatttgagttttttatttttgtgactgggggcatcctagatggccacttgcctagtctactgttttacagatgagcaaagtgaagccagatcgctgaagtgatgactaagtgtgtgacatagtcatggatttaccagcttttatttatatcaaggagcatattgggaaaccttcaaaatacatactttaggaatgtgattttaatagttttagggagtcattaaacttaatcattgtatataacttaatcattgtatataacacctgagttcttttgaaatgtaaataaaacaatcatttaaaaatatctggctgggcacagtggctcatgcctgtaatcctggcacttggggagtccaaagctggtggatcacttgagctcaggagtttgagactagcattgggaggcattttactaaaaataaaaaaattagctgggcctattggcaagtgcctgtagtcccagctactgaagaggctgaggtgggggggatcacttgagcccaggaggtcaaggctgcatgagctgtaatgtcacaattgcactccagcctgggcaactgagcaagatcctgtctcaaaaaaaaaatttctttaataaaagaaaatatcctaagactttagttcattaacagaaaacacagattttaacagtggcttgcatctgtagtgttaaaataaaaactcaccttttagctaccatgaataagatcacaattctgttttcctcttggtgatatttgctgactcacaaaattaaaacatgatcccatttcacatttacttgtgaatttatgaaatatcaaaaatcattgcagaaggcacaaaactggaaacaggatccatttaaagttgtgtagtcactcaatcacccaggctggagtgcagtgaggggatcagagctcactgtagccttgtgtgcagttgtgtggaatgctcaggtaatcgtgtccacgtcaaaaatccaaaaggacaagctgtatgatatctcagaggtaggaaaaacacccattaaaaactcatcaaaatcgtgttactttaattaatacctagcttttgaaaagatggaaggctaattgaacttcccatcctccatgggaatgcccatttctcaaccacttgagaacaggatttgatgaatcaggattttaaaaataataattaatatggttaattatgcctggaggaattgttccagtttttttcactgcttctactgaaactattttaatatttatactcaaatacacttctctccataagaaattgtaaaaatcattattgacataagaggaagtgacagagacaaacatctaggaaaaatgatgaaaacatactttgcccaaaagaaatgcacagacatccaattatttttttaccttagtggctaaaacctctgacaaatcagtatttcccctgttcatcaggcaagtggaggaccccatgtgggagccctggctctgaagactattggctttgtgctctcaggccgtgttcctccctggatcacaagtcccatttcagaaggaaggggctttattcagttcttcctcatctctttctaggctctaaattatatgacttctgttttttctgaagttacacaccagagaaataaacccaaatacctgcatcacttcagatcatttgaaaagaaatagtcagtctaataaactgagtaggagacacacatttccacttctctgaagaaaagttcactacaattgagttctgtaaaattattgcatgatgtgtaagttttagtgtatggaagaacaaaatattgaagactggtcatatttccagatgaaactgatctctgaaataacaggaaaatggaatgaggaagaagttacgtaaattagtaccatgcaattggaagctaaatctgagagacatgtcaccagcttccaatatttgtgatggatagtccaaaaactaactccctaacaaaggcaggacaaaacatggtgcccaccgagtgtgaaataaacagcattgaatgtccatcctccaatggctagagtatatctaaatgctgaaggtggcacatggtgcttcagaggctggcccctctgtttcccctgttgcgtgtctttaaattataatgcacaactgcttacggttagttacacacaccactggcagttctgctgtggaagaatttgttcactgcatttcctctgcctagaataataccacttccctccccaccgcacttccagcctttgcctctccagcaatgactaattaagtcttagagactcagcccagaggctgtgtgggaagccagcattgtgcctctgttctgtgcccctcaaaccctggcagtttcctctgccatggcatttgtgccccatcacagggagcctgtagcatcttctgatggcagatgctttttttcagttatatacaaatagccgcaaaagtctggggcacatagtgatttataattttactgaagtttgattttaaagaattactctgcattttatcatatataaaaaactattggtcaggaggtcttaccatttatattccatgaagaaagaaaaatgactgacagttgacaaggtagtgactctaacacagtgatgatagaatatgaacagatttgtaccgtagattgtatggcatgtggtgctatgaagctggtgtttaggaatgagtgatttcactatgggatgtttctaatgtaccactttgcacccacatcattgccagactctgttctgttctgaaaagtgtgtgtattttcttttctttcgagaggttgagggagtggtgggcatcttactctgctgcccaggctggagtgcagtggcatgatctcagctcaatgcaacttccaccttcctggctcaagcgatcctcccacctcagcctcctgaatagctgggaccacaagtgtgcaccaccatgcccagctaattttttgtatttttggtagagatagggtttcatcgtctggtctcgaacttctgagctcaaacaatccaccctccttgcctctcaaagtgctggaattctaagcatgagccactgttcctggtctgaaaaaagcgttatttcttatgggggaaaaaatggccccctacttcccaaagaactgaagagctctaaggtaatgacaatttttatctagaaaatagaaatgttgaataaactaaagaggaaaatgacaaatttggcattgactcagatatgcaactcaagagattccaccatatgctcagtacagacaacaagaaaaagcgactctggactcagtttcagctggtactccaaccaacagaaaagctacccactgaatggaagagaaaaattctaccactaaagttgtaaagttaattaattggagacatgaatctttgcataagtaaaatgacgtgcttaggaaacatgattcaagaggaagccagttccatattaaaaagaaatagttgatctaataaactgacgaggaggcacacatttctgcttctctgaagaaaaattaactacatttgagttttaccaagttgctgcctgataagttttagtgtatgaaagaacaaggtattgaaaactggtcaaattttgtgggtatagaataccaatatagtggaatgactactgatcttagctttactctgaacaaggattggctcaagaattttagattctttgcataattcaaaagtaatcagaagtgccatcagctaacttcactgccttgaagaaatgcatagaaaaagttctaggtcagaacaagcgttcattgcagtggaagccagcttatgtggaatgaaaatgccttcctagattatatttccaaggagaagaatctggtatctgggttcaaggcagctagggaaaaactgactcctgtccactttgtggcaatgaatcaaactctgtacttaaaacctggcttgttttagcattctgtgtacctttgggtgttaggaaaaaactactatgcatgtcttatggccaagctgtccagcttgttcaaaatggcttgttttgttttttttcttttttcttttcttttttgatacaggatctcactctgtcacccaggctggagtgcagtggctccatcatggctctctgcagccttgacctcctgggctcgattgatcctcccatgtcagcctcctgagtagctgggactacaggcgtgtgccaccgtgtctagctaatttcttcttctaattatttttttgtagagacagagttcactgtgttcacaaggctggtctcaaactcctgggctcaagcgttccacttgccttggcctcccaaagttctgggattacaggcatgaggcatcacatccagcctaaaatggtttttaaatggctctagcaagtaatgacaagtgggacgattgctgtagtcttttgcccatctacacgggggaataaaattgaggactcagcacagcaagcatatatgaaaaggaaaggccaggcatggtggttcacgcctgtaatcccagcactttgggaggccaaggcgggtggatcatgaggtcaggagattgagaccatcctggctaacacggtgaaaccccatctctactaaaaatacaaaaacttagccaggcgttgtggcacatgcctgtagttccagctactcgggaggctgaggcaagagaatcgcttgaacccaggaggcagaggttgtggtgagccgagatcgcaccactatactccagcctgggtgacagagcgagactccgtctcaaaaaataaaaggaaaaatgagcatagttattgcacaggagcacaggatcccaacagaaaacctgaacaaagtgtccttccccactgttctctcaattcttcccacagagcaaggtggtttctcagtcaaatggatgtggctgagaacaactatggttttaatgcctggctttggaccatgaggtgaatatattgtaaccccatcaaggtgcagtctaggaaaatctaaagggattaggttggtagtctcagtgtcacctaagaagaaggtgctgacctcagcagcagttccacctctgagcaggaagttgcctttccttcacctatatttctgccttagacacagagcctcctcctcaccaactcattcccacactccccaggttgttatatcaaaattagaaacttgctttccattgatctattcatccttgggcctctgcttctttgagcagatcttaattattggtgcaactgctttgtcttctttgaggaaacagtttaactgtgaaacacaaacattcatgcgatcaagttgtgctgactgtgacaatatcttggcgctcacagtccatcagcatcttgttacttgcccttctttgcttatctcccaaggtaagatgaccacaagcagatctttaggacatcttttctgtgtcattaaaaagctggagatgtgacaccattctttctgggcttgtttcataagggccttgtggcagaagtggagaaatagcttccattgcagaatcatgaagtattagctaatcatagactttattcaattttacagggaaaatatttttacagcagaatttgcaaatttggggattcattaaggggacattgttatatgtcccttgcaaatgtcaaggctctactgattctggaaattatatatctgtctttactgcgaaacttgtactgttcaatatggtatccactaaccccgtgtggctcttgagtacttaatatggctagtgtgaattgagatttgctgaaagtataacatactatattttaaacttggtacaaaaatattagtgtaaaatgtatcactcatttttatattggttatatgttgaaataataatttagatatattgggttaaaatatataaacattaatttcactgtttttaaatttttttaacatggctattagaacatttaaactcatagtataattcttttttaattattattattatactttaagttctagggtacatgagcacaacgtgcaggctcattacataagtatacatgtgccatgctggcccactgtacccatcaacctgtcatttaaattaggtatttctccaaatgccatccctgcccccaccccccaccccacaacaggccccagtgtgtgatgtttctacccagtgaccaagtgttctcattgttctattcccacctatgagtgagaacatgtggtgcttggatttctgtccttgtgatagtttgctcagagtgatggtttccagcttcatccatgtccttgcaaaggacatgaactcatccttttttatggctgcatagtattccatggtgtatatgtgccgcattttcttaatccgctctaccattgatggacatttgtattggttccaagtcgttggtattgtgaatagtgccgcagtaaacatacgtgtgcatgtgtctttatagcagcatgatttataatcctttgggtatatacccagtaatgggatcactgggtcaaatggtatttctagttctagatccttgaggaatcaccacactgtcttccacaatagttgaactagtttacactccccaccaacagtgtaaaagtgttcctgtttctccacatcctctccagcacctgttgtttcctgactttttaatgatcaccattctaacaggtgtgagatggtatctcactgtggttttgatttgcatttctctgatgaccaatgatgatgagcattttttcatgtgtctgttagctgcataaatgtattcttttgtgaagtgtctgttcatatcctttgcccactttttgatggggttgtttgcttttttcttgtaaatttgtttacattctttgtcgattctggatattatccctttatcagatgggtagattgcaaaaattttctcccattgtgtaggttgcctgtttactctgatggcagtttcttttgctgtgcagaagctctttagtttaattagatcccatgtgtgtattttggcttttgttgccattgcttttggtgttttagtcatgaagtccttgcccatgcctatgtcctgaatggtattgcctaggttttcctctagggtttttatggttgtaggtctaacatttaagtctttaatccatcttgaattaatttttgtataaagtgtaaggaagggatccagtttcagctttctacatatagctagccagttttcccagcaccatttattaaatagggaatcctttccccatttcttgtttttgtcagatttgtcaaagatcagatagctgtagatgtgtggtgtatttctgagttctgtgttctgttccattggtctatatctctgttttcataccagtaccatgctgttttggttactgtagctttgtagtatagtttgaagtcaggtagcgtgatgcctccaggtttgttcttcttgcccaggattgtcttggcaatgcaggctcttttttgattccatatgaactttaaagtagtttttttccaattctgtgaagaaagtcatatggggatagcattgaatctataaattaccttgggcagtatggccattttcacaatattgattcttcctatccatgagcatggaatgttcttccatttgtttgtgtcctcttttatttcgttgagcagtggtttgtagttctccttgaagaggtccttcacatcccttgtaagttggattcctgggtattttattctcttcgtagcaattgtgaatgggagttcactcatgatttggctctctgtttgtctgttattggtgtataggaacgcttatgatttttgcacattgattttgtatcctgagactttgctgaagttgcttgtctgcttaaggagatttggggctgagacaatggggttttctaaatatacaatcatgtcatctgcaaacagggacaattagacttcttcttttcctaattgaatatgctttattgctttctcttgcctgattgccctggccagaacttccaacactatgttgaatgggagtggtgagagaggacatccctgtcttgtgccagttttcagagggaatgcttccagtttttgccctttcagtatgatattggctgtgggtttgtcataaatagctcttattattttgagatacgttccatcaatacctagtttattgagagtttttagcatgaagcattgttgaattttgtcaaaggccttttctgcatccattgagataatcatgtggtttttgtcgatgattctgtttatgtgatggattacgtgtattgatttgtgtatgttgaaccagccttgcattccagggatgaagccgacttgattgtggtggataagctttttgatgtgctgctggattccgtttgccagtattttattgaggattttcacactgatgtttatcagggatataggtctaaaattccctttttttgttgtgtctctgccaggctttggtatcaggatgatgctggcctcataaaatgagttaaggaggattccctctttttctattgattggaatagtttcagaagaaatggtaccagctcctctttgtacctctggtagaattcggctgtgaatccgtctggtcctggactttttttggttggtaggctattaattattgcctcaatttcagagcctgttattggtctattcagagattcaatttcttcctggttttagtcttgggagggtgtatgtgtccaggaattcatccatttcttctagattttctagtttatttgcatcgaggtgtttatagtattctctgatggtagtttgtatttctgtgggatcggtggtgatatcccctttatcattttttattgcatctgtttgattcttctctcttttcttctttattagtcttgctagtgatctatcaattttgttgatcttttcaaaaaaccagctcctggattcattgattttttgaagggttttttgtgtcttatctccttcagttctgctctgatcttagttatttcttgccttctgctagcatttgaatttgtttgctcttgcttctctagttcttttaattgtgatgttagggtgtcaattttagatctttcctgctttctcttgtgggcacttagtgctataaatttccctctatacactgctttaaatgtgtcccagagattctggtacattgtgtctttgttctctttggtttcaaagaacatctttatgtctgccttcatttcattatttacccagtagtcattcaggagcagatagttcagtttgcatgtagttgtgtcattttgagtgagtttcttaatcctgaattctaatttgattgcactgtggtctgagagacagtttgttgtgacttgtgttctttttcatttgctgaggagtgcttttttccagttatgtgttcaattttggaataagtgtgatgtggtgctgagaagaatgtatattctgttgatttggggtggagagttctgtagatgtctattaggtctgcttggtgcagagctgagttcaagtcctggatatccttgttaaccttctgtctcgttgatctgtgtaatgttgacagtggggtgttaaagtctcccattattattgtgtgggagtctaagtctctttgtaggtcttgaaggatttgctttatgaatctgggtgctcttgtattgggtgcatatatatttaggatagttaactcttcttgtcgaattgacccctttaccattatgtaatggccttctttgtctcttttgatctttgttggtttaaagtatgttttatcagagactaggattgcaacccctgctgtttttttgctttccatttgtttggtagatgttcctccatccctttattttgagcctatgtgtgtctctgtctgtgagatgggtctcctgaatacagcacactgatgggtcttgactctttatccaatttgccagtctgtgtcttttaattggggcatttagcccatttacaataaggttaatattgttatgtgtgaatttaatctgtcattatgatgttagctggttattttgcctattagttgatgcagtttcttcctagcatcgatggtctttacaatttggcatgtttttgcagtggctggtaccagtcattcctttccatgtttagtgcttccttcaggagctcttgtaaggtagacctggtggtgacaaaaatctctcagcatttgcttttctgtaaaggattttatttctccttcacttatgaagcttagtttgcctggatatgaaattctggattgaaaattcttttctttaagaatgttgaatattggcccccactcgcttctggcttgtagagtttctgctgagagatctgctattagtctgatgggcttccctttgtgggtaacccaacctttctctctggctgcccttaacattttttccttcatttcaaccttggtgaatctgacagttatgtgtcttggggttgctcttctcaaggagtatctctgtggtgttctctgtaattcctgaatttgaatattggcctgccttgctaggttggggaaattctcctggataatatcctgaagactgttttccagcttggttccattctccccgtcactttcaggtacaccagtcaagcatagatttggtcttttcacatagtcccttatttcttggaggctttgctagttactttttactcttttttctctaaacttttcttctcgctttatttcgttaatttgattcaatcactgatacctaccctttcttccacttgattgaatcagctgttgaagcttgtaaatgcgtcacgtagttctcctgccatggttttcagctccatcaggtcatttaagtcttctctacactgtttatttgagttactcattcgtctgatctttttttcaaggtttttagcttccttgcaatgggtttgaacagtctcctttagctcggagaagtttgttattaccaaccttctgaagcctacttctgtcagctcgtcaaagtcattctccatccaactttgttcctttgctggcaaggggctgcgatcctttggaggagaagatgcgctctggtttttagaattttcagcttttctgctctggtttctgctctggttttatctacccttggtctttgatgttgatgacctacagatggggttttggtgtgaatgtcctttttgttgatgttggtgctgttcctttctgtttgttagttttccttctaacagtcaggtccctcagctgcaggtttgttggagtttgctggaggtccactccagactctgtttgcctgggtatcgccagcagaggctgcagaatagcaaatattgcagaacagcaaatattgctgcctgatccttcctctggaagcttcgtcccagaggggcacccacctgtataaggtgtctgtcagcccctactgggaggtgtctcccagttaggctacatgggggtcagggacctacttgaggaggcagtctgtccattctcagagctcagtgctgggagaaccactgctctcttcagagctgtcagacagggacgtttaagtctgcagaagtttctgctgccttttgttcagcgatgcccttcccccagaggtggaatgtacagaggcaacaggccttgctgagctgcagtgggttccgcccagttcaagcttccctggccgctttgtttacctactcatgcctcagcaatggcagacgcccctgccccagctaggctgacacctcgcagttctatctcagactgctgtgctagcagtgagcaaggcttcatgggcatgggacctgccgagccaggcgtgggatataaactcctggtgtgccatttgctgagactgttggaaaagtgcagtatttgggcggcagtgtcccgattttccaggtacagtctgtcatgccttccctcagcttggaaagggaaatcccccgaccccttgcacttcctgggtgagaagatgccctgccctgtttcggctcaccctctgtgggttgcacccactgtcaaccagtcccaatgagatgaaccaggtacctcagctggaaatgcagaaatcacccatcttctgcgtcagccacgctgggagctgcagactggagctattcctattcggccgtcttggaatgtgctcatagtctatttctattggacagagctgatctatatttgaggccaggaagagtgactggcatgtactcatttgatgctcagtttatgtctgataaaccaaactgttgaactgaaatgaatggataacaattataatgattttttaaagtagcaatttaaatgctgtggatttggaaagtgatagagcaaaacaagatagattatgtcaggaaatcttaagatgtttattaattgtctctggtatgtagagttagaacatatataaaaagagatgttagcactggctccagctgccttctcatgaggcgttcagatgtaccctgcagagctgaccttattttgaccacttatgattcctttgctcctgtgcctatgatccagtagtttgttcaagaaagaccaatttccaaaaatattttccctgtgtgccatttagctgtggttctcatactttaatgtgcttaagaatgacttgcaaagcctattataaaactagattcccagaatcattctcagagatgctatttcactaggaaaggagtggggtctaggattctgtatattagtatccccggaagatttcaatgcaagtggctgttaaacaataccttgaggaacactgccgtatggtatcatgatctgggaatagcctggaaatctaggtagaaggggcaatttgctcagcaatttttgttaactataactataaataacacatactataagaacttacactatgaaggatttaaattaaaaggcattttaataagcaaaaattaattaaaaagtcatagtaaaggaaatagtcaacagagtgaaaagctaacctacagaatatgagaaaatatttgcaaaccatatattggataagggatcaatatctggaatatatagagaactcctgcaataactcctgcaaattaagttgggtcaataacaaaatgacccaatttaaaaatgggcaaaagacctgcatagacatttctccaaagaaaatatacaaatggcaaaaaaatatgaaaagatgcacaacatcactaatcagagaactgtaaaccaaaaccatgagatatcacctcacaatgcttcggatggctattatttttaaaaatggaaacaaacattaacaaggatgtggagaaagtgggacccttgcataccatcagtgggcttgaaatggtgcagctgctgtggaaaacaataggcagtttcctcaaaaaattaagtagagaactgtataatccagcagtccaaattctgtgtatttgtgcaaaagaattgaatacaggatctcagagagatacattaagacctcatttaatgtcattgatagttcttggaaactgcaactttaggcaaaacgacataagccatttttttcttatcaatattattatgaaacagtgttattctggacctgtgtatatcactttgcctatagttgcagcttccaagaacctgtcaatgaatttgacactgtatactgtgtttattgcagcattattcccaatagccaagatgtgaaagcaacctaaatatccattgacacatgaatggttaaagaaaatggtgtgtgtgtgtgtgtgtgtgtgtgtgtgtgtgtctgtcttcaacattgcatatacaatgcaatatcattcagccttaaaaaggaagtcctgtcatatactacaacacagatgaaccttaaatgcattatgctaagtgaaataagccaatcacaagaacacaaatactgagtgtttgcatttttatgaggtatctaaagtagtcaaattcatagaatcagaaactagaatagtggttgctgggggctgtgggaggggaaaatggggagttgttcaatgggtgtagaatttccatcatgcaagatgaaaaagttctagagatctgttgtacaacaaagtgtatattgttagcactactatactgtacacttttaaattaaaagaataaacttttttaccataataaaaatattaatcaaaaagtaccaactatcctaatagttcatggtgacattgaactcaagagaagaatatgataattccatttcctttgaacaccctctttttatgaaaaaatttgttggaaatttcaagctaactaaagtaaatgtgtacttacagtgaagctgtctgggtggtgagaggactgggtgttggtagcctctccatgatgcactgagtggagggcagagcttacttacttaccctgaatgtcattcccaaaagcagctcgtccagatatttggatgctctccacaaggaagagagatgttcactgcaggatgctgtcatatcagaggcatctgacactctggaaattctcttcttcctctctcttgtctgcatacctgaagcgtgggatttgcacatcgtaattttgtccccttgaaatgtttttaaatagcctaggaaagctttaatcactttaggagtactggttgccaggatcctttctgagaccaaaggagaatgattggattgattttgtgaagcagtctgggcattcatatgctgtgagcactcactctggcagctagaggttttgcctctggccagtgaccattcctttgagtagtgagctttctgttctttccagtaactgctggcaagtgggctaatgtggctgggctggtgggccctggggtgggctagcttccatgagtggagcaaatggagtaagggcagagacattgactccagtatttactaacgagataaatatacaaggctaggctggtagatacctattttccacctttgtgcccttcttgctatcttattcaagcatatcaacccttttttggtttttatttggggttttaaaattttgttctatttttgtttctatttttgcaatgtgctggtttgtttctttaaaaatgttgattataaaatatttcaaatctgtaaggaggcatacagatgcaatatattcaccacctagcttcacaaagagaacactatgtgtgcacttgaagctgctgtatatctctctcacatcacatcccacaccatctcctgccgtggtctgctgtctggaacttagtgttcatcattcctaagcaattctttataccttcaccttataatattgtatacctcaacaacatatagtattgttttacatatttttaagctttatataaatgatattatattttatgtagtcttctgcaacctgctttttcattcaatctgcctgttcactttttaaactttatttggaatatttcttccagtgttacttagctatattgttgtcatcaccagtgtgcagcattactgtgtaacagtgttagaccctaaaatacagctagaaatggcttaggttgaaggcttttatgtgtgtcacattaatatgtaactataatatggtgtgtaactattaaacatatttgttttatttcaggttataatataacttatcctctcatgcttttttcctgccccttctccccaaatcatcaacaatagaagaagaagaaaacatgtcaggacacaaatggtaagtaatttgtcatcttttctgaattgggaaagtagaaagcatatagcatatgatcaataaacatctattgaatggaaaaacaagagatacattggcagtaagtatcatgttagccctcaccaatgctgagccaaattcagtatctctgttaaatatggtgtgaaaaccaagtaacaaaaatattgtaaattcttacctaatgtgcattctctaagaaattcatttatgtgtaacttttctcttgggaacctactgatagtttttcttaccaccattttgtctaatgtaatgagttgatgcgtttttattactatcttatttataacttctaacattagagttacaagggaattttatgttagggtagctataaaataaagaatgattctacaaccacacacgactcgtgcttattaatttagagtcatgacttcaaccttcctgaacattcaggagccaattattgtcaaaagtaaatgatgctgaataaagtagatgtggtaaccatttggcaatgttagcgctgacatttatgtgcctataacatatctgagcagcatgttaaacctcttgtaaggtccagagctcttcaagcagtgtttccaaattcttttgaacccatgacccaccaagcaagcagatctttgtgaacttttattttctttaatttgtatcatgaaaaacaaatgtgttacatatttttcaaatgcacaattaattataataatacattttttttttttgagatggagtctcactctgtcacccaggctggagttcagtggtgcaatctcagctcactgcaacctccgcctccctggttcaagtgattctcctgcctcagcctcccgagtagctgggattacaggcatgtgccaccacgcctggctaatttttgtatttttagtacagacggggtttcaccatgttggccaggatggtctcgatctcttgacctcatgatctgcccacctcagcctcccaaagtgctgggattacaggcatgagccaccgcgcccggccaaagaaatccattctatggcccactcttgagaatgccattcccctaaaataatcagtctttggagtgtatccttccaaccttttaatgtgcatattctatagagagattatcttttacataagttttatacattatcttattttctctgatatgagctcataatacgacttttaaataatgcagaaagatataaagtagaccatgaaagtctcccataatcctacttctctctccaaagataaccattgttaaggaagtcatcagaaatgccttctggctttttaagaataaatgtgtaaattgaaaattgtaaacttaatgaaattgtaaatgaaggaaagtaggttttgagatactggtattttgatatagtcatataaacaaactcacgtttcagcacaagcctggcacattttgggtggtgatgggatggggtagaggaaagtacatctccacagaggagagttgcctgggggggtcaggggagcctttggggcagggactctaggtccaaagaggatgtggacgaagcaaggggagggatggaactccatcagcaaactttccagccatatttggggtactccaatcacttttacacaattccatttcattttcaattacttttgtttcttttctcttttttcttctcttttttcttttttgagggacagggtctcgccccgtatcccaggatgaagtgcagtggtgtgatcacggctccctgcagcctcaaactcctggacttgaacaatccacccacttcagtctgctgagtagctttgtgtcataggcctgtgccaccacacctgactaattatttgtagagatggggttttactatgttgcccaggctgatctgaaactcctggcctcaagcagtcctcctgcctgggccttccaaagtgctagaattaaaggcatgagccaccatgcccggccagtttctaattttttctccacatactttttgatttgctcttcactgtgatcctcctgaaaaatggcttttcatctatattttaagcatttatatggaagagtttaaagtttttaacatcagaagcctgcaaccaattttaaatttattttattgttattttattgtggtaagaacagttaacatgaagtcaaccgtcttaaattttaggtgcacaatacagtattgttaacaataggcaccatggggctgggcgcggtggctcatatctgtaatcccagcagtttgggaggctgaggagggcggatcatctgaggtcaggagttggagaccagcctggccaacatagtgaaaccccatctgtactaaaaacatacaaaaagtagctgggcgtggtagcatgtgcctataatcccagctactcaggaggcctaggcaggagaatcgcttgaacctggaaggcagaggctgcagtgagctgagatcacgccactgcactccagtctgggcaacaggagtgaaagtccatctcaaaaaaaaaaaaaaaataccaagaataagcaccatgtcacacagcagatctctagagcttattcatcttgcataactgaaaccttatgcaccttgaatagtaatttctcatttcttcctaccttctagccactcgtaactgccattctactctctgcttctgtgagtttgactattttagatttctctgtaacagatcttaggcatgctgttcttcagcctcttatctctgctttcctgccatcacctcagtgttggctgtagtgttagagtggagagagtgtgttggtgtctggctttatctctgactcactgaggtaacttgggccagtcaccctgcctggcttgatctcactgtctccacctctaaaaggggtgtgcttagtctgttatatctacattcttttcaagggttagtttctttatttcctgcaaaagattctaaatttctccactctgacttttaaggtttttgagtcagaaagagttgatgaacttccttggtgtaacacccagataagaaagtgctcatacgtttatcaatgttgtaaatgtaaatgcataatggaaagtcatgtttaaagaaatcatttcacactaaaatatcttaatctttatgaaaggtgtgaataaaatagttctttaaatgtttttagcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagaggtgagctctttattgctgtcagccccaacacagccaccttgctaggatcaaggtcctagagtatactcactgaggcagagctgggtgtgctttgtatttgaaaatgaggaaaatctaggattaggtaaactcaatcccagcatatttattaaaacctgcaaattctcacataaccaccatgcctcagttactctgtattttaagaacatagtcgccatgtattgcctgtggtaaattctcagtaagcgtttcttgggaaaaggaatgcagtcaaagagctgctgcttgctggtcagagctgaggagtcagatttagaacactagaatctggcaaatgttaaatttttttaaaagaagaactcaggtaaaacgtcgtggaaagtagagtctaataagttttgtattggaccctggaaaattctaaaatgaataaggagatatttagttagactagttaacaatatagtaagctggatttagatatggttgatctagcatattaatataagaaggcccactaactaactccctgtcttgctggacatttctgccaatagtttagattaaaattttgaaagcatacctatcatttctataaataacagggcactgagaggaataatatcttagatggtctgataaggattcaaaatgaactcagattttaatatatacactaaggttaatgaactgaacatttaatgggactaaaaaagcccaagatttcaaaaagttttcggagtgtccagaatggtggaaaccatagttattctacatcagagagggttaaggggaaatgttagttgtcaattactgtcatgtgaaaagggatgagattgattctaagcacatgagggtagaccagacccaggaagaactttgtaatgttaaggctgccccgtgagaactgggctgcctttgaggttaggactaaccctgtgagatggatctgggctactattgtacctactatctgctgtaactttaggagaactatacccagtttctcatatcctcgttttcttaatgcatgaaatagagatattaatacctacttattacagctattatcaagattaaagtaggtaacagagtgatggctaaggtttattagtgtttataaatattatactaacatatttataaacatgactaatgtttattaataattaatgtttatgagtgtgttttatgtctcaggaaccatttagactgcattccatatggtatctctagtacatagcaaagctcctgacccactggccctgcctccccatcctgcatttcctctctcccacacgcttacattgccctcaccaccagccagctatgatggccttgtctcagttctcagtccacaaccagccaagttcacacccatcagagcatttgctggcttccacctggacactgtttccccacatcttcccttctcatagttcaggtttcagcctaaaggtcacgctgtttcgagtcactgcctgtccacccctgctccccacctaccccacccctgctcactgtctaacacctggccatgttttattttattcgtagtactcatctctcattgaattatctcaggtgttcatctgtttgcccaccttccctccactatgagatcaaattccatgttagcctattcacgacgtatccccagccacacatagaatacacattcaataagtaccaactgaataagggtatgtgttagtgcaattaatatcagttctcagccctttccttctgcaattggaaattttgaaatagaaactgggtttgacaaggatgttctaatggagatttctgcaatggaggaaagtagaaccaggaagcatctgtttcgattgttatattctaagtacagtgtaaattattataagcatatatgctttttatatctcatagtattttcttcttaagaacctagtaaatacatgcattattcaaaaggtaatttaatatgttaattacaaatatattaaacattatattttggctgaaccaaatgtaccttaatcaaaatagctgctgtcctaggtatgtagcatccattgtacttagctgtgacaaataatttagcacatgatagaggtttctgttgcagaaatgttaatactgatgttgatgtttatagagaggatggattccatccatgaaatatacaaaaatgatgtgaaaacctctttgatgttcgtaccttgagttatccatagaaggctaacttataaaccaagaagttttattcttctggcacagaaaacttgtgttccaagctataatattggtcagattctattgcaatctgttggaaagttaatatagaaatattgcgctgagttttaatatttgtccacgttgcttgctaatgaaatccttttctgaaaaacagctcttcagtacaataacagacaaaagtaatctctgctgacagaagtcttcttgccagagtcactgtgccacagcagagtggactgattagatgatggaaatgtttcttatcttgccttgggcatgattatgttagtatatataattgtcataactcacagaactgaacactccagagctgtgcactgtagtgcatttaatttatacctcaatttttaaaaagtgaacagtaacaacagaacaactcctaaacatactttttgaacgtccttgctcctatattcaggaaatactatgtgttagtgggttttgatccagaatactgatataaaacacttgctaagggacagattcagactgctgattttctcttttgttttatggctctttactaaacaggtggaagatgcaatttaacaaaatgagaattagcaaatttatattctttataaccaagttttatatgaagcattcctagaaatggtttaatgttttaagtatatatgcatgcatctgtttttattaatttagtcatatttataatgaaacagatcatctgtgttcacgcaaatgtagaagtgctttatgataccaatatataatttctgcaccaccatagccagtgaactaggagagagaaagagggaaaaccttgccctgccttactgagtggctctacagaggcaagatgtttatcttccaggttttctcattgataccatatctggtccctaagttagtgggcaaagggtggagaaagtgtgaagtctgttctgtcttttcttgagctatctcagtttctgaaacaaaggctggaaccgccacgcattgaaatcaagttagattcttctcagcacagccccatctgcctatcccccagtttccgctagtatggccacagcatggcattatattttctctctgtatggtttatgaaattgttgggaaaataaggagtgatggggactgcttgcccaacatcattttatcagatgttttctaaatagacaggacatccagctgattgattttgtttgctttatccagttgtttaagcatgccataaaatacattaggatcacaaaataagttaacgtcatcttttaaatatgcttaattgacagatcccccattaaaaaaaaaccacagcaagtggtgaaaggaataaatttgattatgaatgaatattgggtctctggtttaccaagtcctctaactaggcccttcacttaggatgtctgttttttgtttttcagctattatttcagtagactgggagaaataactgttctgcagatcttaatttagatcacagagatgatgaattccaataaatacagaataataggagatatttaaaggctttggtcacagtttctgtatagtacaccgcataacactaagcatacttagacatgtggtcttgtttttggcaaattgaacactctggttgtgttcaatgtaattattttttatctcaccactgtctgttttattttgcattttgtttgtatttttattacagctgtttcattcaattcagagaacctgtctggacttatcgaaagcaattgtactctatcaaaagaggatatgttgtaagtatgacatcagtatgaatattgatcaaatagtaagaaatagcagggtattttgtcttgatacatcatttcatatgcttaggaaactaagagtgtttgtctgtgtcttcaggcgttgggaggagagtctctaataattttaccaataatatacatagcttatttatctttcaaagcaagtatcatattaggagaattctgtttggatctcccatggatatggacatgccatttattttcccaattataaaagagttttctcagtttgtatcttgggctttttaccttcaggtttttttttaatgtgattatcttcactctctgatatccaattttgttccttttaagataagagacagaaggcacatacagttgatttgttgatgacattttgttgacaacatttcttcatgaatgttttttgcattggatattaggttcctacagaacaatattttcatatagtcacactgttttaaaagcattaacaacaaagttatctctgaaatactaaatatcaattatgtgtttgtacatttttaagtttccatttgtaggtcattttaataatataatgtatatatttttgagactagactatgggaagtctttctgttgctgactgctgccaaaccccttttcagtaatcacaaattaataattggtcatttttctacatcagtaatattttattaagacaatcattttggtaggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaaggtgagatctcttagaaaaaaaaaaaaaaaaaagacaactacttcaggaaagtccaaaatcattgtatgtagaggcagtattttataaattatctatgttagtatttcctaagtgtttgaggtaagacttctccagggctccacctccaggtcttgatctgtgagcaaattaagacacatgaccgccactcccccatttatcttccccacattcagtcagtctcaaatgctggtattttgcctcctaaatagctcgcagattctccttcctctctccatcttctctgccactaccttggttcaggccaccaccattagtctctcacttggtttactaaccattttcctcactgatcttgcctccacctctgctttctctagcctattgtctgcactgctttcaatcaaagtacacttttaaacccgatcagattcttccttggcttaaaccttgtgttctggaaactattggtcaaactccttcttactatacccaccatccccctagcactcaccatgaaatgaatcattttcattgttatggtagaaaacaaaataatttagaaaattgtaactttatttttttaagtaagtcacatgaagttggtgtgtccacttttcattaaacaatatatattgtaacaagggaagaaaagaaggatgcttgcatatttcctgtaaatagtgattctctaaacagaaattatgcttcctacgtatattagtgtttctaaaagaatatagaggaaaaacttccccctaaaccacctcagattagttaatagaattatagttgaacaccatgaaggctcataattatcttgtaatataaagggttagaataatgtccccaccgttgaagcagtcacctggttgtgccagcagagctggctgtggatggtagataagcccttttatgtctacccgctaagctcacatgagccatgccatctcagcagagacaggaaggaggagttctgccctgtgtggacttgaaagagatcccaactttgatggaagactaaaaatagtgtggttaatttgaggatgttgctatgtagctgtcaaagacacaaaaatgaggaaaatctgtgaactaatatggagtgatttggaggatatgcttttaagtgaaagaagcaaaacataaaagcgtatctatagtatgctatccttcatgcaagcaagaaggtgatataaaatataaatgtaaaaaaaggtaatatatggagagtgtgtgtattaccatttttttacattgcatcacattttaccatctatatctatatctatatctagagagcaagcctgctcattgtgcaaaggaaatttaggaaggataaaccagaaacgaaagagactggataccagtggtggatgaggagtggggaagggttggagaggagggaatgagaatggaggagcaaaggtgaagagggagctatgagataccttcccatagctctgattcataaaaccatagtaacatttcatagactcaaaaaatacttaaacccagccagatgtgggaaaatctaaaatggaatacaaacagtagcaaatgaacctgattgcattataaatgaataacattgtcacagtgatcagaatcagaaaaaaaaagaactaacctcagtagttttggaacataattatttttaactagatactgaggctaaacacaaaaataattatacatggaagccgtactctcattggtaaatttgtttcttataggaatatgggttagcaatgctgaaactacattatgcaaatattgaagttgaatagataagatattgcagatgatgagagccaggtttctcactctgtactttagaaagaagttacagataaaaggagaagctagaaggaacactgtggtgttgcactgtcatcaaaggtgccactatgaagccattgtttttaatatctatacagatagatacatacagaaatagatgcagatgagggtgtatgcatgggttagtgtacattcatatatttcctgcttctgtgagctgacatgacctagaagcactaacgctccatagcagtgagtacatctggcacccagatcttgctttctaaataccttttcccagtaaaagaaatgctccttggagaagtggttgattctaggattggggcagggaaaattcaagatgcacctatattgtttgtagcactagaacataaggaagtgcttgaaaaaggatatgttgaaaggacacaggtgcaaacctgtgatcaaagctggcacaatttgagcaacaaactaaataatgacagttttgaattataacccatagaataaaattaatttcccttaaatctatatgaagagagagagataaatggtggagaagggacagctttttctcataaaataatttcagttaattaatagaaagaatgagggaactacaaaatcaccattaggcaaacaccacagtgagaattgtgacaggtgagattcactgaagagtgttagaattagtgagtgaaagtttgaggagaaaatggacatttgcattgtctcatgtattcccccgaagatctgtaatgattacaaaaggaaaaaaacattcttaactttgcagtggagaaacccagcagatacctccttaaccaagtggttgagcttgacatcatgagtgatgaggaacactgatgtcatgtaacctctgatgctgtgcactaagaaagacacttcaccattgtgtatccttcccaaatatctgtaaccacagtctaattctgagaaatcagacaaaccaaattgaggcacattctacaaaatatctgaccagtactcttaaaatatgtcaaagtcatgaaagataaagactaaggaacggtcacagatttaaggaaactaaggacactcaatgttttggtgccaggtgagaccctagattggatcctgtaacagaaaaagaatgtcaatgaaaaaactggtaaaattcaaataagggctgtaggttagttgatagtattataccagtgttaatttcctaatgttgattattgtgccatgattatgtaaaatgtaaatataaggggatgctagggaagagtaagtactaggggatgttagggaaatgtatacaggaactctatatactgtttgtaatttttctgtaagtctatcattatttcaaactaaaaggtttaatacatgtaaattggatcacattgctcccctacttttaaaagcctccaataacacataaaatggaatccgactcccattcttatacataggacgtgatctggccccagttcacctcttcagtcaccttttcccttgtccaccaaactcccaaggccttttgcactgggtgttcctgctgcctggaaggtccctgctctcatagtcccaaggctatcgtcattcagaactcagcctaatggtcagctgctcagagatgccttccctgattaccttgtctaaggcacctactgaccgctcactcttaactccccatctctcattgctctgcctggtatttttcttttttgtgtttcgtgtttgtgattatgttttattttctatctcctgctgcttgaatataagctctgtaagtgtggggaactcctttatcctcttcatcactgtattccagtggcaagaactgtgcctcgtatgtgttggatcatccataaatctgtgctgagtgagttaatgctgtccagctaattaatttcatagttccatagttgccttgtttttaacggcacatctgaaaacctaattagcaagtaaatataaaaatgtttttgtctctgaattctcaagtcccagataattgaaaccttattaatagaacattttgagttatctttttttgtttttgctttcttcttgtaatagagacaggggtcttgctatgttgcacaggctggtcttgaactcctagtatcaagcaatcctcctgcctctacctcccaaaagtgctgggactgcaggtgtgaaccaccacactcagcccttttgcgttacctgatacctatgttatacctgaattttaaacttctgtaagttaatttcagtatttgaatttttaaaattaaagaatgaccatcccttctcagaaaatctaaccttgaccctgatggagctcacacttctttccactgccctctgagtaagtattgccaagtaatcagagtcagcacctaaaatgaaacctgtttgctgccccaagttgatccacaagtgcctaaaatgaccgaaaattatttttaaatgtttcagcctacttaggtttatttaggaaagagtacattttgtcaaccatgtaattattcaggtaccacaaattggtttcttcctagccttaagctaaatgcattcatttgtatgtgacttgagacttcaaggtaaaaagggtgacagtagcctcacacgattaagatcaaaaatgagacattgctttccatagggaaagattcattgtggaattgagtgaggcacatattaatcagtggggaggagaaggaatggaatgtattaaaaaacaaaaaaccttcttataattataggaattttaaaaagctacatagaaccatggcgtgagtattaaaaggcaataagtatttcaactgaaataaagtgtatgaggataacaaggcaaaattgtagtcaattcaattcacaagcatttaattagcaccgtgaatttaagactttatgctcagcctggggaatacaaagtttgggtgagatccctgtcttggaaagcttagagccccctggggaagagagacacatgcccagtcacacaaggtgagtgctaagtcaggtgcccagagagcactgctgtccggagaaatagggatcaattgcttcacagagaaaggaacctgcgagcaggcctttgatggtgaacttgatttttgagagacagaagagaagcagggtcatcatttatctctcaggaaaaatggattctaaaagcctcttcttgactgggccttcccaagggaatgtttagggtgaaactatagtcacaaattaataaggtagcagtatcgagtttagccttcacctttggatttgtggttcctgcctaatgtcctacaattattgttagtgagattatgtcaggaatgggggtgcattcttaaagaaaagtgactggtttgtgaaagctgacaagaatcctagtagcatttagaaagcagttttagagacacagggtatgtaaatacatcaatacagaaataggaaataaaagtagtgttcaaagtatgttgatagtaaatgctgtgtttagggggaaagcacatccgaggaagctaagtgtcactctggtgcctgtggcttggctgctggtgtgtgttcaggacccccactgtaccattatgtgggtatgctgtattttattaaactagttcctagtataaggagagtgtttcactattataaataatgatgctatgattgtttttgcatttacatctttgtgcccattttgctacttccttaggaagttctcctaacagtagacatggagagtccaaagatacatgtaattctatgattttttaaatgtttaccgtcaaatcagtctgcagaaagcttgcaccaaatcacttacccaccaataataccatctgaggttgtctttaaaaataaggccaagattaggcatcaccaattcagatttggttccagctctgtatttttaaaacccactgtcatcaacctgatgacctccccaccctccgtccctacccccacttccaaccaaaaacctgtgtcacagctgaggtatttgaattgctttacaatggaatagaatgtaactcaaaaagcagagatcaaaagtcagcaggagagaataatgagaggcagctagcactgcatcctaggcagccacaaaagattcccacagtcatacttgacaaacccaactcctttatttcagctcgaagccgcacactatgggcttacgtttcagtacagaggtcattttctagttctgattacagggcaccaaactcactgacagatgtattcaagtgaatttgatctctcgtattgtaaatggaagaacagcctgaaagttaaatggggggtagggggagcttaccctgtagcctgccgcttagatttaatttcatctcgtcttcgcctctggaagagagaggaccttgtgatttgtctttcttgttccctttgcaatcaaaatgctcattgttcatggctccttttggtcttttcttcatcagtcttgtctcaagaagaaaacgaactgggaaaatttcttcgatcccaaggtttccaagataaaaccagagcaggaaagatgatgcaagcgacaggaaaggccctctgcttttcttcccagcaaaggtgtgtggcctttagtggggttctatctggggggatctgaggagactccgggacccacctactcacgaaagggaatctcacagtgttctttagaaggattttgcctgaggctgaggagctgctctgtactcactagttaggcagtttgtacttaactctctaattaagattaacacataggatttttttttcctccctattaattaaaaaaaattttttttcatttttctgttggtctgtaggggcattatatatgtcaatcactatgagtgctgtcctaggcttatgtttgaccttcagtgttgcttgtagcaatcagtctggtccccttccagcagctgattaaagcaggagcctaatgagaccaggttgaagggttccctctctgctctctgtggaccaattaacttcagagaggtgctgttctcatgcccaggtccacactgctcagaccctggaccataacccgggagtgtgttagaaatgcagaatgtaggccctaccccagacatgcaggatccacatccacattttaactagaccgctgttgttttgatgtaaattcaagtttgcgaagctctggtacagggaaaattgtggtagatgagtggcatttttttttaacacaaccgtgactcatttttatggtggatgttaaataagcaggagcccctgcacacagtcactctctgcgcctgagaaaagtgacactcctcctcgttcccttctctcccagtaactaacaaacccccaaaatgtcactcactagtagtaggcagaatgtaggtagttcccacaaatattcaagctatagaaatttcacttactcaaattgtccaacattttcttctgttaatgtctccttgctgctttccctccgtgtgggccaagagcaggccagcagcatggtacatggttgttcctttgaaaacccaagaaagaggaggaaaaaagagacctgctgtgtctgtttttcagtgatgccttctcctgggcattttggttcttcctgatgacatttggaccctgactttgggggcaatgccaacttttatgcttgaatgaaaccatttctagtagttctccacacatttcccaagaaaggtatttgtttatcatcttaaatcttaccatttagtattatttataatttttctatgtaaaaatacatattcattctagaaaaattttaaaatagagacaaaccaaaaagtgaaaattaaaaagcaactaaaatttttactaataaaatgatctacttttaacctcttaatagatactttctgtgcatataggaccttttccaaccttgcaagaataattgattcctaaaaaaatatttcatagagtaagttgtcatgtgttaaacatataattatcactaacttcagtgagaaaaattcttaggcaaaggaagagaaacaaagaatctagaaatgaatagaatagttagggagatagctgaggactcttgatgtctttaagtagaagtcatcagttacacaaaccttcacaccagtgtttgttttacagacttatttggtagtcattgcaacagccatatattctatttgatgaaaggtgagtattaaattaaaccaacagggataacaagcttactttatggcacaacaatgtctttgaaaataatctgcaacatctaggtaggacagtgtgagcaggttattcttatacaagtactcaatatttaaaaacaatactttacagagaagaagaaaactaggggaaatagtaaaaggaaattttttcttaaatagttcattgcaccatttgtaatcttaccgtgctacacgcacgtaaggcattgcagacgttgatggaatttccaaaagctgacttcagttcactgacaccattgttccctttagctaaataagtttgcatttaaattgaaatttaaatattcattttttggcacctgtgccctgaaacttcatgaagaagagtatattttaagagtataattcatctgacattgctcatttttgggtagggagatggaagaagcagtgtttttccccaagataagtattttatccaaagtttaatatgccttaaatgttttttggctgggtaaagggcatatgttatagccaacattataataattttacacctacttcatcactttcatttctggtatagtatcctcaaggtttttttaacaaggattaaatcatgtaacctatctgaaagtgctaacacacgacagcctctcagtaaatgtgctggtcccccttcctataccatttcaaaatgcttctgctcatatttcattcctctgtgactattggagtgagcagcagatgccttggcctttggagagtgatctaaaatggcctagtcggagagatgctaatcacatacgctccattcctcctcaaagggccaaatgtagaaatgggcagtggtcatgccttggccatcctccatgaacacgggattggccccagcttcaaatgagcactcagcccaggctcaagaccacccccaacaacgcggatggaggtgcttgccagtggtccagttagtagcagtaaactaagggatgggtacatggataatcttctctggctgactaatcagttggaactacatgcatttcgattattattcagcaaatattgatggagcatcttctacattccaggtactgttctagactcacgagtctaagattggcagaatgtcaaggatttaaattgctcactggcttagttttgagagtgtggctttgtcctcttgtctaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtaggaggttttatgagggttagcagaaggggtacctgctggaaggtaatgaggtgtgatttgaatccctctggtgaagaagacataactcaaaagcaccaaggatgcaattaatcatcgctggtgtctttttatgtgacagaataccaattaatgtgatacataattctctaaaggataagatagaagagacagctggaaattgctgggatttcataactgcttttaattgaagtcagattttcttataatgtgcactttttgtaagattgtcacatttaaatgccttttcatgcataactaaaaatcaagattagatcaaatgaatctgggaggttagaacagactactggggaaatcttttaaaatcgctaatgcatattaaaattaatagaataataatgctcctttgttttgcgatatgttcagaagcagtggggtttagttgcagggttaactcatgcagcattcctcagaaatttttctgaggaaaatatgtggctgaagagatggctatgctcttaaagatttggatatgcactgaaagatttggtgagcagtaaagaacaatcttgttggttttttaattgtgtcaatttagcagtttgattttgtcatacaagaatacatcacaccactaggtggcagtcttacactgaatatttatgaaaatgcagcgagatttttgttgtgtacaatcttggtagttctttgtttggtcgcctggatatatttcagagtgtgaaagaaaaaagaatcagccaaatgttaggcttgacataatattgtgtcaactgtcttactcacttcaaatgatccatttgtaattgtgatattgcttaaaatccctagatttcttattatgtacattattgcagagctacaaatagaaccatcacttgcgttggaggttagctgtgtagaggtggagggaaggagggaccttctggtccttaagaatacggtcaccaattcttgacctagatatagattgatttctttaaagtcaagttttatcttggtttgtgatttagaacccttccctctgaagagaaagcagggtccattttatttctgatcgcagatgttcttcatgtgtcagcaacatctgacttcttcaaaaggtaggcttctgaatcatagaaaatcaggactaaaaaggctgctcatgatcctctggtgaaactcgctcatcttatagaagagaaaaatcaaagccccaaaattgtaaataacatttttaaaggattgctagctagatgctggtgagcccaggctacttttgaagttttctaactttctaatcaggccaataatttggtttgtctttagcactttatttgagggttgaggagaatgaagagggtgaaaaaaattgcctgcagggcagagtgcttatcatttgtatctgttgcctcctttactcctcacaataaccaagacaccgattttattttataagcgaggaaaatgatacccatgttaggaaattagcccaagatcagagaggtaaatgagagtcagaatcattcaaaatacacataattttcttctctaagagagaatacctaaaattgaaaaaggcctttcatactaattcctctcttgtgatttattcactcaattaatatttattgaacacctcctatgtgccaggtaataaagataaatatatgattattctggaaggcagaagaattttatgtggaattttttttttggttttgttttgtgggggtggttactaactgtaaggacgaaataaaaaccaagcccgttcgtcatttggtttgagtgttgaaacattacccattccttggtgtcatcagtctgttgattttggaaaacatgtttttttaaaaaaaaatcctttgccatgcagaagttgctgaagccttactccccaatcccatgtgtgctggattcaatttaacagctaaacatggtgtacttagaatctttttttaaataagcctgtcttcaagtgtatatttgattagaccagactctccacaaggacagaaaccatgttggggatcttcacagccatcaccccagggccagtccagcacttgaccccaaatgagcacatacataacagatgacaagattccaggcactgatttggaagtgccacacccatgttttctcaaacctgtagggcattcccgccatttgcagctgacctcatgatgttttggaaattgacttatgtggttttgcaggtaagaagttgcgttattaatgtgaggcttgctgccctctttagaatgaatttaaattgtggagttttcccttcacttggagtttacaacatgacatttaactttgagcaagctttagtgttttgtcccagtaggattccattttaaacagagtctccatttctctcccagggatgtgttacctaaacgtgtttctgagtcatctaggagagctatccagctgcaagtggctcctcaggagtgactgtgggagggggagtttcagtctcctcggggccggctgccaccttcacgtcttaaaggatgaatcctgagctaaagtagtattttgctataaattctcttttttgagttcacactttctggtggagacaaaattctaattcatacctcatggatgtgatctccctatttggattccttagtatccactcattcatttatttgtccattcaacaaatgatattgaagctgggccctgttcaggcagcatccaggggaatacagcagtaaggaggcagattgatcattgccatcttgtcttgtgcagtcatctgtggatagagcaagtaaacatagtacagcatggtgaacagtagtgtctgtggtggcgcatggtgaacagtagtgtctatggtggcacgtggtgctgcaggagctcctggaaggggcttcctggaggaggtggcactaaacaaaatgtgaaggatgggtaggaaagagctgggtagaaggagtagaagcaacagagcagcattcctggctgagaaagcaatttacgaaaggccttttaggggaaaggagcagcgtgcttagaaccagagcacagaaggtgaggtgagtgtggagatgggggtgccctgaccatggggttagaaagggagacaggactggaatagaaaagacaccgctctaaggggacggagtagtgggagggtgtagggaaggcaggaggcatgatcaggtttgtgttctttgtaaggtggagaagggattgcgagggcctaagcttggaggctgggagaactactgggaggcttttacacaaacccggatgagacataaggtaaccatgaaatgaagggggaggtagaccagagagaaatgggctgttctgacctctaccagattccgtggtagcaccactttaattgctgagctcttcattgtctttagaaataagtagaataagcataaataaatcgcaagttcaagtgtattttcacttccaaccaaggcttttttcatagtgtcttcagattgccaagaaaccttttaaatagcacacagtgagcatgactgaaatgatgaatgaaaaacctgaagttaaacaaagcaatctgttttccttctggcaccctgtgaagcacagaggcctgacgacagagctctcaacatcaacattaagagcatttattaagtgtctgtgtcgggggtggaaatacaaagaggtgggaaagcgtgagtccagccttcaagaaggaccctgccaggcatctgctccttgtcaatatgaccatgagggacgggatacctggagagtgtggctgcacatagctgttctcaagaccaaatacataataggaaaaggtggatggatttaaaggggcagggctgagctgtgtgcagttggaagttcctcctgacagcgtgattcaccccaagaccacgaggtattttatgagcaaagttacaacgtgtgatatatgtgctctttgaaggcagagtaaaagggtatgatttaaaagtagaagtcagcttcttgtagcagattacatcagctgaagttgtgagcttgctgcagagctttcgcagcctgaatgcccttgagagagtcctcctgtggtcaattaagtgtcttgtttttcttgaaagtcagaaatgggatggagggtaattattctaaatgggataaaagctgtgttaggtgtaagaaaatagtcctgaatcctctaaagagatagtatagaaatgtatacgtgggcatttataggagtctgagtcctcatagacaaggacaagcggaccagtgttttaatgagggccatttattaaacggctaatgaaatcctacagcatttgtctagtgtttcatcaccataattcaaaaggatagctaaaaggtattataggaaatgagtgatactcactggtatttgcaggtgcgtatctatttaaaatagtgttaggttttggagactgttcatgcactaatcatattatcaaaggatatgtggtgagaaggtttattaacaaatgttggtggcttactcggtgggaccttattagggccatcagtcagtggtgctccggtgtcctgattgtgaaggtttgggtctatggcacttggtcaaggactggtaaacagcagtattgatatgggggatgggtttcctgtgaacaaagacttgggttaattaatttgacagtatcattaattactgctgaaatcattggtttttgtcagaggtcaggctcttttagcaattgagggcaggtcccatgagagttggagacactaagtaatgcaagagtgtcactgctcaaccatctcaggctgtaggacgaaggcctttcctttctgcctgggccattcagctctctggattaaaccagtttctgctttacttcagtgtctaaggtagggctgggacacctccccctatgccagtgagttgtgttgagtgaatggggaacatttccagtttggatccatacagtgaaccagtgttaaatgtttaagcgctaatatctctcaggactttgcttaattcatatataaaggaggtagggtagggggcttattccattatctgctcttcctctgctaattctagaattctatacagtggattgagttcttttatgaggagaatttcttttgtaaaactaatgctctcttaaatgtatttgtttcataactcgccattttcatttgtaggttttgttgtgtgcctgttgtttgggtttggttgtttaactggggtgcctgttttttgtggattcaagtagattgactctagctgccaaaccccacccgtgggttgctgcttttttagagtatgtgaatgccgaaggaaaagcctgctgttttcacatggcacaacttggaagggaacaaacaattacacccatgcttccagttctgaattggatgagatgaggctttggatgaaagcctcatctttattgattttccccatggaacttggtaaatagcaaaaattagctttagggtgaagccaagaccatttaaaataacatgcatgaaacagataacttgcagagctggtggctggctggctgctgctcctgactggaaatggagaggaggaaggagcgtgacctcagagtcaggatggtgctacactccgtccccgcccttgctgacaccagctgtgaccacttggataggtccgataggcctattgcagttttctcatccactgaaggtgattgctgagccctcttccagctgcaacatttttagtttttcgttttgttttgtttgttttgagacagggtcttgctctgtctcccaggctggagtgcagtggtgcaatctcagctcactgcaacctccgcttcccaggttcaagcatttcttgtgccccagcttcctgagtagccggaattacaagcacgggccaccacacccagctaatttttgtatttttagtagagatggggtttcaccatgttggccaggctggtctcaagctcctggcctcaagtgatctgcccaccttggcctcccaaagtgctgggagtacaggtgtgagccacagtgcctggccttagtatttttttttctaaatcactgagctcttctgtagagaagtgtcgatactggagaaggactgacatgtacttttttcaatgtggtgttttcctgggacttcaagtaagttctggtctttctgagtctgcttgctcttgttgctgttgctctaatcttagcctctggaaaaaaataagaatgtttcatgcataattattgggtgaatttattggacactttcaaagaggagcctttggtatttacaaatgggtaatatttttctcttatttatatatgaatacttttgcaagggtcagtaacctatggcccacaggtcagccacctgtttttgtaaataaaggttttattggaacatgaccatgcctattcattcacttaggactataagtggtctggctcctttcacaataccatggcagagttgagcagttacaacagaggctaatggctcacaaagctaaaaatacttactcgccacccctttatagaaaacagtttgctggctgctgttttataggtacctctggtgcatgttgagattaagaaagtgtgaggttttaaaattttttaattgtggtaaaaagaaacacataccataaaatttgccatcttagccatttttaagtgtccagttgagtagtgatcaatgtatttacattgttgtgcaatggaactgtagaacattttcatcttggccccagacagtccaattccagagctcactatgtaaaccactcattcctcccactcctacagagcactatgaacaaatgaaatccagggcccatggtactcagagtagaatgagacctgatctacaaaccagaagatccatttcttcagggcataatgctggacaaactaccaaacgcattaaccacgctaagcctcccttgcaggttggagctgaggaaggtgcccgtcaccggggggcagtgagttttagagggcatgagtcacaggaggtacttagcagggcacatggcacaaggcaagctctcagataatggaaactcttttttatagttaccatatttactgctgaatctccaagggaaaaaaaaaattaacatccagcaaaacacatatgctaagtaaatcagctgtgggttctctgggaggttggcctcagccttggattgcccccacaatgtgggctggagtaaatggtgtttatcgttctggattgtctgacagtttgtcacacaggagtctccaggtatgacaggccactcctgacttcctcttctacgattcagcggccttcctccaacccaaagtgcaggtgacttccaaagtgcctgactgtctcaggagtcccgccaacccaggattagctgcctgtcctgtctctcgctggagctcctgggatcccttgaacattttgctttaaaatttcccttggcccatggtggtgcacgtctgtaatcccagctacccaggaagctgaggtgaggatcccttgagcctgggtggcagagattgcagtaagccatgatcacgccactgtactccagcctgggagacagagtgagaccccgtttcaaaaaataaaacattaaaaaaaatttttttcctttggctataatggttagacaacccacctttgtgttcagggatttttttttcccctctgtggtctacttttagttggatggagtctttgaaaaaaaaattgtcttttgagcataattttgcgtttataaatggataggctaggaaattatatagtggtctgttaatttgtacctttcctactggatgtactttcacagcttttatattatttctgcttttagttcgacttcgtggtgagaaatatttaagtttaaataaatacatattcatgatgtgtttatgtcctgaaaagttttcagttacgtttgtgcaaaataagtaaatatatttacacacatccccaaaatgacagacatttaagcacatttctctcacatccttttctgtttcccaagctagaggctgatcctcagctgctaccattattcagtctccacatgcaggaggcctcttgtttctaataattctacttccaaagtgtctcttgaattggttccctcctctcatccccagtgctcttatctgagctaggatcttcctcaatttaaaggactataattggcacccctttccacactaatgctagtccaattctgtaacataaagtgatcatgtctttctcctggctaataactttctgtggcccttccttggacaattgacaagtccaaagttagtgtggccttctaggccctccacaggctggctctgacctacctcccccaaccccagcttccctctagaataatttccctcccgcctctcttccctgctgctgccacacacatacatgcacaccctgtgtttccagcctcattaaaatctgtgccattcaccccattcttaacacactctgacctttgcaggctctgtttctcccaccagaaattcccttctccctcttttgtgcctgtaaaactttgaggcatcatttaaagccacgtgaccctcagggagcctttgccgacttcccaaagcaaggctgttacccttttgcactgttcctgttgcactttatacatgcttcttagcctgccacttggtagatattcaataaatgtttatcaaatgagcaaataggtaaataaataggcttaattattatgcaattggggttcaagaatgtgtaaaatccgggtcttacacatcctcgaacccaaattgcataataaataaacataatatgcatcttataaatgtattactgaaatttaatccttccattgaacaaaaatgagactcaggtatgcaagcgaggagtcatttgatattaacatcctagaagataccatctatacttactaattcataatttctgttccttgaattctataagtagaggaactatccatacagtttttttaaaattaagcatgttttgtaatactataaatgctaatatgttggcttcaaacagatttttttcaagtgtggagggggaaggaccacatctctcttgagaggcattaaatctttccatgtgacatttctctaattgtttaagggaaaagcttgcttaactctcgagtttcagagtggactctggacaaaagtgaattatctgtgaactcatctgtgtgaactgatctggtccaagatagttttccttttgccagattgtctggcttttcttcctaaggtttaggtgtattgggtggcacatgcaagcttggcttctagaatttcatggatgacaacagtcaaaacataacaggttttactgagtggaaccatcaagttccaggtcaaaatactgccgtaaattgagcccatctcttaacaagggctcctcagtgcctcagcagcttgaatctcttggatgactgtttccatgtttcatcacttaatgcttttggctgcagggtcagagggatgtatagtgcctgtgacaactccccctacccccacccaacactgactgttccgctggcctctgtctctttttggtagctcctgaagaaggtatcatcttaaattacgggtcaatggaaaattaccatgttcaggtagtatgatttactggttactatctctcgcctctgtagtttatccctaagtctgtcatagcaacacatccttctagattactttcttctttttggttaacagctcacatatcatctttcccagctagtcgtcttattcaccaagatgaaatgttgtaatttttaccatcttctagatttcagtataaaagaagacagttgtaccctggtgggttagcccagcacactcgtttaaagtatttatgcttcagggatccattactttttatttttatttttattttaaaatatggtgatttacttacatatacaaaatagagcatgggttttatttaaatttcaaacaggagcagtgtagctactgtttcccgaatgccaatagcgttatagtactgtaagttgcttttgttagaatcaaaaagaattttcttcaaatccttctttacaaacagacttcggtgactgcaaaaataatggtttcgtggttgcctagattgccacttttacgtaaaactagatttataagttggctagggaaaattaatattttagaaagaaagatctaaatcacaattgctttaggaaaaacttgtgttctgtgttagtttgtcatcaaggaatattaaagaattttgaatagcattttttaatgattgaattatttttgttaaccctcaacaaagcattcctaacaaggtttatgcaagcagtattggccctataatggagtcataggttgtcatgatttcataggttccctgtctctcagtgaaactcagaatcccctttgtcccaggtcctaagtctatctatattttagtgtttgagctatcggaagaatgatccaatagaaaactggtagtttccattcatagttctgagatttaaaatagcaaaaaaagatgttggatgattccttgttctccagagaactgctgtaattctaatctaacagggaaatgaggaaatggaggctggcatgttaccggtttatgtcctggtcagcaggagctctgttcactaaaatgtgcacaattctcagccactttcatcccacttacctcaaaaagtgtcttcgctttgtctcctttagtgagttattgataaaaagaaaaccttaaacagaaaacagctttaaaaatatgtgtactacctttcaaacataaaattttcaggacagttacaggtataataaaattatcccaagtgaagaaatcctgcttcatcttcagcagctatcccactcctaataattaagcaagatcaatggaactcagagagaggagccttaaaatcttaaatgggccaattttacatgggttcagggagccctaaaaagaagcagaccctaagagcctgttggtataactctgaaatgaaattcccacatgcattaatcaggcttctgttgttaccatcaaatgaaatatgattttcgggcttggtaacacttcacagttgattggctccttctatccaaccacccatctatctgtgcatccatcttttaaaattctctctccagctgtgactctgagacaaccattgtcatttagatgctgattcctcactgtggttctgttggtgactgctgacattgaaatgagggatgtttctcaagatagattaattatataaacaaattgagggatgaggtcttcttctgctttgttcttttgaataaatttctgtcctggaccactagaagtgggactcagccatgcttacaagcaaaaatagttcatgggtattagttcatgttctgagagaggttcaggcgaacggacttggaaaatatccacatcggaagaggagggaccataggggaaaatagtctacagattaatgcatgtgaaataaatgaagaaatctctcaaataaggaagctgagaaaatagtggggcaaaatatgttacatttaggatcttgttctctttcttttttttttttttttttttttcattttaaacctgtgggagaaagatccaggagaagctggcaaccgcaagtgcttccagggcctggaagcaagttgggggatgagatgagctgaggaagctaagaatgaggttgaggtttcaccatacgccttttcctgcctctcaaatgttgtgccatgtgcacgggttacccattaaaataatttgtattaaaaatattgagaatcaatgagattgaagaacagaagaaaagggagaatgacagaaaagtttcttaaattggcaaaaatggggagggtttttaaatggtttgtttttaataataataaagggaagagagaaatcaggctttaggggcaaagatgggaagctaagttccaaggtaatgtcaagtgggcagctggatggaggaggttggaggatgaagtcattttcgaaagccatcagcagggagagccatgtgaggaggtgaagtcacttagggatggaaggatcaaaactagtgcctgagggaaatccaccaaatagcaggaaggaagatgagagtgtttcttttaaaagcctccactgttctaggagaacttcaagaagcagttatgcttatccggaaagggaaaaaaggtgagaaagtaaaaagccaacttttcccacatatctcaattctgtcctagaaggaacatgttctatgtttagcatcagtgagaacgtggagaaaatcctttcccaaaaaagaacgaagggggagggggagagaggctgtggagggggcagctatttgagagggaaccatctccacactttcaacccaactccaggccttcgagttggattgcagcaccctacaggccgaggtttcgtctcctgacatggaggttttctgtcagccttaatgacttgctctgtgttcagcgtccacttctatttcttattcatgctgtttaatgtgctgagacacagtctttccctacagtctctctctcaactctgttctctcaatctagcgatttcatcagttccttttctttgggagtcttccaggtcttacaaactaaacccaagaggatttatgttcctgctagccccaattttgtcattaaaagtttttgagtagtatcaattgccataaatcaaactaatatccctctggcttcataatatttgtttattactagcttattttttaatactctcataagggtctcctaatgttcaagtttaaaaagaaatggaaacacatgcagattctaaaccacacatctttttgtgtgcatgttatggattgggctccttttaacaaagtgtatgtgttaaagtcaggtatgactgggaacacagaggatgtggctcctctgagggttactagagactatgtggcatactcaggtttcactggaattttatcagaggcaccacaaatcaagtattttagaataagacattgaaaacatctttaattttaaagatctgcatatcttcctcatccaggctgtgtatgccatgcttcctcaccttccctccccaagccctgccaggaaaaggcagggatttgtaaactgaagctatgtcagctaaagcttttattggtacttatgatccaggcctccgtctgcttttcattaattctctgctgaaagaattagcttagcccacccccccgccttttttttttttttttgcatgtcttccattttaaaataaaaagcaacagctaaaagtcatgatgtgaaaccagacaatggttagatttcgtaagttagactccctcttccttatccttagtgtattttaggttttaggcaaaacctattagattcattgtggacttaattgtccctcctttctccctggcatgtccccattttccccactgttctgcaatgtcagctaataaatggtgcaagtaaagttgacattaaggagatgacaataggaaagagtattttgaaaatataatgaagatttgatgaactttcttacgatttaatccagaaaataagaaaaacgtactttaaaagaacgttaaacatgagttgtgcaaaagtcaaaagactgctcattttttgtttaaaaatatctttttcttagtacaaaagcacagcagatatttaaactccacaatgaacaatgtgataggtttatttatgtaagaaaattaacatatttgaattttttcccagcctagagttttccctaacattctgccttgtagatagatgtagcagctctttaaatatgtacataatgcagaatatttttgattaaatattggtaaagttctctacagtttacaaagctgtttcatattcattacttcgttaaaactgcacaagagtttagcgagggtatgaattctttttcccatttcacagataagaccacagggcagccatgactgacttgcccatagccatacgtgtgaactagaatttgaacccaagcctctgactctagagtcagtgctcttctcggctttccagccccatattactacaatccgataaacagatccttgtgtgatattaggttactattggaaaaaaaggtttctggggtagaggagacctggcttcctgttcaagtagcagtcacatcttccagcacatgccacgtcctctgaactcgtttttctgaccccagtgtttcatgttccaagcacccttaaggagtatttgggcttttttttttccttctcaccaatctctctgtctcttgaacatccagtcacatttctgggtttggcgtttcacatttctgttctaccttattctgggagtcgttttttgaggtgaaatggcaggtctagagcctgaattccttggggtctgtctggcgcctgaatcctgcaagagtaggctcaactcagggacccaaagctgaggctcatggttggaaagtagacatcacaaaggccagcatccagcaaaggatcctctgcaaattgccccacaggtttaaagcctgtcactgttgaaaggtttgcggtcataagaggaaagtagcagaagccctacagcaaataggcacagaaaattaacaggccccctgcagacatttccagtgaagaacatctcaactcactctgaattagggcctctctggcctgagttgagtgtaagaatcctctgagaagcaagttggatgtggagaatcctggcttctacctaaggattttgattctggaggcctggggtggggctcagagatctgacttttaatgggctcccagataattccttttctgggatccatagatcacaccttgagaaatactttctcagagcaccatcgtgaaatagctgatgttcatgatgatgactgatccatcaaaaaaggcaattttgctctattttagaagatagacatttaataagaggtatctgacttatatgaagatttcttatgtcttaactttttttttaatagaatatgctttacctacatggaaaagtcacttaaaccactggatttcccaggaactctactatattaaggcttaatgtgctttttagtacttacatgcatgtttacctaaggcttagagcctagaaatttgtatatcacagacactcaaaaattacttattttgtttatctagaatcagtactaacctttctaacgaaatctcttctcctgcttcagctaaagcccccttggtgttctctaggttgatacagaaaactgaaagagctagaatggagccccaggttagttaatatctattattgaatactcagcagcaaacaattctgacagttaatgtacccatgttaatcacaaggaatttgccaggagcactctgacactgtcctgtcctgatatgcatgttaaaattgcccacaggttcacaaaggaatcctcccctctgcattttcccccattcgtgcggtgtgtctattgcctatagctggttcttcctcttaggagtaatcagcctaagacagagcaggctcaccaccaggtcctacagatgcctccatcattttactctgcagtttgttacagctaacattattcttaagaaatatcttcctggcttggaggtaatttctgtggtgagtaccaagatgtttactaagctgagaaaaagtcaagggtgatataaaaacagtaattctcattcatccccagaatggcatttctgtgcttgtgggaatgcactagaggttctgaaatcataaatgaagaatgtcagaaatacagtactttgacattttttgacaaagatgtagttagccattcttgaacagaataaaagaaactttgacattgaatgtaaagtagaagtgataacaaaattagcacatttaaaaagtttatcatgtatcagctacagttctaagcaatttacatgaatgggctcgttaaaactccccaagaggaagacactatgatctccttttcacagatgaggattttgacgcttagagaggttacataactgtctcaatgtgacacagtcagaacatgtcagggccaggtggaagggattataatttgactcagaccacattgacacatgcatccccttattttctggaactaaagcagtttcttcatgagcagcatgatggggtcttctacacttgtcagttgaataaggttaagaagcctctgttgtttcagtttaaatgttgagtcaatcaaaatttggcttcctctgtactgttttaaatcatctctttttggatgccctttcagaagcattctctgccccaggagggagggcattgggctgactgtgtcctgggggtaggcaggggacatggtgtccttgaggccactccctgtcccccggtttcttgcttatcttgctgcagcatctgggcttgcatggtgagttcctgaaacctgtggccaggggaatgcctggtctccttcctcagccctaggaatgttctaaaatcctcagcctccttcctctgatgaatctccctaatggcaactctgattaccttggacttccatttggctgctaacccagtgccattccctggcaagtttactggccagcaccctcagccacctccctcttctttccataaaacatagaagatcttctgaatttcttctccataccacaaaagcttatggagaaacctgggagctaaactcggccctttttcatcaactgcactgctttattttaacgcagctgaccctacttggagccaagtcaggcctgagaggcaaccctcttgcagactcccaaacaggcggtggggcagctcatcttctgcctttggtttttccctcagggcttttcctccctgagacaaagttgggctccatgtgtctttaaaaggcccagttccctgattgaaggccccagcccagaaacgggtgggcaggatttgtcccttcctttctcttgtcattaaccccatcataccaccaccataatacgaagtgtaggatcaagtccacctgctaaagtggaagataaacactttctaatcctttaaaaagcccgagtttcaagtttattgtcttgctgcagacttgagaacccaattttgggctgtcagaagctggagagtacaactttctttttgtatttctcctgcaacaatccagaggcacagccagggagaggtatgtctcaggctggcaatggaggaggtcaggcacatagacatgcaaatagaaaaccacgttgatatattacaaaaatattgccccaattttctatgactaaaacacaagcattgtcactctagaaagtatgtttttatctgccatactcattgaccactaaagtaaatgaaatttgtggggttttttggcatcaagagaatagagcagtggtaaaagtagatcagacatgaaacacttcagtccagaatatgtctacagttacaaaaggagccaaagctagacatggcttttctgagaaatagacagtgagaaattagaaaagaatgataaattatgaaactatcctgtttggctggacatttagtagatggatccaggattaccagctcaaaactcaactaatattcataactgtggcttaaatcttcatgaaactctttcattatactgaagaatctaaaatgattttcagtagtcaactacagtctagtaaatccagtttcctatattcaagtgttctttttgctccctttccatgagacctcatcggtctcatctctgattcccagcaaggccccttccatacttgtcaaccttcacatggcatgtgcttgctcttatgtccgtgcccttcatgattgcgtcccccaaacaggaagtcaatctgttcctttatttcctccatgtcaacttatggccacttctttaatctggcataaaatccaaacttccacgagttcactttttcattaatatagtactttgtaattgttctaatatattgttttgtaattgttcttttttttttttttttttttttgctcaactgtgctaaaggttctcaaagactttaagaagccctaattacttctgtcatcccggaaacacatggcactatgctttaactgaataaatgttcagttgatgtactttttaattttttaaattttattttttgtgggtacatagtaggtatatgtatttatgaggtacccgagatgttttgatacaggcgtgcaatgcataataatcacatcgtgtaaaatggggtatccatttcctcaagcatttatcttttgtgttataaacaattcaattatactcttttagttactttaaaatgtacaattaaattattattcactgtagtccccctgttgtgctatcacatactaggtcttactcattttttctatttttttgtacccattagccatcccgacttcccttcccacttcccattacccttcccagcctctggtaaccatcctactctctgtctccatgagttcaattgttttgatgtttaggttccacaaataagtgagaacatgcaatgtttgtctttctgtgcctggcttatttcacttaacataatgacctccagttccatccatgttgttgcaaacgacaggaattcattcttttgttttttgtttttgttttgagacagagtctcgctctgtcatcagtgtggagcacagtggcatgatcttggctcactgcaacctctgcctcctgggttcaggcaattctcctgcctcagcctcctgagtagctgggattacaggcacctgtcaccacacccggctaattttttttatttttttagtagagacagggtttcaccatgttggccaagctggtctcaaactcctgacctcaagtgatccgcccgccttggcctcccaaagtgctggggttacaggcgtgagccaccatgcctggccaggaactcattctttttatggctgaatagtactctattgtgtataagtaccacattttctttatccattcatctattgatggacacttaggttgcttccaaatcatagctgtagtgaacagccaagagcctgtatttgctgcaacaaatacaggagtgcagatatgtctttgatatactgatttcctttcttttgggtatataccctgcagtgggattgttggatcatatggtagctctacttttagttttctgaggaacctccagacagttctccacaatggttgtactgatttatcagggttccccttttctccacatccttgccagaatttgttattgcctgtcttttggataaaggccattttaactggggtgagatgatctttcattgtcattttgatttgcatttctctgatgatgaacgatgttgagcacttttttgtatgcctgtttgccatttctgtgtcttgagaaatgtctattcaaatcttttgcccacttttatatcagattattagattttttcctattgagttatttgagcttcttatatactctagttattaatccattgtcaggtagtttgcacattattttctcccattctgtgggtcatctcttcacgttgttgtttcctttgctgtgcagaactgctccctttattgtcactgaggctggaaacctaaagaacatcttgatgccttactctctcacacctcctacatccaacaaatcatcagattagcatattttgaccttccaaatattttccagatctatgtcttcttaagtctgtcatctcggctcttgttcaggccttatgacgctcgcctggaccaccagtctctggcttggcttcctgcttcaagtctgccttccacataccccagtgtgactgaaatgaaacccaaatccaaccacatcaacgtctctgcaaagtaactgccaaggccacaggattgagttcaagctcctcaacatcccacaaagccctctgtggtttcactctggtccaaatctagggttttaattcacactattttcagcctcatattttctgttgcaataacatcaagctacttgattttctccaaacaatgctttgctcatattgtctcctctgctaggagacaggttgaggttgataccatctcagcaggtatgtggatgatttcccttcaacctggagaaagagaatagaagtccacaagagaaggagcatgaagtagcacagtgtgcagcgcaggatgggtggatgtttgtgacaatgggtaacatttatgcaaaccacattttctgccataggccattagcttgtattctgcttccatattttggcttgtggtataccacaatctgtattgtttgttacatacacaacttttagaaattttaattttcaaaagaaagttgatagaaatacatcattccaaaatatagggaatactcttctgataaaatcattatgtataacatatattttcggttgattccctaacatccattccatcctatcacttccacttccaaaggtatccaaaccatcagttcataaaactttgagagttctgaattaaccaggtagtttttaggttttttccattgccagatttggatttagctttcttgggtctgttcatttagttataagtcatctatctactttccagcttccaacgtttagtagtggtagctcttttcccatcttctttgttctcgtttgtgcccccttagagtttttggtgggctttcagggttgaatagagctaaatggatggcttccacccttcatctttaatagaaagactccattattattattattattattattattattattattattatttcttctttcttctttttttttttttttctgagacgaagtcccactctattgcctaagctggagtgcagtggtgtgatcactgcaacctccacctcccgggttcaagtgagtcttctgccccagtctcccgagtagctgggactacaggcacgcaccgccatgcccggctaatttttgtatttttagtagagatggggtttcactatgttggccaggcttgtcttgaagtcctgaccttgtgatccgcccgcttcggcctcccaaagtgctgggattacaggcgtgagccaccacacccagcctcttcttttttttaatgtggttggcaaatggtagacattttttaagggtctgaagcataatttttattatcttttctcatctttaccatctgtcttttttttttcagcatctacattaaggatatacatctgtcttttttaccccttcccaaagacattttttaaatgctcatgtgtagaaaaattatatatattaatatatctattagtctgctaataaagatatacccaaggctgggtaatttgtaaagggaagaagtttaattgactcacagttgcacatggctggggaggcctcacaatcgtggcggaaggtgaatgaggagcaaagtcacgtgtcacatggcgggaggaaagaaagcttgtccaggggatctcccatttataaaaccatcagatctcgtgagatatattcactaccacaagaaaagtatgggggaactgccgtgattcatttatctccacctggcccctgtgataattgaattactacaattcaaggtaagatttgtgtgggaatgcagccaaaccacatcaatatattatatattatatgtaaagttaatagactattttaagagcaatttttagcttcccagcaaaattgaaagatacagagtttctgcatactcactccccgcttcccaaccaccccacaacacacatacccagtgcatacacacagcctccctcaccatcagcatcccccatcagtgcagtacattttttgcaattaatgagccaaggttgacacattattatcaaccaaagtctagagtttacattagggttcactctttgtgttgtagattctatgttttgacaaatgtatagtgacatgtacccaccattctagtagcatatgggtagtttcattgcccgagcagtcatctgtgcttcacctattcatccttctatctccctgagcgcctggcaagcactgatctttttactgccttcatagttttgcctttttcagaatgtcatataattggaatcatatagcaggtaggcttttcagattggtgtctttcacttagtaatatgtacttaaatttctccatatcttttcatggcttgatagcttatttccttttagtactaaataatatttcattgtctggatgtatcacagttttttcatccatctactgaaggacagcttggttgcttccactttttggcaactatgaataaagatgctgtaaacattcatgtataggttcttatgtggaattttttgttgttattgtttttggtgttggtgttggtgttgttgttgttgttgttgttgtgagacggagcctcactctgttgcccaggctggagtgcagtggcacgatctcagctcaccacaacctcttcctcctgggttcaagcaattctcctgcctcagcctcccgagtagctgggactacaggcacataccaccatgcctggctaatttgtgtatttttagtagagatggggtttcactatgttggctaggctggtctcgaactcctgacctcgtgatcctcccgccttggcctcccaaagtgctgggattgcaagcatgagccactgtgcccggccggatgtttttaactccaggtggacaccaaggagcactgttgctagatcatatggtaagaactttagttttataagaaactgtcaaactgtctttcaaagtggcgataccattttgtttttgtttttgtttttgtttttgtttttgtttttgttttgagatagagtttcactcttgttgcccagactggaatgcagtggtatgatcttggctcactacaacctctgcctcccgggttcaaggattctcctgcctcagcctcccaaagtagctgggattatcagcatgcgccaccacacccggctaattttttctatttttagtagagacagggtttcaccatgatggccaggccggtctcgaactcctgacctcaagagatccagggatctgcccacctcatcctctcaaagtgctgggattgcaggcgtgggccaccgcacccagccccattttgtattctcacatcctcaccagcatttgatgtcagtattttggatttttgccattctagtatctatgtattatctcattgttgttttaatttgcagttccctaatgacatacaatattgggcattttttcatatgcttattagccatctgtatgtcatctttggtgaagtatctattcatatattttgccactttttaaaccaggttattttcttattgttgaattttaaagtttctttgtatattttgaatagcatgtcctttatcatacatgtcttttgtaaatattttcttccacacatataatttttaatgctttattatttcaactcaacataaaaaaattttttgaagcacctattaagtgcttagcattgcatggagattggagatttaatacagaaaaagacccaatacctacatttaaagggcttccatttatcataagcatttccctgtgtgtcaaaaaattctttataaaaaaaaagtgacgacaatagcccaatattttattatataaaacgccctaacattagacttttaggttgcttacatttgtgagcaaataaatgctgtctgaaactttttgtacataaacctttgcccgtattttagaaaattcccctgaatttgtaggaatctgcttcaagaaaataatttggtcaagaagaagtaacatttttatagcttttgatggctcaagggacttttaagtcagactcttgccagtttggtaaaattaattaagctaaaatggtaagaattttaaaaggagagatagccttttctcacaaataagtaagttgtatttaataaactgttggcttcataaaaagaaaattgaaaacaagatgttaacgtcttttattttataaataaacatgaacttttgtaaaaagtaatttatttttggctgcttctgtaagtcattttcactgatattaacatttattacatttggtctctccaaccccaccgccccaaagattctgattcagggatctagggtataatatagtggggaggagagttcacacacatgtgtatatgtgtgtttgtgtataacagacaggattccagagcaagccagctttggaggaacagttctggaatagttctgttccaggcatgaaatatcatcaaacctgttaccagtttaaggggcagagattttaaaaaatcattttatctatgaagataaccatataattttaattggccacatatggacagagactgaaagtgaacttggaaaatgaaaagaatgctgttaggacagaggcagttgaggtaatttgtttgcagccaccacaggcaaacacagaaactccatctatcacaggctcctttcctgtgaccttcttagaatatctctgttccacataaaatcatctcctcttttctttatattggttttggtctctctgtgttagctcttctgcttagatatgttattactcaaaggtttgttatgggagcaggcaaagtataatgtaataaatgaataaataagcaaatggaacaaaagacagtttttttcatgtcatatctggccaaactctaacttcggtatgatatcacgcaatggcagaatctacagagggaaggatttgaaggatagaatgcttttgccaccaccattttcttactgattttgacaacaggactgactttgaaaatgaatatattgacctctttgatttaatgtcattcctggtcccttggaattttcaactctagttagcagacgtcgtctctttttgcagaagcataggttagcagttctgaaactattcttcgtgcattccaggattgagcagataagttgtggacagtgggagccaggttttgcactttaggagaacggagctacagttgtggtaaaaggatgagatagaactctgcggtattggattcaaattggagatatggatgtaaactcctgatttctgatacatacacacatacatgcatgcatacatacatgtgtgtatgtgtttagatatatgtaaactaatgtagctgtgcatggattataatacatatatgtgtatgtgtgttgtgtctgagagtacttgtggatatgcacacatttgtttacatatacatataaacatttcccagctcagtcctctgagatgaccttgaagcagtttcactctagtagcagtgagcatatctagaaaccagatctttgtttctacataccctccactaaaaggaactagggctttttggagaaatggttaaattcaaatttgaggcaggtaaagtagaatagagcctggaacatcatgtcatgccaaaaatgaagaaagtacctgcagaataagggggacttgtcaaaatgacgctggagccagcccaaagaggctcccattcgccaaatatgggatcatttaagcgttaaaataaattactaatttaaataaataattttagtaagtgtaatactattgaataaagtaagaatccatgagctactttgatataaacaaacaaaggagaacaaataaagtagaaagccaaccaataaatgtagaatgttgaaaatcaaaaatcatattttgcaagccatcataaacataattgattcagtcaagaatcatctatgaatatgaaaactaatggatggaagtttaatgagatataggatctttacgttgtctttacattgtttcaaattatattgtattatttacaatgggtgaaatagtaactcaaatggagaaacctggcaaacaccatcttaaccaaaagattaaagttaacatcgctagtggtgggactaaccaacagcatgtgccacatgataccatgcactgaggaaaagccggaatgacttttgttatactgttagaggtgtataaccttaatttaagtgtgaggacacatcagacaacccaaaatgtggaacactctctaaaatacctgccctgaaaaaagacagacccaggaacttcccagattaaaggagactgaaaaaacatgacaactgaatgcagtgtatgattttagattttcttttgttatagaagatattattgggacaattgataaaatcacaataaggtctgtaatattagataacattatttcaatattaatttcctgatttcaataattgtactgtggttatgtaagagagttccctatttttaggaaatatatattgaattatttaagaataaaggaactttctgtctgcaatttactcttaaacagtttaggaaaaaatctatgtgtgtttgtatttagaaaatgaaacaaatgtagtaatgtttgggtgaattaacattttgggaatctgggtgaagggtatccaggcatacaaagaattcttgcaacttttctagaagtctggaattatgtttagtgtctttgtgatttgaattttaatacgtttctttataatgttcaaattaagaaattaaacatccagtatatgaaagaaggaatggcactgaaaaaagtgacattagtagaggtttatattgtgttataatattatacaatattataataatatgtaatattactataggcaatatgtattatataacacatatatacagatgcttcttgacttacaatggagttatgccccagtaaacccatcaagttgaaaatatcctaatcggaaatgcatttaatacaccaaacctaccaaacagcatagcttaccacaggctaccttaaatgttttcagaatgcctacattagcctacagtggggcaaaatcatctaacacaaaacctatactatactacagtgcttaatatttcacagtaatttattgaacactgtactgacaatgaaaaacagagtggttgtttgcgtacttgaagtacagtttctgctgaatacatgttgcttttgcatcttggcaaagtcaaaaactctaagtcaaacaatcataaatcaaaccatggcaaatccaggactgtctgtacaatattacaatactgtatttatgttgtagctattgtgatataattagaattatgtgccagcatgattctttgcaaattcagtgagacctggtcaatgtctttcagataaattacctaagactagatgatagcagggacattatacatcaaaatagtgatttcagttactctcgtataaagtggagggcaggaacgatggacagctatcatcttaaaagcttattggagtcagacgatggttcctcacatctgctgacctgtaactatggaataaacaactctgatgaccatttgttcattatcatactggagtcatgttcctgaggaattccagggcagtaaaaatttagaagctaaatgtttaactttccagaatgtttaatttttctgcactaagtcaaagcaaggctcatggaagcaaacttccttgttccctaaacactcagcccagaaaaattgagagatcacacatgtaaccgtgaactttgcactgttagatttataaacttcacaaaccaaaaatagtttctgttgttgatccaaaaacctccattctaatgacaaacttatggtggctaaaaaccttttaaatgttagattgagttcctgctttgtccctctgcatgtgattgagccaggttaagttgatttgaacctgagaaaagaaacacattgcctctgtagggttttctaagccatctgaattggtactaaaccatttctgtgaggtgttagaatcctgcagggggcaccagaacattccaatgcagttgaacacatttcattaagtccagaagagctaactgtattaccttattataattgatttctctactgtaacgttttcagttccattaatattatttttttgtacatttacttttacaacatttgtgagtttatggaatgtttctgcctctctgaggaggcagaggaaggaaagagatcatctcttggatgagtccttagaaactacagccatgtctcctctgggtaaatatgaaaggtttcagcccactcggagagtaaggactttccaaatgttcctaatctgactgcggaaaaaaaaaaaactggaagaaactgagaattcaatttactttcttagccttaaggctgtgtataagctaccctgttattatcattattaataataaacacagtgaatgtcagacaggcacttcatggtagatttttatatgaattttgtgcaaaagtaaagggttgccaggctactgcataatattactcagttctggtccaggagtacaaaattccaccaggcctcctgagcccgtccctccaattagtggcttacttcattacgaataaagaaccctcattactgtgggccttcaagtgaaataggatcccctacctcttgaaatccgcctttctaagtacagacagttcccaacttacaaacaatccacttaagaaccaccaaggcattcagaggctgctgtaggctcctgcagctgctgcctgggccccctgcccagcccccctgcccagccccctccccacactcctggtctgctcaagggagcgctgcctaccccccttgcagagccagctgcccacctgcccctcggactgcaggctcggagctgggggttcagtgaggcctcagagctaccgctggttttatagttgagctcagctatggggtaaataggcttttgtggcctggcctgggaaccgaaccaccatttaaaaaaaagaagaagaaaaaacctgcctccatgggaaaatgtattctgcattcccaatagccagccaacaaatgttagaatgactgtgggggctgtcttctgtcttcatgcccctagcagagcgaggaggcgaaagaatccgcctgtgtgttctgggttctgggtccagctctagcactaaacccaacataggaccttagtaagccctttaacctctgtgtatcacatcatctgtaagacaataggattgtactaaatgagttataagcctccttctagtataatgaccccaattgatcaaagctctaccctcattttattcattcagaggcattttactcagggcacatgctttgtgcaggctctgggcttggtgggaatacagtcaaataatacagatcccagcactcacagggtgcagtgtttacttggggagacagatctttaagtgaatgttcataagtgctatgattgcaatgggcactgggttctgtaaaagctcaggagggtctgaatcagatgaagtctttgcagaggggttggctcgcgggctcactcccctgatttctattttaattgactcctctcccagggtatcaaatctggttcactgggaagcatagcttctgcatctaccatcctaacagtttggcatggtcccctggcctcatcaaggaaagtcttgccctcctctttgcgtcactgaaagatagaatacagggatgctcccaccaaaccatagtcttgattcctgtaagtactgccctgaatgcttgcttcttctctgccctagggagccatggccaaaaaaggttctctcttgctctccttggggccttccctgccctgaagagaggcaggattggcagcaactctggtactcccaagtttaaaatattccttacctcccaaaatatttctgaagtcccagctacctcttgctgtcctatatttataatgccctaattataattctaccaaaaatcccttctaggcttccacccttactccacactcacttttaaaatagtaacaatcgaagtgattcaaagaagtcacctgtcatttggaaggtggcataacagagtggttcaggttggaatcttgactctgtgccttgatatcggacattatgaaattatgtcggtatgaaggttcctgggcaaggaagcgaccatggaagagcagttttgaggagagttaattttggtagctctgtgtaggatgctacaagaatggagaggagggaaaagatgagagattttcagcgtagaaatgatgaaacttagaaaccaaataagtgtgtcattatgcaatgtgaacttatataactttcctgtactctcaaagtatcttatttattttggttctatgaaagcagtttgataattataactggaaaatcttttcttttcatataaataacaaaacaccccaagaaaacattatctaagagtttttccaatccccattccattatgttcccttaggatgcctttagcgtaagaaacagcctggtgccttggtgaggaactcagtctctgcagtgagcatctcctgggttcaaactgtggcttccccacttcgtagcagtataatctcaggcaggtttcttaacttctgaatatttcagtgtcttcatctgaaaaatggagacacagtcaagtaccatataatgacattttatgatggtggtcccataagataacaatggggctgacaattcctattgcctagtgacatcttgatgatactaaatctgtgcaaatctgggctaatgtgtgtcttagtttttaacaaagaagtttaaaaagtgaaaaaagttaaagatagaaaaaagcttatagaataaggatataaagaaatcttttgtacagttgtacaatgtgtttgtgctttatgacaagaattattacagaagagtcaaaaaatttaaaaatgtttaaagatgtttataaagtaaaaaagttacagtaagctaaggttaatttattatcaaagaaagaaaaacatttgttataaatttagtgtagtctaagtgtagtgcttatgcagtctaaagtagtgtacagtaatgtcctgggccttcacattcactcaccactctcactcacccagaacaacttccaggcctgcaagctccatttgtgggaagtgccctacacaggtttatcatttttatcttttatgccatatttttactgtgccttttctatgtttagatatgttcagatacacaaacacttatcattgtgttacaattgcctacagtattcagtacaataacatgttgtacaggtttgcagcctaagagaaataggccatctcatgtgtaatataatgctttgtaatataatatatactttgtaaaaaagtataggtgtgtaataggtgctatatcgtctaggtttatttaagtacactgtatgatgtgtgaacaaggacaaaatcacctaacaacatgtttctgagaacatgtccccatcgttaagtgacacataagtgtaatcacgtcaagctcataagattctaatgaggattaaatctgtaatatttgtcaagttcttagaactgagtgtggtccatattaagcacaacataaacattcttgttgcccaattttaagtgtttgatatataaaataaatgcaaaacaagataatagcctgtgtgctatactgagatattgaatagcttatcttttgagaaatggagacaacattactggaataagaatacaactctaactagttttcatatttccccttctcagtggcacgttgaggccctgtcacttatatgtaatggaacccatcaaattgagtacattatgcatgaaagtacacttgtgatatcttaccctgatctgccccttttcctgccctccttgtttttgttgacctcagcttgaaatcttaactttagattcagcttcactttcttcttttctgacccatttatttggtttcaaaatctcatcatttcttccctggaaatctctctgtcatccatcccctgtctccatttgtatagcagcctacacagagctgccaacctcatcttcctgaaaaaccactctactgtggccacttccctgctcaggaccttcagcagctccccattgcttaacaagcaaagccctcagcctgtcgttcagaaccacacaaacccagcccactctccttccctaggtccaatactgtattcccaacagcctattctccacagtgaccagatgattgctgtgtctggcatggtccacatttatgtttgttgtccaggcttcactattaatgatgccctcttcactcagagagcgtccctgtttggacaataaattgtatggccaccctgctgttatcccattagccaaaccatgtatcccaggattccctgtctcctccccctgttcctttcatctgaattgctgtcgcttgatctgtgcctatccacaagcttcccctttttcaaaggcccattcaaatgttacttcctccactctttcaaaactctcccagggttctttatacaaccactcttttgccacctaacacttcctaatgtgtatcatgattatttatatgctgtatagctcctctttcagaatacgacccttgaagaaagaaactgtgtctgattaacaaagtgtttcctgtagcatctaacccaggctcctacatgcctggaaaaataacagacatcagttcttgagtgcttactatgcaccaagcactgtatgtataatcaatatacactttagataccatctgtatatattatctcatttaatcctaacaatagctttgaaatactgtgtctctgtttactaatttggaaattaaggcttggatcaaatgaccttgttctagatcacagaagcagtaagcctaaatagaaacattcgagcccaaatttctctgacttcaaagagcatgctcttaaccttttcactccaggcagatggttcttaagattaagtatgcagcagggtcttctggagggcttggtaaaatgtattgatgtgccccatcccagtttctgattccgtaggcccaagttagggcccaagaattacatttctatcaagctcccaggtgatgctgatgttgctggtccagacagtacactgagcgtaagtaagcataatcattcgttgatgaataaatggattggtgggtgggtggatggatggatggatggatgtggatggccagatgcatggatgggtgaatggatggttggatgaatatatttaaatttatcacttggtttaaagtttcataagtctgctctaattttgtacattaggtacattgatgtgttcacttataattcttacaaggtcaggattaaaatttacttttatttttcacagccatctttactgtttcataatattgtttaagtttgaatttgagctgactttttcagtttttttaaaccaaagacagaattttaaaaatttatctctcatttccttttttcctttttttttttcttttttgagacatagtctcactctgttgcccaggctggagtgcagtggcacaatctcaggtcactgcagcctccgcctcccaggttcaaacaattctcccacctcagcctcccaagtagctaggactataggcgcacgccaccaagcctaactaatttttgtattttaataaagatggggtttcaccatgttggccaggctggtctcaaactcctgacctcaagtgatctgcccgccctggcctcccaaagtgctggtattacaggtgcaagccacggcaccccgccttttcttttctatcttaaaaatattttgtccaaaataatgttaaagatggtttacacatctctcccatctccttccaatatcttttctatactcttgcatgtatatttaacatacaataggcttttaatccacaatagttcattaggttttatttcaagtatgaattattctctcaaacctaagtgtattctaaagggattatttttaagtggcctaggaagagagaaagctatcttgtgatttatatattgtgatatattccctgaggagcatggttagagcaaatttcctcccctctccaacccccgcactgtttcacctcttaacaaaatgacccatgatatgaattcagctgttatttcaaagtaaagacagtagccctttcactgttgagcacattgcgtcttattgataaaagatacagctggagcaaaaggcagtgtgcatgcccttcctgtaatcctcttggagcatggaaatggcaccagaccattatgtacatctataatgtaaggctccatattactctacagagacaaaatgagaggggcattttccataggaaatgcaaagcacttcaaaatgcacctgagcacttttctgtttgactaggcaccacatttgccaatttagaaggcacagtgattatgaccttgcttttggaagttaaaagcccattgatttctgtatgcagaagatgctagcaaattaactagctctttttattttatcagtgagataagcatcttaatagactaataggtaactttctatgttagtgataatataccatgcaatgaacaataaatttatgtagtaaatgctagtctatattttttattcttgcggtgtttttcaaatactatgttttttatatattgtttgtgcccaagtctcaactttccgacaacttgaaatttccttaagagtagagatcatgccttatctgtagcttttgaatgtttttatctcatttaccctctcaactgcccttacagagaggcataattgacctccatagtgctaaacacagggccttgcatgcaactcctaataataatagcattaagcattacagttttaaagaaagcttctcatatacattttctctcttatttatctcatgcttattttccagatctaatggcagaaattcagaaaggttaaataacttgctcagggttacaaaggcaggaagcttctgatccaggcatagcccaagtcttctagccccagattggataccctttctactccaccacattaccaggggttttaataattttttgttgactgaatgcatataattgtccccaaagtattcccctctgcaaaaaccttctatatctccctctaacatatacacatcagtatgtgtgtatctcttattggattatattccaatgtggctgcattgctcaggctttgcgataggaccacatctgtagacgggggttagaatagcctttaacgggacaaatatctggggaaaaagtcctcagaatgatctttaactgttaagatagaaccttcactttcttaagtaaagacttttaggcatgtaggtaagtttcagtgtcaggtaggtttaggtgtcagatggttgctaagctaatcttcccccgcattcccataggagaccaagagctggaaaagcaaactaaatcttgtaaatcggtctatttagttgtaactttcttctcttatgtttatttcttgtctgttattctggagtctttaggaaagttgtggttagagattctagcctgatcaccattgtgttgtggaaaactatggaaatagtcattgcatgtcccctgtacatgctaatgtttttactgggaagctgtgccctgcagacactagtgatggaggcagcaacttcagggatatatcatccaaggatataatctccccatgtggagattctcatttacactgccaaccttacagtgacagtgggttttctttaaaaaagcaaaaacaaatatattgaacaccaaagtcaatagatagaaagctgtaacatacaatacaaaaataaagtttttaaaagacaaaatgtttttaaaaatagaataaatcctgagtgttagatctgctggtcattctgaaaggatgaccttctttaataaccctttaatttttttattttatgttttatcaacaataaaaatttagaggaaatatatcacccataagataactactaggatcccagggataatgggtgtccctttaattcattccactttggaacatcccaatggttggtttaatgactttaatgacttctgtttccagggaagaagagtcctgttcttctcctctgcccaactttcatagtcattccttcaagtatttattgagcaattaaaatgtgttaggcactatgcagagctctgagaataaaattgtgaaccaggcactcactgcttctgccttcctagaattcaaagtgtagaaggaaagacagacattaatcaagcaattgaaatgcagggagtctagttctagaaaagagaacataaaggatcttgttagggaatgtagcagggatgactaactttgtccagtgggtccagataggcttctcagagattctacgatttaagttgagcctgaagagtgtatagttagtagccaagtgaaaaaagggaaaaaaaagggtaagagtgtttctggcagagttgtaggatatgtgaaagcccagaagtgggagagggaagaaatggcatagtcaaggaaatgaaaggaattgactggagcattgagtttttcttccataagctttgcaagtaactaccattagctttaattagatcataaaggagcaggttcaaagaacattgctccagtaataacgtatgctcagatacattcagctcataggaagtaagaagactggaacactcagataatctcctggatagttttaactatatttatgtattcattttgcatttggattatgttcctttgacctcttaagaaaggtgatgtgaatactattcatgcctcacatttcttaattaagcactggcttattttctgagccacgtttaaaaactgaaaatggcaaatacctaaaaatacatcttatcacagacatgtgagacttctatactaaaactgcaaaacattgcttaggaaaattaaagcaggtttaagaaaagagaggaatgtaccatatttatgaattagaagacttccttttgttaagaggtcagtacccttcaaattgacctacagattaaatgcaacaccattcaaaatcctgctagtaagtagtaaagatgactataaacttatatagaaatacaaagggcatagaatagccaggataatctttaaaagtaagaacaaagatagaggacttacatttacagatattaaggctgattataaagctaaactaattaaggcagtgtggcattggctaaagaatgatccagtagatcgatggaacagactacatagttcataaataatcccacacatataaggtcacttgatttatgttaacagcattactgtaattcattggagaaaataatggtctttttagaaaattacgctggatcagttggatatctatacagaataccaggaacccgacccctatttcatatcatacacaaaaattaactagggctggatcatagacttaaaagtccaaagacagaacaataactcttttaaaacaaaacataggtaaatatctcaatgaccttagaacagataaagagttcttaacaggatgcaaactgcaccaccataaaagaaaataataaattatgttttatgaaaattcaatcttttcattaaaaaacaccatttagaaaagataaggacaaactgcagagagggagaagatatttgttacatgtgtatccaacaagggacttgtatccagaacatctaaagaagttctacaactcaaaaaaaaaaaaagagagagagactggccgccacctcgtgaaaaaatggacaaagcatttgagcagatacttgacaaaaggaaatatcaaaattgccaacatggtttcatgtacacctgtagaggtacttacactatcaatcatcagggaaatagtaaataaaacccacccaatggctaaaatttaaaggactgacagtatcaaaggaatgagaatgtgaaggaacaggaactatcatgcactgatagtcggagtgtaaactggtagaaccactttgggaaactgacattgtctactaaaactcgtatactttaaggcatatactcaaggagaatgaatgttcatgtaaaacattcacaagaatgttcacggcagtattttcataatagctgcaacgtgaaagtaaaccaaatgtccatgaatagtagaaaggataaattaattgtggtaccattcattcaataggataccatacagtaatgaaaaagaacgaactgttactatattgcagtactatggatgactgtcatgggtgtgatgttgaatgaaagaaactagatatcacaatatatatatgacttcatttatataatgtttaacattagacaaaactaattcatggtgatagagatcagaatattggttatctttttgaggaggtattgactggggatagaatacaagggagtcttctggagtgctgaaaatgtttggtatgtttttctgggtggtggttaatgtgggtatatacatatttaaaagtgtatggagcaaaaaaaactgtatattttgcacttcagtgtaagctagaccttaacaacaacaacaacaaaatctaagcagctgataataaggagtttgagaagaggaacgggggaatagagtcgtagagcttacatgaaaaaaagcatagaataaagtgagttttagcaacatggttacttagaagccctttagaaagaaaaggaccatataatcaggagtatctctgttgtttacatatccaactttttaagttctttaccatttcatacatatatctcccagccctaaatattcggagaactctttctgtaaaaatgtgggaaaaaaaaaagttctcccttcctcaggaaagtatatttagtatttggaaactcgtttggggaactagaacaaaaggctaagagcaccagaagttcaccagagagtcatctgggacttcttagttctaataattatgctaaaagaaaacactgaagaattttctagcagttttcagattcatcccaccacatttagcaacaccgcaaaaccgttcgatagttgttatacaacatttctttacaaatgcgtgaaatggtatgaaaacgaattttgagaatttctgaacactttagtaatcatccgatgctgttgatgacattcttgttgatggtcaaactagtaatggaaataataaatctttggatcactgtcagttgtctatgggattgttagacttcaacccacttccaacattatagctagaatcctaagtcatttagcctcttcttaaagccttccccacactgggtaggataggctaggctaggttatgggacagagacacccacaagtctatgacttaaatcaatagaagtttttcttttgtgttcccagccaggcgtccaggttggtggggtggctgtcctctaagaagtcatttagagactcgggtgacaacagctttgcagtccttaaaacttgcctttcagtgttgcctggatgtggacatctcagtcatcccaaaaagagaaagcacatacaggagcctgtatggaagagttttatggacaagcctggaagtgatgcagtttacttctgctcagattccattgtagagaactttgtccatagcgacaaccattttcagaggagtctgaaaaatatagaagggcagatggatttgggtggaaagctagcagattccaccataagagcacctggtcatcatgctaaaacgctgaaatgctgtcaggcctatgatgacaaaaggagccatcactgacaccaagcgttactggatcaggtgtgtacaaagaacccaggatccacattttccagagcagagcaaattagaataaggtaatttccagcaggaaggagcaaataaatggtacagcaatatataaaatcttaacacagaaaatgttttaaagatttagactaatgggaaattgaagcagctggacaagcttccttcttggcacacaattactgcagcaatgtcttcttttttaaaaaaaaaaaaaaaagaccacaccaagtgacagaatgttagtcatcagactataaaaatagaagctacagacccaaagcacaagatgatgtatatttctgtgcagcaggttaaaaattatttgactagcatttttagcacctactatcagtactggggcaacaaaatcaagatatggtttctgccataccctccctgaggaatgtagaaaacagtcaattaaaatacagtgaccattcaatgtgataagtgtcttgtgaggtaatagaggtatataacgaactgctttcagagcctgaaagtggagcatctaagatcagactttgggaatcaagatatgtgcttcctagaaggtatggcacaagctgaattttgaagggccagtgaaggagaaacaacgtgacaccaatgggaacaacatggaaggggatgaacactgggaacttacaaaaggaaggaacttacaaagatgaaactgcttgatgagctggaagattgtagatagtttagttttgctagagaaaagaatgtgaaagaagccaaagatggaggtagagaagtgggccagggccagatcatgaaggtcctgtgctcacattccagagtttgcatttaccctggatgtctgggaactgctgaaagtgctgttaatgcatcagtcttttgagatgcttctgaacaccgatatcaaccacactttggtattcagtgacagcataatggatccataaagggaaggacctgatctttttccccattcactctattcaggacccactatagagtgaataaatactatctccctaacagaattactttctgcaattcagttcacctgttaatttattggttgatttgtggatgtgagttgtgtttacttacagtgactggccatcaataagcataataaaactatactgtactataaaatacaagtaggtttagcttaggcagccaagagacagaagcaaattcttcagcttttcacatagcacatagatcaaaagaaagattaataaaaataaaagtaataaaaaataaaggaaataccaatgggataaaaatattgtagacctttactgaagaatttctgctgaaatatgtgcttctcagattagagagaaattgataaaagggtgccctgggctcagtcttgtgacctaatgcttccactaatgacctgaaagaggaagtgaacccagttagctgttttctgatgacagaattgcttccttaagttaaaaacagaaaacagaaaaaaaaaattcaccagctgagcaaacattaagaatgttggaacaatgtaaaaactgaccaaattaacctgaaatgtatctacatattataaactacacgattgtgaataattttgactgtatttgacttgccatgggctcgaaaatagaagacctttttctctgtgatcatacatcaacggatgtaattacatagtgggtaatagtttgtattttaaaataagaagccaaaaatcaaattttgtatgcattagaatattttcatgtaataaattaacaaagtgataaggaaagagagtagtagacgaagtgctgacactccattttgggtaatataaagttaatctcgctgttcggagatttggtgtaattgaggaggtaaagtggtttagtgaaatgagcaggggctttcacatcctggctccacccctgccagttgagtgcttaatgtttccgaaacctgctttccttctttgtgaaatagaaatacagtaccacaattatgttgtaggtacattgtgaaagtcaaatgagaatatgtgcatgtatgtatgacatctaatcagtaagtggtggtggtggtggtaaggacgagggatggtatctgagaaagcctgagcagtaattcagcaaacagagcatgttgtgccctgttgaagagcagtactatgtagtgggaaaagcaaggcctgaggagtgatttgttcactcattctgctatcgtctcttcatttactcattgttgtgcatgcctgctgcccacgaggcacaaagccttagccttagaaaattgagtgctgtggtttcccccttcgtgcagcttagagtctggagggtagctgagcacacacaggatcaggtggcacttaccacggttttgtctcataagggcgtctgcaaagtgcactgactgcagagaggaggaagctgctaactctgctgaggggcattacaggaaaaggttctcagaggagcaaacccttaagcggaaacttaaaagatgagtgagaattaaccatgtggaccaaaaggaagagggctttccaggcagaggcagtacagaagcacgtggatgggattggcctgctgtagctcagcatgcatgaaggataaggtgcctggaaggtaacatgggaaaggagacctctggactaaggcaggcaggcagggcctgggtgcaaagtttgtgtttcgtacaagaggagacaacatccaaccccagtcctggcatttctacacactggctgtttgcttttaggaacggtactttgtacctaagctttctcctctgtaaaatgaggggagttgcagaatgaaacagttgtaaaacaggaggccctccataagtgttcacttcctttttctcccctttgccgtccatggaaccaaagactgacgaggcaggagcgggggataaacaagggagaatcacagctctcttccttggaaactccgaaaagtggattatgctaggagtgcccaattctcctgaatcatcgttgagataattattttgagattttgatccagtacaacatttgatatattcctagaaaatgaccatgaggcattggtgtgctctgtttttctaggtggcttttgaacccataatccccgtttgatttttgttttgttatcagaacatgtataaacctgaacttctgaagagcaagtagggaaaaagtttggtggcttttccactattatctgaaaatgagtatctgaatgaaggttgcatgccatgtttttataaatcagttgaaattgtgtcagctgcatgtgtggtttattcaggtggatataaagaaaaaaaccct[450 bp omitted]ctgacaagcacatgagatgatcctttctctcttttgccctccagatggtggaatttttgtctccaaggccctgtttaaccacccattcctctctttctcttagcagtggaacgtgtatttctccctggccttggtttaaagtctttctcactcattcttcggtttctttcccctactattcaggtgtaattctcttcagcgcaatggtagaatgatgctgccaagagtggacgtgtttgtgtttcccgcattaaagagtatgaattgtctcatttgtctctctctctgttttttttttttttttttttttttgagatacagtctggctgtgtcacccaggctggagcacagtgcaagtgatcctcccgcctcagcctcctgagtagctgggactataagtgctcaccaccacacccagctgatttttttatttttttgtagaaacccggttttgccacgttgcccaagctggtctgaaactcctgagctcaagcgacccacctgcctcagactcccaaagtgctgggattacaggcgtgaaccaccacgcccagctttcattttttttcttgccatcttgggggaaattctcacactataatgtggggggcaactttatatgcacatttaaagctcattcatttctagtgcactaggttcgttataaaagcatacagaaaaaatgtatatataaatgagttttctgtggctgcttattactacaactatttatattgtcataggtaccttttcaaaagtcagtttttcaatcacccattaagtcagattaagaggaaagatcatgttctctatttgttgatgaacttacaaaacatgtaaaacagacgggaaaagaaatacataattaaagagactgaccacatttcctagaacaagccacgcatactccattcccagggcctttgtgctcactcttctttctgctgagtcttcttccccctgagatcggtatggtttgcttcctcatttcctccaggtctctgctccaatatcaccttctcagaaagtctttccaagactattccatatgaaacagaatcctctactacccctccaaaccctgcactcatatctttcttacaatgctttattttcaccaacagacaatatgtttacttttgttatttattgtccagtttcacccactacaacataaccatcatgaaagcaaagactttgctttattctctgcttatctccagcaccgagagctataggtgttcaattatattgcttgggaggaggaagagagggaagaaaggaattaagaagtaagtaatggtgtcaggaaaattaaaacctggaatggcctgaggtttatgaaacatcttaataacaacaaggctgttgtgagcatgaaatagtaccttggaaagacaggcctgctactggaaacagattatattccttcttcatttattagttggaatgcttcagcaatgaataactcccttgtcaattatccggtcgtcctgaagcacagacagtttgataggatatgcaggataaatgtttgtttctttttctttgtcaaaatattgaattggttcattagcattctctacaggtgcccagtgagggttttgtttgtttgtttttctgttgatttgttcatttgcttgtttttaagtattattatgaactcatagatttggatatatttgatgtgttttaatcgttgccaatattaacttcattgatgctcacaatgtctcatttttggctagtgggagtctcttaggttgactcctgagtccttttgaccccagtaatagccttctttgctttctggtacaaccgaatatttcagaatcatcttatgtatttccttccctagtcctggaatcagcagttttgtcaaggagccctggttacttagagaggggacatgatagtcagaggccgtgacctcattgcttctaagttagccgttacttgtagacctttacagtgaacagagccagaaaatgcattttaaatgattaaatcttaatagggaaagcaaagaaagcaaagcaactaagcccctattttactttcacctccgttgtcagtgatatttaaactggaaatgatagaaagattttagggaaaaattgaagctcaatctatgaaaggagcaaatgtgtgctagttatatttaaatacatttagtcaccagactaagatgaattatgtctcagaaagaactcatgtatgcaagcacagtaatactgccagtgacatttgagaaatcagaggtgccagaaattgcgtaacaagaaaatattgtcctatttttaaaagagaattttaaaacttgaaaattgaatgtactaaattaaactgtgttcttaaccaaatctagaactgatcacttctagatggtttataagcaacttagaaaaaacatgtgattatttcaaagcagaatgagtttattttaaatctaacaccagaccaaccctatttattcttgttatattttgtaagtctcatagtcatctctatagatataaatggagtaaagtgagttatagattggattttttcaaaagcaagatctagctctatgctgtccatagcacacaccttaaatgtaaagaaacagatttattcaaaacaaaaggatagattaatatatagcctgcaaattctaatcaaaagaaatctgaagtggctttattcatatcagacaaaaacatacttcagcacaaggactattaccagaaataaggatatttattgaagataatagggtcaatttataaaaaggatataacaatcccaatgttgtctacaactgataatagaatataaaaatagaataagaacttaaaggaaaaatagacaagtctacaataatagttgaagatttcaacactcatctttcagtaattaatggaagaaatagacagaaatcaataaggatatagaagactgtcagctaccttgacttcattgacatttacagaatgttccattcaacatcacagtatatgttcttttcaagtgcacatgaaacattcaccaagatagactgtgtttaggtttataaaacaggtctgaataaatttttaaaaatcaaaattatgcaaagtaatctagttatgacagaattaaactagaaatcagtaacaaatatatatctgtaatatcccctgaataattggaaattcaacaatatttatccaaataacttgtggattaaagaagatgtcacgagggaaatcaggatatattttgaaataattgaaatcagaacacaacatatcaaaatgtgtgggatacagctaaagcaatgtttagagggaaattaaaaccattaattattagaaaataaggaagttctcaaatcaataatataaatttttatcttaagaaactaggaaaaaagaacaaattaaacctaagtacacagaagacagtaattaagagcaggggcaaatgaaaccataaacagaaaacaatagagaaatcaaaagctggccttttgaaaagatcaataacattgataacctatagtcagattggtcagaaacaaaagaaagaagacataaatcattaatacttagaattaaggaggacattactatagacagtacaggcactaaaagaataataaatattatgaacaactttaagccaacaaatttgataactcagtgaaatggacaaatccctttaaagacaagctaccaaaattcactcaaatagaaataaataacatggtagccctatatctatgaataaatcatatttgtagttaaaaatctttctacaaaggaaacctcagttctatatggcttcactcataaaatgtgccaaacatatacggaagaaataatatcaactttacataaactcttccaaaaaaatgaaagaggagtgaacacttcccagttcattttatgagggcagagttaccctaatagcaaaaccagaaaaagatattataagaaaagcaaactacaagctaatgtccttcatgaacatagacaagaaaaattattatcaaaatattagcaaaaggaaatgatgatggggtttctttttggattgataaaaatgtgccaaaattgatttggtgatgattacacagctctgggaatatactgaaaatgatttaattgtacactttaaatatgtgaattgatgtttcctcctaagatcaggaacaaaataaatatgctttctcacataaacttctgttcaacattaacatagccaatataataaggcaagaaaaataaaagacatataaattaaaacagaagtaaagctgtcttcattcttggacagcatgtgtacatagatgtatccacatgaatttttatggaaaattctaaggaatctccaaaagaacttttaaagctaatcgttgaattttgcaaggtcacagtatacaagctgaagttataaaaattaattatatttctagtaatgaacaattagcaattgaattttttagaaattataatagcatcaaaatatgaaatgtttaacaataaatttaacaaaatatatgcaagacctgtgcaccaaaatctacccaaaaagtgccaagacaatttaaaaatccaataaatggagagagagaatgcattcctgggtcagaagatattaagatgtcaattgtttccaataaatctgtagattcaatgcagtcctaataaccccccaaaggcttttttgtagaaattgacaagctgaccctaagatttgtatagaaatgtgatgtacctggaatgggcaaaacaatttcaaacaagaacaaaagagtaagatttatactacatgatttcaagacttactgtaaagtgacagtaatcgagacagtgtggtattggcataaggacagacatatagatcagaataatagaaagtccagaaatagacctacacaaaagagccaagttaaggcggtttttcaagaagtggtgcttggactattgggtatccgtattgaggaaaaacaaaatgagcctacatctttgtcccacaccatgtgtaaatgtgaacttgaatcagatctcaagtctaaatgtaatagctaaaaatactacatttctagaagaaaaagtgcaggaaaacagtcttttagaccttagattaggggaaggtttgttcaggcattaaaacacacacacacacacacacacacactcaggcattaaaacacacacacacaaccataaaagaaaacttggtaaatcagacttcatcaaaatttaaaacgtttttatttcaaaaggcactattaagaaaatgaaaggcaagttcagacttaaagaaaatgttttcaaatttagtctgataatgaatttgtatttagaacatataaagaactcttaaaattcagtaataaaaagataaacccatttttaaaataggtgaaagatttgaatagacacattactaaaaatatatgtggcaaataagatatgaaaagaagttcaatatcattagtcattagagaaatgcaaattaaaatcacaataattatgactataatggcttgaatttaaaagaccgaaaatgccaaatgttaatgaggatgtggagcaaatagaacttgtattcattgctggtaggaatacaaaatgatgcagttactttggaaaatggtttggcaatgtcttataaagttaagcacacacttactgtatgatttagcaatcctgcccttagacatttaccaaagagaaatgaaaaatgtgtttacacaaagacttttgctcaaatatttataacagctttactcaaaatcaccaaaaattggaaacaataaacaaaagagccaaaaaattgatgtacaagtaacagtatattcatacaattaaatactacttgagaaataaaaaagaacacactactaatacatgcaacaacacttatctcagaaaggattgtgctgagtgaaagaatccagccacaaaaaaagactatagactacttggcataattctatttatatgaaactgtagaaagacaaatataatctatagtgacagaagtcagattagtagttggcaggagctgggacttgagggaaggaattgactacaacgggaacttttaggaatatagaatgtcttatatcatgattgtggtcatagttgcataactatatacgtttgttcaaaaattcatagaattgcacatctgaaattaaattgtagctcaacaaagctgcttaaaagtaatgatgatgaagatgatgatatgataatgaaggaaatagaggcatcatctccaaggtgcacaataaacagataccctctctgcatacttttcccctaaaaacagggaatccactgaccacagtgcacttgagggaatttgatgggctaatttctttctactgcgttgagaagcctgagctaaagaaacttagcaagatttctgataatagaagctctgttcaggctatgtggcttgaagtttccctatgcctactttgaaactgataagatcaacattgttgaccaggggttcttgagatggtatctaaacattttgtgcacatctcagaatactgtcagtcacgtggtcaatggtggtagatttgtgaccctgtgtcccatggtttaaagagcatggattatacaaccaaatacacctgagtctggatctgatatttatttgtcagatgagtatctgggtctcgatttcctcttctgtaaaatagggatttcccaaacaaatgttatggcatgtaataggtggtatctgataaatggaaagggttctgtgtttctaaaataaattttggaaacactggagtaatcaaagttaaaaagaaacctttatcatgaaacttcttagatcctttcatatgaattgctaagcaggcaaaagtaagcagcctgtgtctgtgctatccggattccacaaaacagaaattcctcttgattcattgaggcaagcagaggagttaattagaaatcccatgtgaccataggaaaagcaactggatccagaaactttagtgctactaggtctctcagtctctccgtctctctctctctctctccctctttttctctctctgctctctcccccctgtttttctttgtaggccacctttgttctctcagaccaatgttccttacaccacaagaaatttaaatggcaagattgtctgcccctaatgctttagccaacagagaaggaaggagactttttcactctagctccaggttcagaaatcctaaggaagggctctgattcacccagctttgatcaggtgccgttcactgaattagccaaccacagtgcattatgattaattcaacttgggtaaagatgtccatccctggtctagtcagtggaatttggcctataaaaaggcttgccaccccccatttaaaccacgttattaaagtaaagagaagaaaattgttttgtttgtttaataatgcttttttttaacatttattttaggttcaggggtacaggtgcaggtttgttatttaggtaaattacatgccggggggtttggtgtacagattattttgtcacttaggaaataagcatagtagctgataggcagtttttttatcctcaccctcttcccaccctccacctacccgcaagtaggcgttggtgtctgttgttcccttctttgtgtctatatgtactcaatatttagcttctactctaggtgagaacatgcagtatttgtttttctgttcctgtgttagttcacttaggataatgacctccatctgcatccatgttgctgcagaggacatgatctcatttctttttatggctgtgtagtatgctatggtgcatatgtaccgcattttccttatccactctaccactggtgggtgtttaggttgattccatatctttgctattatgaatagtgctatgatgagcacatgtgtgcatgtgtctttatggtagaatgatttacattcctttggatatattcccaataatgggattgttgggtcaaatggtaattcctttttaagttctttgagaactcaccaaactgctgttcccaaaggctgactaatttacattcccaccagcagtatatacacattccttttttctgcagcctcaccagcatgtcattttttgactttttaatagccattctgactagtgtgagatatatcttactgtagttttgatttcatttctctatgattagtgatgttgagcattcttttcatatgcttcttggccatgtcttcttttgaatagtgtctgtttatggttttggcctgttttttaatcaagtggtttgttttttgcttgtaaatttaagttacttatagattctggatattagacccttgccagatacatagtttgcaaatattttctcccattctgtaagttgtcttttttctctgttgatagtttcttttgctgtacagaagctctttagtttactttggtcccatttgccaatttttgcttttgttaaattgcttttggcattttcgtcatgaaatctttgttaggtcctagtccagaatggtttgtcccaggttatctttcaatgttttcatagttttagttttttcatttaagtctttaattcatcttgagttgatatttttgtatggtgtaaggaaagagtccagtttcagtcttctgcatatgcctagcagttatcccagcaccatttattgaatatggagtcctttctccattacttgtttttgtcgactttgttgaagatcacatggttgtaggtgtgtggcattatttctgggctctctattctgctccactggtctacgtgtctgtttttgtacccgttccatgcttttgccttatgtgcatataggcccacagagaaatctagccctaagaagtaaattgaaggttcttttcatgataggccattattaataattacgttttactggtaattaataacaccaatatgctgttttggttactgtagccttgtagtatagtttgaagtcaggtcatgtgatacctactgctttgttcgttttgcttaggactacgttggctatttaggctctttttttggttctatatgaaattttaaaatagatctttctacttctgtaacgaatggcattggtagttttataggaatagcattgaacctgtgattgctttgggcagtatggacatttcaacaatattgattcttcctatccatgagcatggaatatttttccatctgtgtcatctctgatttcactgagcagtgttttgtaattctcactgtagaaattttgcaccttcctggatagctgtattcctaagtgttttattccttttgtggctattgtgaatgggattgcattcttgatttggctttcagcttggttgttgttggtgtatataaatgctgattttttttataattgattttatattttaagactttgctgaagttgtttatcagatcaagaagctttgggaagagatgatggggctttctgggtatagagtattattatctgcaaacagggatagcttgacttcctctcttcctatttgggtgccttttctttcttttcttgcctcatggctcaaagctaggacttccaatattatgttgaataggagtactgagagagggcatcgttgtcttgttctggttttcaaggggaatgctgagaagaaacattttttcaatgaggtaaggatatcgttgaggggagaccaaaaatagatcctgaagtctactgttggctgcccacacacatgtgtggtgcacacacattcacttacacatacttctttgcataataaaatatgaaaattgcttctgccatgagtggatgcatatatgataaatgaagtaacataaattgttaattaaaggaagtgttaattaaaggaattcagcaaaattcttggttatttggccctcgagaggtcttggttcatcagcctcggatgaaaagatcctcttttaatgaagccaaataaatatctgaccttctgttttggggtgtttgtttgtttgtttttgagacagggtcttactgtcacccaggctgcttctggagtgcagtggcatgatcacagctcactgcagcctccacctcctgggctcaggcaatcctcccaccttaactctctgagtagctaggactacaggcaggtgccaccagcctggcaaatttttgtatcttttgtagagatagggttttgccatgttgcccaggctggtcttgaacacctgggctcaagcagtccacccatctcagcctcccaaagtactgggattaccagtatgcagcactgtacccagcctgaccttctgtttttgaagtgacttcagatgggctggcttagactttctcctgtggcaccttattaaaggccaaaagaagtaattgatatattcagtgatcttaaaattttccctgaatgcaggatgttgcctcaggggaaaataggggtgaacagatccagttaatgacggaggagtattagagctgattggggaagaaggccaagatttctgatgtggtctgaggtgtccatgagaagttgatgtgagtagaactggctggtggaaaggcaagctagacaataacattaagtctggggtagtcaggtacagaggagtcatcctccacaccccagcactcaacccctcaccagggcctgctttgcctcttaagtgtcttttggatcagagcagtattttccataaccagcatcactatccaaatctaaactactaacatctttcctcttgactccagatctattcttttttttttttttttttttttttttgagacggagtctcgctcggtcgcccaggctggagtgcagtgcgacgatctcagttcactgctacctctgcctcccaagttctagcgattctcctgcctcagcctcctgagtagctaggattacaggcgtgtaccaccacactatcaaatttttgtatttttagtagagacggggtttcaccatgttggccaggctggtctcaaactcctgacctcgggtgatccgcccacctcagctcccaaagtgcggattacaggcatgagccactgagcccagcccaaatctattcttatctaccttcaactctctccttcagtccatctcccactgcagtgagtaatctttcaaactgaaaataggatcctctctcttccttgcttaaaagcctccagtgtttttctgctattccaggataaaaattaaaatcctgagcacgccaacaaggtgctgctccaggatgtgccccaactcacctctctgcctcatctcatcccaccctcctgctcgttctgagcaacgcagctacactgacctactctcagctctaggacctgctttattgtcctccaccccacaacccttgcacacacttttccttccactggacttctctccctccttgcatagttaatcatgctagtccttcagagtagaggttgagcaccatgtcctcggaggacatcctctgggtcagattccttggtcaatcattcttgagggactatgtgactttccttctgagtacctcactcagttcatagttacaccttcgctgatctgaaatatacccaatgtactatcgattccatttgtgccgactgctaccagcatatagaagatactcaataagtatttgctgaatgaatggatttaaggccagagctatctcctataagaagatataaaaatgagagtagaatcattgttttattttataaggttaataaaactcttagaaaaatgcaaaactactgtcatattattggttgtagaataataaagacctttccactggatagaaaagccagattgaactgaaagtacgaatagctttggcttcaccatgcgttgttcaatttggggctaagagttagaatttcaggttagaaggaataagtacagagaagggctctgatgttttgccagtcaaatcattgctcctttctctggtaaactgaattgctgtggcctgaggaagacagaacccagactaaggaggctctaaaatacatggccattagactaggcgcagtggctcatagctgtaatcctagcactttgggaggccaaggcgggcggattttctgaggtcacaagttcaagaccagcctggccaacatggtgaaaccgtatctctactaaaaatacaaaaattagccaggcgtggtggcgcaagcctgtaatcccagctactagggaggccgaggcaggagaattgcttgaacccaggaggcagcggttgcagtgagccaagatcgcaccactgcattccagcctgggtgacagagcgagactccatctctaaataaataaatgaccatttcctacaacttggagaataagagaagatagatggggtaacagaaataaaactaagaaataaagggtacatttatttgagtgaagaaaattttaaaagggccttcaaaaccacaggagctcctcaagatatttatgtaatagaatataacttatctagggttgagaggaataataatcaagacgtttgtcacttaagtgcatctggaggcatatgaaattagactcttgatagtggcctatgcttggctatgtccttggtgttttaacctcaggcttcaggctggaaatgtgttttctagagcagacatggagcacaaaatattaaatgaactttgctgtattcaaaacgcccaacagtgtagcatcctccctgtttggcagggaaagggctcagcatttggaaactcagcagtgcattaagtattttaataatcattgttgacatacaaagcatatggcctttcagaatcattgggtcaagtgttgaagttgtcttctaggtttctaaaattaccttacaaaattcaaacaaaatgaaattagggtacatttcaaactacgctaattcatgagctttgtgttatagcaagtgaaataagttttctcctaagatataagagaatctatgagtaactgattatgttaacgtaaaggaaaaagcaaaattgacacccctgcagaaaaagttaattcgcatttcgttagaaaatctagaggttccatataagtaggccagccttacgaataccttatatttactttgtacctcctagtcatgcctaagacccacctcaaatatcccatcatttcagaagccttcattgtctgtttccttacagtttatatcagttgtctataaccacaataatgctgtgaaataagcaaccataacactcaatggcttaaaacaataagcatttctcattgcacacaaggctatggtaagcaggaccattctcgtctttgtgggctcacttgtgtctgtggtcagctgtgggcagggagggtctctgctgataatggctgggctccctcacatatctcagagtcagctggtcaaagactgatctgctgggacaactggtctctcctcctcacgtctcttgcatgcatatgtttctcacccccctccagctggtcagcccaggcatattctgatggccctctcaaagaagcaagagagaaagtggaaacaggctggcattgttttgtcaagcttacagtttcattacatttgttaacatcccattgaccaacgcaagtcacatggccgagctcagagtcagagtaggagaacactacagagttacagggcaaagaatgagaatacagggaggccattagttaaggctttaatgccatcatcctacaaccccacccctctctgttccaccaccagcattaatcatttccttgtctgtgctgtctctctgttcctcttagttctatgtttttaattttcccattctattataatatagtgactaacttgtctgtcctccttaagagatgagggggtctttatgctatgtgcattcatttataaatatttattgactccctgttatgtacctcattcctttacagctttatagacaccctagttcctagcgttggtcctgacacacaccaggcactcagtaaatacgtgttgaatgaatacatacttgaaagctccgactcccacgtgtattttcttcccctttgtaggaaaaggctgaagacagatgcctttcaggaccccagctgaggcggccttcctggccagagcaaccgatgaccaacacagggatctacagtgaacatcttcccctccagactcccccgattctcccctccagaaattaggttttcttttttctgccttcctattcctctcaaagggaggcaggaaatctctaacacttactcatcctagactctttttatagtcagagctcccagggaatttaaactactggctctttgctctgcagtggagaaccgtccagctcatggtatggtcagtttgaaaggaactgggtggctactgatctttgatcttcccagatctgtagaccaagaatacagaagaagtcttaggacagttttgacatagctatagacacaagattctattcatacagagtattaattctttctatcagtgtagtgttcaatgtactgcctcattattttccaattccatagaatccttcagggaaaacttgtatttctgggtagaatcataattctgagcttcttgattttccagtgagtagcctaagttgctcgggaggcagaatagcatggctttggagtcaggccggctaatttagaatgccagccctgcccatgagtaacttgccttgatgaagcctcgcaatcctcatcagtaagagacagtaataacagcagccaaaatagaatgatgctgacatgtgataagtaaattgtattcactgttagatttagttattattatataacatcctataattttatacattgtgaatatgttcatattagtggtgaaaatgaatgtattttatataaaatgatctatgtatttatttttattagaaaataaaatcatcacttcttaaactacattaaaggttatactttaaaatgcatgcaaatacctcaccttttgcaatggcttgaaaaatttctttattcagccaacaaatacgtattcagtacctgctttgcgccaggttgctaggcaatataatgatgaacaacgtagacatggtccatgccctcctggtatcctatgatgaaagaattattaatacatcagtgttacttccaactctcagtaacctatctagtatctataactttacgatgatctgagataaattaatatttgaactcatcacactgaatacactgaatatgtacagctttttatatgtcaatcatacctcagtaaggtggtttttgaaaaattggctggttttctctagccaaaatatgctgtgttgacactatagattgaaggagggtgtaattttaacttcatattttgttttgttttttggttttgttgttggatgtttatttgtttgttttttttgagacaggctctcactgtcacccaggctggggtgcagtggcacaatcttggctcactgcaacctccacctcccacgctcaagtgatcctcccaccttagcctccccagtagctgggactataggcgtgcaaccccacacctttgttgttgtagagatggggtttcaccgttttgcccaggctggtctcaaactcctgagatcaagtgatccacccacctcagcctcctaaattgttgaaattacaggtttaagccactgtgcctggccttgacctcacaattttcaatgcagccgtatcaagttgtaaaactttctattttgttatgaaataatgtgtaaaatagatgtttctgaatctttccctgacgttcactccatccccaaattcctgtatggtttaaggatcgatggaggattactagtacacgttactcagtagtaaaaagtttcatccatgggaatagtttttttaggctgtgtcaaaattccctccgacgggatcttagattggatcctggaacagaaaaaggacattagtgggaaaactggtgaaatccaaataaagtctgtaggttagtaaataggattgtatcactgtaaatttctttgttttaacaaatgtagcatgttctataagatgttaacactaggggaagctgagtgaagggtatgagggaactcagcttctaaagactgtaggaaaacaatggagcaaagctgatttcctcaccaccctgcttgtctccagtcttctcccaaccatgatcagtttgtgaatgccttgagaagaaaggattttaacattagactaagaaaaatagaattaggatgacaagtgtgctataaaatcataatatgcagtactctcatttggctcctttggaggtaaagaatggatgttgtaacatcttcccatttgtctggaattttcaaaagtcttttcatatgtgaaagagaaaaggcctgctgttggtctcatttcacctgcaaattttacctacttaagggttagggtgattcagaaattcctctttattttcataggtacaaacacaagtgcgccttgcaaaaaaaaactttgacaaattgaagatggatgtttgtcaaaaagtggatcttcttggagcgagcagatgcaatctcttgtctcacatgctagcaacataccaggtaacaaaataatgtttgttgcaatgaaccaaggatggcacaaggtttaaataacatcaaaatggtgtttgagctaaaagtaagctttggccattgtgaagttctgaatgcctttccgtaatttcacttcccacatctctgccttctagggccctacgtttaaccaaaccaaatagtagttatttcctgtatataccataatttcccacttctgtacatttacttatggggtcccttctacctggagtgcctttctcctccatccgtgcctttccaaattccattctttttaatgtacgagacagaatgtcacgcctttttcagtaagcctcctctgaactcacttagcgttgtgtctgtccatctcgtggcatatctttctcatcaggttgtcagtattcaatgcattgtttttgtttcccctgatagcctctgagttccttccggataacactgcatcaacaatgctactgagcaccaactgagggcaggatgcagaatgctggatgttgtaggaaatataacagttaagaccagggctgggcacagtggctctcacctgtaatcctagcactttgggaggccgaggcaggcggatcacttgaggtcaggagttcgagaccagcctggccaacatggtgaaacctcgtctctactaaaaaaatacaaaaattagtcgggcatggtggtgggcgcctgtagtttcagctacttgggaggctgaggcaggagaattgcttgaacctgggaggcgaagtgagccgagatcgcaccactgcactccagcctgagcgacagagcaagactccatctcaaaaaaaaaaaaaaaaattaagactaggttccttgtcttcaaagagctcaaagtttaggaagaatctggagatagtgaagtctatttttctatacctctaggacagagcagagtgtgctaagtgaaataagttctaagaaagccagtgacagcttaaagagggagaaatagaatcagctgagggattgcaacagtagagcgttaattatttaccctgggttttggaggatggatcagatgagaaaaagagaatggagaggagaatgtcccaggtggtgggagcagcatgagttctgggaggcagcatttggggaaacagggaggcatttagtttggctgaaatacagagtgtaattgggggcataatgggaagcatggaaatgagttagaatcatgctttaaagaatcttcaaagctacagagagtcatacttccctggggaccaggactagaactgggcattcaaaacattaatagctttactgtctttctttgcagaccactctgcttcatttttgggagaaaacttctcacactatggcagccatccatgagagtttcaaaggttatcaaccatatgaatttactactttaaaggtatggaagctagaggggccactagaaaatcttgagaaaagtaaagttttgtttatatcacaagcaaagtccattgcagaaagcatcattattccaggactcagaatgctgaagagagaactgtgcccccagcagagtctttttctttctttctttctttctttttttttttttttttttttttttactgcatcaggattcaatacaatgagaatctactgcaatccaaaagcgcgaattgaaccttgaaccttgagatacatgttcctgggagatgaattgtggtgaacttgagtctaatgattggtcctgctcctttaaaatacttgtttgacattgctaaaggggagattgtacaagtcccataaactcagttacttttaattattatattcaaatatcctcacttgagaaggtgtcctcctttcctctcttacttctgaaatgtatcattttattctgagagtattatccaacataaaattgaatttttctgtaagactacagcaatattttctaattgaaaaagcagtattaaactcaatgatttttcatctcagtagggatacgtgcacagtgtctgattctcagtattggatctgcacatggagtgtttttctctctagtggttacagaggatgaatgcatattgagataaagaagtgattttggttccaaaaggattttaaggatgatgagagaacagtgggtacttcattgccaggtcatgtctttgcaagaagaaaacgaggcatgaactagctaaagttcaccttgaacttgccttgctctttatcgttcaagcaatttgtatgtgtttcatcaccttgcttgacaagacgttaaaacattcaaatgcatttcttttgctttaaaccatttttttgattctgagatgtgtataatgtcagtgcatacatacaagtaccaaaaaatgctttaagaccctggcccttaaaatgaaggttccaagaggaacccaagaaagtccactcaccttgtgctgcacctgacctggctccagacaggacacctggccaaagaatttgttcttcattatcctctcccagctggccgcccgcccattgattggcactagctggcatgttgcatggtgaatgcgttcacagtgagcactgttttgctctgtcaactataagcacttcaggggaaggagcttttatttcttatgtatcctcttttgtctagccaaatgttttgtacacagtgtgccctcagccttccccttcacactggcaatgttaccgttgttggtaggggcttcatcatctctgatttactgcaccttcagaagcaggcattctgaccaaggcagattggttaaaagtataatgcacactattcacaattcttatacaggcctgagcaaaatcccatggattttactctttgataaagcagaggcttttagggtttagggcatgcatgtgcatcgggttttcttttatacatcatttcaaagcttatctgtcttttacaagacaactgtacattacatacaccaaccagttagaagatgaaatgatgcctaccccaagtataattcagaagaacttcaggcatgagttagttgcatataaagtacaatgtgaattcatgaaattgaagttgtgccacaagcatggaagaacccacatgtgtatccctggcctcctgtgctgaggaaaatatggctccttaatttttgctacgacgtttatcctgcagagaggatcaagctgattatgttagagcatttctgggcagagaatttagtgaaagtttgacagcagtggttcaggacatacttacaaatattttgggcagatgactatctgttagcttttacatccccagagccttccttaaattatggtttaagtaatagttcatggtttaattgtgatataatcttagtaggagtaataatatatctgttagggtataatgatgttatggtaatattaagaataaatgttcagaaaccaaccaaataaactgtacttttgttcttttgttacctctctagaatggttttcatctaggctttcaatgatgacatatcacattagaatctcaagctgatagataattatcaggttggttcaaaagtaattacgggtttttccattacttttagtgtcaaaaaccacaattacttttgcaccaacctaatatttttctttatgtggactcaaatatgatataatggaatcctgttacgatacaactcactattagatcgatataagtatgttgcatattgttttgtatgccacaaaacatgatggtgaaagccattaatacttaatgtatcacagtaaaatacaaggatattgtgtgacttcccaaccctcttgcaccagtatttttaatacatgtcctgtgtttataagatttgtattttatcaagtcatcttttaatatataaaattttattctgaatggcactctgtgttgataatggccattttgaaatttaagtaaatatttccacgattaatttattctgttgatttacctaagcaaatagcccctgaaatgccttttgggactctgactggaaagaaaacattgtctttagagagggttgccaagctctgttaatgaaaagcaagccatttgttttctttgcttcagggtgtattctgagtgtgttggtaattgtgccattgcagctgtatttcctgactgttagttttatgcttgatgaaggatgataattaatgtgttaaacactcggtgcatcctgtttggagggacaagttttttgctacagaattacagagatataactcatgccccaagaagcacaaagttttacttctactgaacctttctgtaagaaatagagttataattcttttacaaagttattttattataaagatgaattgagtcttcacttcatacttgaaaaatatccaagtgactgttgtgatattttgttgtaatgttttatgtgacaacaaatattgcttttttacccaagcctaatataattatattgattctacttttactgacacattccttcatcattttaatttttttataataaatagatttttgtagcattttaactttatagtttagctttgaaatttaatatttaaaaaattttaatctgataattataacagctcaagtttaaggcagagaaactatcttctaagtggtttccaatgacaaaagcaattccctgatcttgtattttcacacaacaaacatttatcaattcattgaaatgttactacatatatatatatatatatatattctgcatgagttgtaattaatatatttattttatattgatgctaaatcatctgggactatctttcacgtggtagaaattattgagtcatggggctaggaatggaatattactagccagaacttgaaaacatggtcacttttctagagaaagtaacttagactaagagtttatggcattttaaaatactaaatgaaattctgtcttgttaggagagcagtaccctatcttaaattaccaacactgagatgtggtagtctttgcttcatctttcgaggatgtcatttactttcacatttctccacagatgccgagcagacattatcaagggggaaaaaaaaagacctcataagtagagtggcttttccctggaaaatctcacatatattatatcagtgaccattttccctctatctggcgtgctggcagcaggttgagttgggtgtcgcagtgagcattgggcccctcgcagcagtggacatactcatccaggggcctgtcctcctgcatttgtatttttaaggagatcagagtgcctgtatttaatgaaaatggccagtagtaaagtggattcctgtgagatgtctcttcccagtgtttttggaaggaaagccagttttttgactttgttcttcatttcctctggttttgtgataaaacaaagtatataaaagcacaatctctggagccagccagacctagctttaagtctggctctgcatggtggtggtagtgagagaggcgtgagtggttgtgaaagtggtagcagtgtttgtgttggtgatgctggtgatggcagcggtggtgacaaaggaggtgaaagcaatgacagcagcagtgctagaggaggtgctggtggtagtggtgatggaggagatgatggtagtggtggaagaggtgatggtggtagtggtgggggtagtggtgatgaaggagataatggtggtagtggtggtggaggtgatggtgatggtggcggaggaggtgatggtggtagtggtgggggtagtggtgttgaaggagatggtggtggtggtggtggaggtgatggtgatggtgatagtggtgggggtagtggtgatgaaggagatggtggttgtggtggtggtggtgatggtggaggaggtgatggtggtagtggtgggggtagtggtgatgaaggagataatggtggtggtggtggtggtggtggtggaggagatggtggtagtggtggaagaggtgatggtggtagtgctgggggtagtggtggtgaaggagatggtggtggtggtggtggtggtggaggtggtgatggtaatagcagtagtgaaagaggtgagtggtagtggtggtggtaagggtgacggtaatggttgtggtggttgttgcgatggtggtggcagtggtgaggataacagccacggtaaaggctccagtaatgacatagtgctggtaatggggatgtacttactatgaattctatagtagatccagaagacaaccatgcgaagcatcaatacaggagagtttgttggggtttctaggttatgttactttctcactctccatttcaccctagattgtcagttttatgtgagtttcacaggtgaggctatgaattgcagtgggacaggaggtctggccagatctcaccccagggtaacccaacccaccccctgcctggctttcacagacactctggcagctcgattcccaaacctgtccttcagctttgcagaccttggtctgggcttacagaattcccaccagggatagaagagggctgggaaggccggcaggcaggaaaggcagtagggcctcccatctctgcaacagggctaattctaaaaaatgcaatttggctttacaactcgctcttgatctgtgccaagattttaacgctaaggaaacctgaatttgaaaacgtaactctgaacatgttcaaaaataaccattgaaacagatgtacccatgtctcctcctttctctcttggggtgtaggtcttagcactgttagatggaacgtcattctagagaccagaatgcttttagctttgaaaattcaaaaaacatccttttctaaattttgtttttctcaaattcatatgcctcgcagccttcttccacccacctccacatttctcagttaatcactggaacatttaccaaccggccacatggctctgtagttacttgctttgaaaataaagccataatagtttttatgaaaattgggtaaatatccctgcaatgctattttagttaccagtcccaacaagacaattacatatggcgagcatccaggatatccttttaggctttcaagttttctctcattgtcattactttacacagcatttagcaaggctgtttttttcccaagctgctccaggccagatcattggaaacagaaaattgggatgcatccaggtcaccaagaaaggagggagtggagggactgaccaaggccaccactgaaatctgagggggacgagccggagtgtggcttgtcatttgttcatccacgcctgatggcgactggcattggttctcccaggcagctggtagctcaagccttcacaatggcatgttgcttctccatcccccacctctctcattccctaactcctccctgaggggaaagggaaaaatattactattgtgtgggtaggttgtctgggccaaacgctctgcaaagggtgaggtgaaatagtgtctaggagaatttgtcacacagtgtgccaaggttgggattgtaattaatagtactgctaggttcagcactgacatatagaaagtgaatctatttcctttaaccctcaaaataaccttggaacattggatatacttgttcttctttccgtgtttcaaatgaggacacagaaactcagaaaggtctagtcgtttgcctgggcctgcatgcccattgtgcagaagattgggaattgggatgctcctgccttccccagcagggccatgcactgcttcccaggggcacttctggacatggggcaggaagggaggaggagaaagcagaagtgccacctttaaaaaatacagctgcaaactttcaattaaaaatagcactttgaagtgtttgcttataggcaaaaaagcatgatttgtatgtcagtccttcagatacctgggaatgtatggctcttcttttagagtttgggatgaagtcctctcgatctcccaaacgcctcatattgaaggggaaggtcactacatgctggctggggtatttaataccatttcttaactagttgtagaatttttaagacccggattcaaatattgcttctacctggtaatagccgaaaggcctgaagcaagtcagttcacctctccaagtctccattttcctgtcaggaaagcaggaatacaaggtttaactgggttttgtgaggattaagtgagatacagaaaacatagagcacagtacctgccacaggaggagcacttaagacatctaattccctttagaactttaaaagtcattgataagaaagcaagttttgagtgtttggtatgagcttggtactgtgtagaagcaccctctcagttcatcctcacagcatcacaagacgaatactcgtcattacctccattgttctcatgggtaaaccaagacctccaaggagtggagaccatgtccatgccacagcactatgtgatccatctccaaagtccatttgtttccaggacagtatggtgccttgtcattatcaattttctatcttatttttaaagaagaatattacctatcttgtttatgattgtgattatttttctctaattttacttttttatacagtacaattcaaggctacctctagttacagagtaatagtgtttcttatatagtgtctttataaatttgtaagtgtacggtgagagcaagagagtacgtatgtgctaaatgtccatgaattatgtggccagtacacatcactgtggcctctgtttttattttcatgtacttctaattgtataaacacacacatacacatacccaactgaattcagcactttttaaacatgccccactattttgaacacttttattttttttatagacaattacttggcaccttcatatgtatacaatataattaatggaaagtagcataagaaaattagatgtcgtaattaaaggctagagaagatactactcagttgtcaaagttaaacattaaatttaggttattagaactggctgctggccttgtgtctgtgaaatttgttttgctaagtagttttgcattcattcagatgaatgttgctgttgcttttattttcctaatacaggaagtggtaactcccattattatattaagctgtttcctttctaagacacttttgcaagctcgatctgcgagtttcctctgtcacgctgatcttacatactactgtgtgtgtgcttcctgaaaccatttaagcatggatggaaatcattagcatgttagtgcagccttaacagagaaaagtttcttagtctaaaaacattctttcctccacaaagaaactttcagtcttgtatgactctgtgtgctgctaatacacagcaattttcatgagcaattttaatgagagactgagtgggtttggggtttagaaacagaacgtttttggagttttcatttctggacgtggattcgtatgtggctcccatcagctggtaattggaaataatggttcatctgatggctgcctcgtctatacatagtcagagaggcctcttagattcattttgcctgagcaggtgttcctgtcacacagaaaatattgtcacccctgacttctatgcgttctatagggttaagcacttcaatggagtcgtggacttcaaaataatttgaagaattcacctgcaccttctaccccgagttgagcgtttgtgatccaacgtcggggagagcagtctagagaatatcctgtatctgacagtcacacccaggaactaatttggggggataaagggggttatgattttttcctccatgatcttttaatgttccccttagcccctttatatcttcaatgtataccatcttttgtaagaaacaagttccatatgtgttattgtttttttccttgctatatcaaagagtatttagcttcgtttggtctacaaattctgtcttggtgatgtcccttgaaaatgtcctgaaattgattatggtgatggtcgtcccactctgtgaatacagtatgtcctcactgtcatcagtttgttcttgggaaactgtgactttaagcaaaacaatgtataatgaaatccattttaccataggctgattatacaatcaagagttaagttcttacgatgtaacaatttatggtcacaaaaacatcaccaagcttctaaataaagacccaaaacacttctaatatttaacactgaaataaatctaagttatatgtacatttagaaaagtttaaaaaaaaaggtaaggtaattctttacccaattcttggtggatcagtgagtgacagggagtcagaacagtagtgggttaaattaaggaataagcgttggtgaagcaaaaattctaagacaccgcctgccaccaggcagttcaatcacaatcacaaataccgtgggctcaccgggtgcttttctgtcacagcgtttattgtcatgcttctgtatgattatatacttgaaggattttttatgataaattttatttattcatttgttcattttccaaactgcttattccagttcagggtggtggatggtgggagcctatcccagcagctcaggacacaggatgggaaccagtcctagacaggatgccaccccgtagcaggtcgcaccgacacacacccccacggtcattcacactgggaccatgtagaatcgcacattcacctgacttgtgtagctttgggatatgggaggaaactggagtggagccaggagaaaacccattcagacatgggcagaatgtgcaaactccaccctgacagtggccccgagccaggaaatccatttttttttctcatcaacattataacaaaatgacattattcaaggacctacttactgtgtactgcaaaccattgaacagttaggtgaattctatggtatttgaattatagctcagttaagcttgtgtgtgtgtgtgtgtgtgtgtgtgtgtgtgtgtgtgtgtgttccccttggctcaaaattctaatatttaataaacaagtccatgtgctcagtatcaattttgcttgtggttttataaaccttttcaaattactcccctgagcctttgaatttcctagctaaggagctctagtttttttagtgtaaccttatgtacatccatttatcaatcaacaagtacatatttagcacctgtcttgagctgcaacagccaaattgttttaggaataatagtaatagtaggaagagaggagcaattactacaggaattattaataataattttaaatagttggaactgcagccattccgttgggagaagcacaatagtgacttaactgtgattgtggtgacagggagccaacaattgagtccctgctaatgggccaacaggggaaggggttgaaaaggaggagtgagtggtttacattacaaaaggattgtctgagagctgctcaagtgtggttatgaggggaggtcaggctggagacagaaaggatgataaccgtggagctgtcaagggcatgtcaggggtttaggcaagcgctgtggcagctagacagggccggctgagagcagacatgccctggccctgcctagcgttgattgataaaaaggaaacacaatgagaagataattgagcaaaccaggaggcctggaccagtgttacaaaatttaaaagtgagtcttgggagccatcagaaccttggctgaaaatattcctggcttcactttgaccagagttggaccattttgtggaggaataaaactaccgaaaggcgagtgtgtgtgtgtgtgtgtgtgtgtgcgtgtgtgtgtgtgtgtgtgtgtgtacatgaataaaatgctgtaattggcagatggattgaaaagagtacatccttgacatctattgaactccttcctcctggctgcacatatactaaacacacacacacacacacacacgcacacgcacacacacgcacacacgtgcctgactttcactggaagctttggggtatataaaaaaatcatgaacatccaggctgcagtccatattccagttgtctcatttgtcctgacactgccctttgtatcattttcccctccagtgcaggctgcagcagccaaggatcgtgtattgcatttagttgtcatgcattagggagacagagcaaaagatgatgatggaacaaaatggggcaaaatgttaaatattgatgaatatgggtacgggaatgttctccccatgtgacccctgctgacctctttatcccagtctcaagacttgtactcttgccaactatacggcagctccagtggcattctttttgttcctcagacaaaccaagctattcctacctttgagccattgactcggaactctcttctccctgagcttcacatggctggctccttcttgtcatttagctcttagttgaaatgtcacttccaaaagaggacatcctgctaactggggtaatgacccaatcactttctatccctcggttttaattatctgcctagacccatcgctagctaataattttgtctgtcgtgttcaccggtgtatccaaagcacccaacagcacctgtcattgggtagtgctcaaaaactatttgttaactgaatgaactaatctaaatgtccagaaataggagtcattaaaaatgatgtcagtgccttacggatgtgctttatgcaagaaaatgcttcagaactccagtcaggggacatatactcagagaagacctgggttccactttagaatattggtgaaggaatgcacatttttatatttcagttttgatattaactgcttaaggtatataacgtcttttttatattctgtagtctaataagccttttttaaattatgaaatatctacacaaattatattggttaaaaggactactgtctctctatatattttatatacatatatatatatatatatacacaatgattccaatcatacaagtagtgtatgaaaaaagcagaaaatatatgaaaatcatcatcattttaaggatatggaattatgagtaatttttacttttttatcagacttgctgcatgtggttctattatgtttctgatttagaaaatattttacggagacaaaacataatacaggataaatatgatcaaatattaataaaactgaagtgcagtttggatatggaaagactttcctgaatttggcatgcttagtgaagctttgcagaaaatgctggtaattgatctggactttgaaaacactcataggattaatgaggataaacaaatagagcattttaggttaaagaagcagaatgaacaaagacaggaaggaagaaactagcacatgggagactatgaggagaccatcctaactgaaagaaagctcatgtttgggggatggtagggagcaagatgggaaagttaggctaggatcccattttagaagatcttcaaaattggtcagagaggttgatattagaagtggaaagaaataaggaagttcttacaataaagaaatacgctggtccttctcaagaaataagattcttgaaaagaaggataacatgatgacgtgggtgttttaggaaaattactctgtgcagagagagaaacagagctggcagtttggaagtgtgacaccagtatccatctggtgtccatggcagacaccaaaatcaatcacaggtctgctctgccgagacacagcctgagaaccatcttcactggccctccagtcagccagtactaatcaatcagaattggccatgaaacctgattgcctcctatgtgtgtcagacaagtgaacgataggcaggagaaggacaggagaaacaaggtgaaggccccaggctcatgacttggattttagtagttctgagaatataagaaggataagtatcctgagatgtttattttgtatttataggtttgtattttaattagggccagaaatagagatctttttgtataaatcattattcagttctagaaatgttttgctttttctttcaggatcattgtcactggtatacagtttctaggcacttgctgtttaaaaaaaaaaacttaaatatttagttaaccttgaaaatagtaactccaacaaatgatgtgccaaaagaagactctcacccattttaatctacaaagatttggatgcacctgctctgtccactcgtgggagttaggttgtcagaatatgttaagccactatttttggttttttaagaaaaggttttgttttctgttattttttaaaactgggttttagattgcaaaatagcaaacaaaatttaaaacaaaatgaaatcgtctcatctctggtggaggtgggaggaacttctactttgtcagtgtgtgggctgcgaacagaacagaatgtttatcttaactacatgttgaagttgaaaaataaagttagcaatagccaaaaggccacgtttgaataacttatcacaaaatggaaaacataaatcttgtggcaaatcagctctgctatatatgctagtatttctcggatgtgtctgagaacattgttgcttcaccatataaaattttatttcttccagctgattggttcaaggtcacctcccaatacctgtaattcaaagtttggttgctgggacaaatggcagttgaattttttaattgataacctttcttttcttttttttgtctctatttcttcttctttttttttctttttcatttttctatggctcgtgatcaagagcttacaagaccctatgaaaaaattagttgagaaagaagagaagaagaaaatcaaccagcaggaaagtacagatgcagccgtgcaggagccgagccagtaagtcacaggttccttccctctgcatctttcttcccacaggtgagagttatgtggttctcgctgaccgaacctggctgggcctcagacgcagacttgtcttacttcctcacttctcagagtagatgtattagcatcccagccaaacccctttaacgcatgctcctgctaggtcatgactcacgtatcccagtaagagatcggtttccaggggacttagaagggcacacttgtgaggagctgactggaacaagacagggcaaatgtccccagcattccctggctctctgcctgtgacctgagccccagctttgcactttctctggtttctggaccctatctggtcctttgtcaacactagatgctcttctagataggaaatcccctggcttttctctcactgagggagcttacctatgaaattgccctgggatacatgcatactaaggcatcatcatatgaaagtgttggattttggcactgtgttttctaccatgcagaatgtctgttttcttctctgtgaaacagagaacagcttcaagtacaggaaatgactgctccatctccatttcatgcccctttacaaagaaggtgcctcttgtcattttaaatactgagatgaacttttcaacatatgtggtgcatggttccctttctcatacattgagaaggaggttgaaatgtggatctgtatcattttctatggagatataatagcttgcaggaatgcagttaatctttgaactggccgacctaggaaaacaaaatggatggcctcgtttctattctctactccttttccacacacaaaaaaaatttagatgacagtcttatcgtaaaacaggcttatacttttattgtatttctaaatcgactttcagatatattttttgtcccacaggaaaagttgctgccaatattagcctttttaaattttaaagagtatatgtactagataaattttttgatgcagaatgaagacaagttctcactgaaggacagactgtagaatgtgatctgaatctagtaaaactggctattttatggtgaaccagtttaacccattcctggtgatggtaatagtgctagctatcattttagtgagcacctactatgaaccagatacaatgctaggtgttttatttatgttaattccatctcatgacaaccttcagtgacgtcaaggctgggattttccttgtcatgtaaaagatggaaggaaggttccggaaggttaaggggctgcccacttactcttgtgtagtaagaggtgagacctgaagtgggtccctgcaccttcttttcaccatataagttcatacaatcaaaataaagcattcacctttacttggaagtggattacctgggatttttcttgatttgttttaattaattcagatttctcaaatacttcagtgcttcatttttgaaagctcacaaagtataacccagtaactatttaaaatgacagtgaacactgaacgtgaattttgtttagaaatagcagacaaaggtgcatcacggtgctaggaggaaggctcggaggcaccaagtgaatctcaagggcagtgatgtgtctctgtgtttaaagaagtggtgagagttgagtaggagatggtcagcctggatttatgagtggtcctgcctgcagcctctgtagccgagctaacctctggaggtgtcctctcctataacactaggaatcagaagaaatggattctgattgatatttttacagtttttttaactatcaatttttactatttttaaggtgataactgtatgcgtctatcttatttatatctaactgcccatctagatatttacagaatatttgcctcgagatgaaagcaaattcagatattaagatgctacagaaagggaaagaaggccagcaaattggcatgtaaatgactatatgttgacccttcttcgtgtgcgtgtgtgtggtgtatgtgtttgtgttaaaagtgaagtaatattgtactgaaagtctggctgtatcataaatataacattggtagaagttgatgactaaacctcttttttattttaagattaatttcattagaggaagaaaaccagcgcaaggaatcctctagttttaagagtaagttttgatttttatttagaattgcttctgaaatattacttaatgcttaacagccaagtcattttactttttgacaaactcctcctaggcctttcttctttttcaactgagaaaaggctaatttgcttcctgtagactcagttctaaatgttcagatatccaccatgtcaaccctacagcattactgagagaggctgtgtattgtgaaccagaaaatcacatcacagtcacatcagcagcagctcttcagaggggcagccacgatgggaactggcaaatcgctgtttcttttcacagcggattataagatttctgctgtgaccctgactggttctagttttcataagatgaggctatgacctcaggagaggtggatttgcggtatgtgtggggcgggtggatgtttgtcaatgttggaaacagataggagctgctcaccctgccctgccagctgatgcctcagcctgccagtgccaagcaacccctgatccctcaggtgaactgaacctgatgtgttaggagaaggggtcagagcgttgggagatggcacagtgtgctgtgcaggctcatcagctatttctgtctcctgctgttactgccagtgttttcattggtccttcacctcacagagggacacagggtttgatagattgtggtagaattaatgtgacacagtaccaagcacttcactggcactcaagctcctcggagatgcgggggaatgttttacaggtgttatgaagagaactaaaattaccccaacactgtgtttacctggtccccctggggacatatgcatctcttcctgcttcaccctctggtgtggtaccttcctggaagataggaggaggcaaaggagattctagaacttctcctctgctccattcttctccttcaccctctatcttcctttttacctttccacccacttgcttctcctcctatttgcttttctcctatctgcctttcaacaacaacaacaaaagactcacttttttgcctctaatgcttgcttcatgtcatccattcacacatgtacaccttcacgtacaagtactcatgcacttgttcatttgttcaacagatgtttattgagccgcctctgtgccaggcatggcgctgggctctgggcatacagtggtgcaccagacatagtcccttccaggatgaggctgacagtcaaaagggcaagcagatggtaatctaatcattaccaaagtaatccagcagctccagctttggtgggagctccaagggagaggtgtagggctttgggcacatgtgatggagaggacacaacttttttaggagatcagggaactggctaagccaagtgctatggcaagacttgtcaaagcagaagaaacagcctgggcaaaggttatgggcacaggaggacctggagaaagtcagagaaaccatgctccagagcatgagggggagcgagtggcaggaggagaaagggagcagctgggcctgctcttgttggccacagaagagctctctgtctatatggatgcaagctctccagcctcagtgtacccacggcacgaatcactaatgttgtcatagtcaaggtaattggataggaaaacatgggttctgtgggaaaatataaactgcagtttattatatttgtatgcaagttataaatctatataaattatatattcatacaatatgtgacaatgcaggggaatcaaattttctctcgttccttgtgcagtataattgcttgtggtatttgcatattttgagattgtaaatgtcgatcatcttgttttatatatgcacagaataaaatccattataatgaagtatcatatttcttttattctgtgacttgcagaaaggctaatgaacatatgagcaaatcaagttttaaggctgttctattacaaacacacacacagacacactttattgtttagaatagtttttggttcacagcaaagttaggctcaatgtacagagatttctcatagattcctttccccagcatatacatagcctttcccactattaacatcctacaccaggtggtatatttgttatagtcaataaacctacattgacatcattatcacccaaagtccatagtttacattagcattcacgcttggtgttatacattttgtgggcattacaaatgtataatgatatatatctaccattataggaccttacaaaacagtttcactgccctgaaacccctgtgtcctccactattcatccctccctcccctcaagcctttggcaaatgctgatcttcttactgtcctcatagttttgtcttttccaaaatgtcatataattggaatcatgcaatgtgtagccttttcagattgacttctttcacttagtaatctaccttttcattttagccaggcccatatggctaaagttcatcagcatcatcaagtaatagtcagttacttaagtcacacacttgtccatggaaggagaattgttagatcgatgtcatatggttttcaggttatctgccaaacaaagcaaagattcagggctgttaatttggcattctctgagagctgatagcaggagtccagtgtaatctgaggacccttgcttctggctgagtttgtggatcccatttcttcctgaagccgtgcatttaccttacactgcaatagcgtatgaacatgcacaccatttcgagttgttggtaaccagttgcacatgttatattacagctgaagatggaaaaagtattttatctgccttagacaaaggctctacacatactgcatgctcaggtaacctagattaaggaaaactactcaattttaattatttgactcaaactcctcacaaaatgaaactgacttataattttgttttctttcctcttctctaaaggacccatagatgaactattagacatgaaatctgaggaaggtggtaagatttatgtgtttctttgggattatgatttgtttgattttttaaattactcttttacatgtaagaaagtgtaatcttaatctttttaatagctttgcattccaaaggaaagttttttgggtgacagtctttataaatgacctcaaatatgcccaagcacaaaatagtatgtgtagacctatcatcattagtataatgaatttcataatgttcaaactactatagctaaaagttatgtcatgggtcacatgctgtagtagaaaaaacatggctttcagaatcagacacgtggatttaaagactggttttaccataaatggcctgtattttaagtgatttgcttcatacttaaactctctaagcctgggttattctcatttgtaaaatggaaacaatagcaacggccttggtgggttattgtcagaactggagatcgtgtgtaaggggtccttgatggcctctaacacagggttatgtcaaatggtcatgagttgagatagtaggactagtaatgttttgtgggtgatttactgtagtaagtctctactgacccttaggtagatgcagagggagagtttgcttagttaagtcgcacacctgaatttaccaaacctaaaatcacttatgaaataacctcccaaaagagaatccagaaccatggatttgagtgagaatgtagagtgttaagtaatcctaagacattgagagggttcagcctaattatagccttagctctccatctgaccaagggtttccttttaatgatgtaccaagagtccaaaatacacctgaaatttagagccaaactccagagcatcccatgccctggtggttggcatgcagcctgccctggctttacagatttctcacaggactacagactggccgaagttatcctgcaggccccagtcaaccagggcagacaactcagttcagtctgggcttgatgttgatttaatttacagagtgtgcaaggaagagagtctctggaagacagaggacattggttaaagttttgtcaaaagtagaaaggcaccgcacctctagcattaagttttcagggtttagggatataaacttgaggacagatatctgctttccctgttactgtcttacgacaggtagcatactatgcagtactgtgtgaatgcccatgaatattttatcaaaatgactaatcatttataaatattgaaatcataccaggtagtggaagtaataagcagttaatgtagattgccatacatggtgtccatttttgtaaaacattttcctctttggcttaagaacagattattttgatagaataaaggtgtctttcacaaattattttttggaggggataaatattttattcttaccaaagtcaggtaaagacaataatagaacaaacctaggtacccaccacccagtttcaacaagtcttaccagtaaacaaatgtatttataatccttcacgtgctttaacttactttgataggaaggctgttattcctttcattcccaacatcttgtttatataatttgctctttgcttttattatcaccttctttaattttattattttagtgtttgaatttgactaggtagtacattcacactgggacaaaagccgacttataataaaaaaatacacagtaaaagaatcctcactctcattcctcttccttaaccccctccctattctaatacttccatcccccagtgtatcttagtgtttgtttacccagacacagcaaatacgagtctgtattttgtttccctctttctaaaaaaaaaaaaaaggttcttggctttagaatttaattttttttaacttggcggtaaaggtacaaccctaacccagtagtcatgcattttttcacagaattaaatcagaaatggcactgcctgcgatagatgcttacttttataaacttcctcgaaagcatgtgccaagatatgttggaatgagattgacacttgtctgcttatttaaaacaactttcatatttcattggtttatagttaggatctttgttagttttgtagactagcagtccatacccccttttttgagcactctatgtaattgtaaagatagggatattaatgtgctggtcccttaaaatgtgtagttgttctcaggcagaagtattggtttgcacattgtctcagttaaagtcaatgtcacataatttgtcttttctctttctcactgccaacccacacagcccttcttcaggcatgagcagggctgccccactgtctgcctctgcttctatgttgtcaacccacagggtagcgtcggcttaaatattaacgtggtcggtagaataaaaatattctctcagtgcacagagaacttgtggtgactgaagaaaagaacactcattaatttgttgacttcaaaatgtgtgccctttggaaaactgctggaaggcccaaatcctgaattaaaatgctgattacaatatgcacgacattaaacagtcaagaaataaaaagagcttaatccagggatggctgactttataggacttggggacgataagctctagcaccctgctgcttgggggccggttcactccctgtggtaattctgttagacaagtaatggctaagccgtggtacaatgttatcaaaaagcagaccgctcgtgacaacagcaacgattctcaaagagccattgcccagaaaatcacccccattcagtgtcgtaatgacattggctttctcctactaaatagctaatataatggaaaaccaatatttgaccacagtttataaaactattttaagtaaaaaagttagtgacattttgagacacgtgaaagtggctctcaaactgccttatgaccacatgtggcaatctgacctcaattcgttaattataacatggagaaatctttgtgtttcccaaaattgggccaagaaaaatgaatagcagatacctgaacaaaaaagtggtgttacaaagcagaagacagttcaatgaattcaactcacctaagtctcataagttggccttacccaaaagatccctctccaggacaagactaagccaattaaaacaattttaattgtctatattctaaataaaatgtttatctcctgctacctccttggttactacttctagacttgtgattctaaattgtggtcacatgtcagaataatagctcattcagtaggtaccataggtgtgggtgaaaacttttagcccacagcagtcatacatgtttacctctgagttcctcctgagtcactcagaattgtctcctgcagttgtccatatattactgactagggatctgactgcttcctcgcatacgaagtggcaagttctaaaaagcgccttctcttttctcatgaactttccctcctctctgtcttcctcagcatcctgggatgtactgctggctttggtacatttttttttttaaccaaatactgttcttagctgatcatcctgtagcctgtagtgctctctatagatttacccttataaagatttctataaagattctggccgggcgcggtggctcacacttgtaatcccagcactttgggaggacaagatgggcggatcacttgaggtcaagagttcgagaccagccttgccaacataatgaaaccctgtctctactaaaaatccaaaaattagccaggcctggtgatgggcatctgtaatcccagctactctggaggctgaggcagaagaatcgcttgaacccgggaggcggaggttgcagtgaaccgagattgcaccactgcactccagtctaggcaacagagtaacactctgtctcaaaaaaaaataaaaaaaattctataaagagtctataaatatttatccctgccctaggttttatgtttttcagtaagattacttgtcttctaacatctactggtgaaatggagtagcaagcttagggatcatgaacaagaattttttttttttagtgcctactcagggtccagtgctgttggtttgttgtttgttttttgttttgttttgtttttcagggagtaggagttgtttttcctctctctgttcttattataatctatatcatttttcatcagagcgaagttcttagaagcagtgttcttgagttccaaacaagtacagtttgttataatatagaatatgtttttcttgttagccattttcgtaaggtgttttcctccctatcttccccctactctctttgggcgatgtgaggatagtgttggtgtttggggtttttcatctgtactgcaagcgtgtggcctttacgattagtcataatgtccagagtggggacgagggagaaaaccagagagatggagtcttcctgtttcacacgcagatgaaggtaaattaagtgacatttatctgccagcttttctgtgctctcgttttcggtctatgtagttatgtttccttccatcttctgtgttctaatttatgctgaggtcatgaaactcagtatgagttcaaaaataccacctgagtgagctgtcaccaatttcccacaccgtgtctaaacttaaaagagcttcctctctatgtgagttttcacacagatattgctcattggttcaggatcagttctcctagggaatgttctcccaggggcatagggtttttatttttgaaaacttgggcagtacagggcaaacatgctgaatggatctgtcatctcagcctttctgccacggtgcctgcatggtgcctggctgccagtggagccatctgaccttagaaaccctcaacactttacaaaagcttaaatattaatttatacatgagatccttaataggttctgaagtaaaagcagagtgctacagtgagaaaacaccttgactgtgagttggggtccctagcaagattgtctgtaactaataaattttgtgtcattgggtaggttatttaacctgggtctttttccttatctgtaaagtgagttagaggagatgatctctaagattcctattggttgcaaaaaaaaaaaaaaaaaaaagtatgatttttctcactgggacaaatcatcaggttcccagaatatgtttgagcaatggcaagtagagaagttttgccaaattgaatgaaggctttccagatggctatattgatgggtagctgaaagggctgcattcgtgcttgactgcagacatcctgaataccactagacagagtgttactttagccagtagtcagggagccactgaaggcctttgagtaaatgagtaatctcacagccagcctgtctaactttgctttctgttgcttataaaacagaatactggcacctggataatttataaggaaaagggctcatgcctgtaatcctagcactttgggagatcaaggcaggaggatcacttgagaccaagagggcaacaaagtaaaaccctatctctacaaaagttttaaaagttagccaggcatggtggcatgtgcctgtagtcccagctactcagaaggcattcaagcctggagtgctatggttgcaccactgcactccagcctggatgacagagtgagactctataaagaaaaaacaagaaaagaaaagaaagaaatggaatttatttcttagagttataggggctaaaatgtccaattctgaggggacacatctggtgagggccttttttgctgagtcctaaggcggcttagggcatcacatagtgagggggccgaatgtgctccctcaggtctctgttcctcttcttatagaagctaccaatcccactcccatgataatccattaattcattaatccatgaatgggttaacccatttgtgagggcagagccctcatgacccaatcacctcttaaaggccgcacctctcaagctgccgcactagggtttaaatatcagcatgagttttggaagggacagatatgcaaaccataacacagactaagcaaagatacacagtaagagggttcctctatggagcaccagcagcttcaccaatgggcaaacccagaagggctcccagacaggaatttgcaaatggagttccagaaagaacttggaattggaggtagagattggagaaccttctgaggtgacattggaaccctaagaatagaaaagatcttctatagagaatgtagggaaggtatgatggtttgggatgaaaccttaagggcagccagaataggaggaggcagtggagaaggtactgtcagggagatgggaggtcatccgagagagccgcctcatggggactcccaggagatagcagcatttccaggctgggcagtggtacaaatgatgctgtacaggtaaaggcctgggaaaagagcctcagaactggcaatgaggatctcactgctgaccttcaagagagctatttcagtatagggtgggggcaggaacttaattacaggcagctgagaaaagagtagagccaaagtagagtatgtggttgtggaaggaagaagaaaccagaacagtaacttgaaagtgtgaggggagggtggagagcaacatcaagtgaaggctgattattgttgagataggcacacatctcctgcggctaggggaaggaagcattggaaaatgaaagactaaaggtgctggatctgaataatggtgggaacagagcaggcttcaggaaggaggggagggcatagagagggcttatcttagaaaggagaggcaatgcctgcaaggtcacggagttggagacaggtgaggatgtgagtacgtcatgtctgttggctcttatttttgcagcagtgtctgtagttaggttatctggtaagcaagtaaacacagagacttgggagcctgcaagagagtgaagggaacttggtgtagcatctgtgggtttggcacctgagagatcctcaacccttgttcatcctttaacacaaaagcaggattggggcaccataacccagaagcagtccacatctgcatgggtggaagccctgactccagttgggagtttcttactagagtttctcccaaagagcttatcacatctctgcatgtgtctccattatctctcagttgagttgaatttttttcaaagaaaatgatagcatgattctcaagagccaactgactatagagctatttctcaagtctcaacttgtctggttacagacctgaacccgtccttttctacttgtagttagatttttcttacgtgttatgtgtaataattttaagcatcttaattatcagtgcaataattgggaggtttttgtgttttatggttcaagtcagtgccagtttcattgcttttagctaagtagtaagttctcttaaaagagaaaatgtgcactgtgtggcctgttagctgttgaataatcaagaagccaaataaaaggctaaattcattggtagacctcagtgtaggcaaaatctgtatttagaactggctgtaggcaatatcctcaccaagggtccttttctcttttctgtcactaaaaagtttgagttgaataggatatgtattagtaaaaagttttctgattgcaagtgatagaaaaaccctatttgaaatagtttaggtttaaatttttaaaagcaaaaaagaatgtattgatccatgtaatggggacactcagttgtggattggcttcaagcaaggctggatccaggcgcttagacaatgttgtcaggattctctctccacttcttgaggctgtttccctctatgtgttgacttcattatcactgggagcctgaaatttgcatctttagagcttggaatcccaaagaaagagaggccctcttccattaagtttctatataccaaattccgggaggtgtccggcatgtgtccacccctgagccaatcaccatgcctgggggatggaggactctggccagcctcatcagtcattcactggggtggagggtaaggagtcatttccagaggcatctcaccaggatcacatggagaaggcattttcccaaagggaaaactgaagaagcagagggaagggatgctgagttagcaaaaaccaccaaagtccattataaacaccatagcacaaaacctaaacaataaaaacaaagatggagctattacagtctgtggttatttttagaaggcttacagtttattatttgttcttgctaatgttaatgatgatcttccctggacagacatctgtactaaagtagtgaagcctccctgagggtttgacttagtggagggctgtataaagcgactgtagaaggaacatacgtcatttccaaggtgcatttgaaattatctgctcctccagggtctacacattgacttgacttggtttcaatagaataggtttggttcagtaattatctggtttcagtcagggcaaaaagtaaactataagaaagggtttgggcattccagtcctacctgaaagtaggaagtatagagttctgtaatgttaataatccttaaaaaggtgatgctggagaggggagcatgcgtagatacaggtgttgatggacacatcctgagctgcgaaggttgctttcctttccttcagctcctgccttcatccacagaggtgggccacctgcctgaccttacagtcctgcctcgcccaccatgtgcaggctcaagtggttcctgaactaccctgttaatatcacactgtcgaaataccattcgacccagccatcccattactgggtatagacccaaaggattataaatcatgctgctataaagacacatgcccacgtatgtttattgcggcactagcagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgccaaggacaaaaaaccaaataccgcatattctatctcgtaggtgggaattgaacaatgagaacacatggacacaggaaggggaacatcacacaccggggactgttgtggggtggggggaggggggagggataccattaggagatatacctaatgttaaatgacgagttaatgggtgcaacacaccagcatggcacatgtatacatatgtaacaaacctgcacgttgtgcacatttaccctaaaacttaaagtataataataataattttaaaaaaaatcacactgtctcagaagcctgtttaaaatgccatttgccccatcttctcacccacaacacctacaggctagctcttagtgagaatttctgtgataacacaaacaataagaatgcttacattagacagttgtccgactaaagtgatgttttgccactatttttaaaccacagggacatgagagtgactagattcttcccctccctgatttatagcctgtctgctcagcacatcagaaatccccttcatctttagatctttatgtaaagtgtgattgaaaatagatccagtaaagccaacacagagaacttttttttttttaaaaaaaaagcctttacttactaattatcttatacatttgaagaaaacctggtcatctcatttaatatgaccatatcagaattgcagcatgtctcagaaaaaaaacataaatcatgatttttttcttctctttgtgaattaacaacaaaaatgtttatagtttccaagtggcagttagataccaccacaaagccacagttgataacaccatcagtctttggttctcaaaataagtaataaacccagtgaaaggacttggtgtaagatttctgatagtaatgctacttgtattcaatattcagtattctgccaatgttcgtaatgtaaggatggctgccttctttaaagccttccttctggaaaggcaattaggtttaaagtgtatttcttttggtcttcctgacaacaccgaggtggccgttattaacatgataaccttgtggatgagcaaacagaggctcaagggggtctaagggtttttaccgaagtcacatagcagcgaaggggtggacctgaggcttcccctctgatccggtgctcacttcaacgcccctcgaactgtgtctctagcctgtgaagctccctgactcgcagcctctttcccttttattttattgctgcaaaaggcacttaggcaaaccagacccacttttcctttgcttcatgcaatggagtttcagcaaagtgggaaggaagtaaggatgcctctcttgggcattgttgagctctggacatcctccccttcactgtcgtgccctgggccagggcatggtgaaagttctctccccatcctgggtggcaggacaggctgccacatggcgtgttgctgttccagcccaggcaatgtgtattgagggcttgcgtgggaagatttgggaagctatgcaaacaaggaactaagatctccaacatgttttcaatcttggccttgtttcatatctgagaaatgttttggtaaatttgtttttatattaaagaaaaaccaaaatcctagagtctgatgcccagaaactgaacttgctttggaggacaggggacaagggaacatgggattcgaaatttaattctataaactcttaagagaggctataataataggatgaacttatattttgatgacatttttcttaaatctagccatcaaccagtctcccccttcgcagcccccacagcattgattcctgagggcttgagccctccgtggtgacgttttgttctctgttacttcaatcagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaaggtaggtaaggtggggattgaaatggggttttttgtttgttcattctttttgttttcaatccaaaagcatatttcttccttctttgtcttttttaatgttttctctatttttattgactttttaactggagactcagaatcacattccaactttatgtttcagggtttaaaatacattccttttcataattctcccctgtgttagcatcaaaggttagatgagtggttctaaatcatattgtcatcctttgattttagacttcttgtggcatacttgagaggatcaaactgctttcatggtcaaggccccgttgacttggccactccgccctgagttcaccacgttcccataagcatgccctcttcctgggtgctgactgacattgcacggggcttcttcactctttttgcacactaagttttatcttgcatttctgctccctttctatcctgatccacctctcccctgaggaccccccactagatccactcttctggttctgcccgaaacacagggccaaacattacctcctcagccacagaaaaaatagagtttccacactgatcagaagaaatttctcaggccaggcatggtggctcatgcctgtaatcccagcactttgggaggccgaggtgagaggatcacttgaggtcaggagtttgagaccagcctggccaacaatggtggaagcctgtctctactaaaaatacaaaaaaaaaaaaaacttaggtaggcatgatggcacatgcctgtaatcccaaatcctagttactcaggaggctgaggcaggagaatcgcttgaacccaggaggcaaagttacagtgagccaagattgtgccactgcactctagcctgggcaacagagtgagactctgtctgaaaaaaaaaaaaaaatgctggaggggttgtcaacatcagtaagggttcaaggtacaccaaccaagtgctggctgagaattgctagcattggaacacattggttgacagtgcaaagcctgaaactcatgttgaaatttaaatttttgagtttctaaacacacaggcttctgaaaggaaaccattttttagtatttcaacactttttccttctttcatgtgactttaattgtaaaacaggaatcacttaagaaattatcaaactgttttggtttttctatgaatttaggctgtctccctaataaacagcatgtttatctggcacttaaagctgagaacaaaacggtaaagctggaacaattaagtaattatgggctattaaaacctcaggtctttggagatgagatcatggacacaagagttggtgggcaagacaaaaaaaaaagtctttttttttaaatgaaatacatgactccttttatcttcctttgggagtcttatttcatagccatttcatttatttgcagtaatggaggtagagatagcagggataaatgaaatccaaaaatgtttctccaccctgagtttcaccccaggtttcaccacctcattcacgggagctgcaaatgagtaaggctgccaactgactagagtttcatccccacccacctgtggtggaggtgctaagaagccctgagagagtcgaggcagagcccagatcctcaagtgatatcttagggctgctgaggactccccagcagtgttgcagaacgaaccccactcagatcctcagctttggaaacaagagcccctactaaccacagggaatggttgcaactgtgttgctgcttagccagggtggctgagtgtcagtcattgtaagagcccatgcacacacatcagcagacagccaagaagtcagagctcctcgcccacttcctgagcaggcaaagtgagagaagttcatctcagtgcccacagtggggctgccagactatgcctgagagctgtgacaagggcagcggccatggggaattgcacttcagccttgccccatatacacgggaaaggcaccaaaccacactgaggtctaaggagggaggtgttctgggagggagagagaaacacaagctcatgctacggaaagagaaacaggaactgcaaagggaggccatttgttactcaggccaacaacatctcatttgaggttgccatcctactagcactttagcaagtctctcattcagtcaacaaatatttaccgggtcccactgtgtgccaggcactgggaattcagctgaggacaaaacagacaaggctgtctgctgtcctggagcccacattgtaacaggatgcagacaggcagtgaataataagcataataataagcaaatcgcatagtaggctagaaagtgatcgatgttagggagaaaaggaaaaagtagagcctggggataatggagtgttggggctctcagggtagtaggtcaggctgcagagctgagtaggttcttactgggaagatgagatctgagcagagacttgcaggaggtgagaatgaaccatgtggagctctgggcagagggaacaacctgtgccaatgccctaaggtgaggatatgcctggcacagtgaagggtcttcaggaaggacacttggctggagctgactaagcaagggggagggatgctcagaggatgcagaggcggaggccaggccacacagggactcatagctgttggaagaacttagaccttttttcagcccaagtaaaattgggagccatcacaggatcttgagccaaagagaaacatgatctgatttcctatttaaaagggtcattctgtctgctagaagttttatttcctctgctgggattctatcaaggtcagtgttaaaggagttaccacccgggcaaggtggctcatacctgtaatcccagcactttaggaggcggaggtgggcagatggcttgaggtcaggagtttgagaccagcctggccaacatggtgaaactctgtctctactaaaaatacaaaaattagctgggtgtggtggtgtgcacctgtaggtccagctactcgggaggctgaggcaggagaatcatttgaatccaggaggtagaggttgcagtgagctgagatcacgccactacactccagtctgggtgacagagtgagggagactctgtctctgaaaaaaaaaaaaatgttgagttaacttgtaactactgtactatttcctttgcatgcaaacagctgccaatggaatacctacagaactgaaatgataggaggaaaaaaagccaaacctaagtggttgaaacaagcagaccattcagcttctgccacacttacagattcccagcaggtgctcccagttcagggatccttcaacacgtgtttgttacaaatgaaggatggacattatgcttccatgactgatcatgtcaaattctgccttctattcttctattaggaccctcaatcccctcaaaaaagaggaaaggatgaatgttagcttgagttttttttttttttttcactgcattcatggcctagaaaatctacctatacacggctgggcgcggtggctcatgcctgtaatcccagcactttgggaggccgaggtgggcggatcatgaggtcaagaggtcgagaccatcatggccaaaatggtgaaaccccggctctactaaaaatacaaaaattagctgggcatgctggtgcgtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaattgtatgattcagtgaatctatgatttgtagatggtaaaataacagccagcactcagtgtggcacgtgctacgtgccaggaactgtcctgtgtgcttttcacatggatgaattttaatcctcaccgtacccttcccagccagctactattatccgttttattgcctgggaaactgaggaacagtggttaagtgatgtgcccaagatcacactcctgttaacgggcaggccggattttgagcccaggcagccggactccagaatccatgcctttcaccattcccttctctggcctctcagtacagtctctgagagcaaaagggatttcccagtggggctcttcagacctctcttaggaagccgtcagaggggcaggacttgtaatgacaccctggcctgggcatcctggtcgcacacagggatagagatatttagggagccataaaggaggaatgggtgtgggagacagaggctaagtccacacacaattgaatgatgttccagaatagaatatttgaaattgagattgtcctaggaaatcttgttcctgtgtgccagcagctacattcgctctggcacactcctgctgcatctcaggttttcctggctctccgtgagagactggggcaccgagtcctcggggacaggcaccaggactgaagtgcaagctctgggccgcgtccccagctccctcaccccctctcacaatccacatttccccctcctcttccgccttcatctcttcagtttcctcctctgtcgtctccctggattctcccctgcttttgtacctctcttcttccacctctctcctcgttctgtccccagtcccctggggaaatggagaggaagggggatttggagaacaatgatatcctcttttccccctactttaagctctaagagtccaaaacaaaggaatgcatgtagaatcaagttgtgctgaaaatgagaagatgaagttaattttagctgggatttctaagagtgtctgaagttatcagcatggtaaggtgtgggggttcctctgtcatgcagtgatgagaaaattgtgccttcccaaggccactttgtgtgagtaggaggagagccagccagagaggccacctgagctggagacaggcaatgctgagaggcctcagagtcgatgttctcaattctgtacccatttccaaaatttagaagtagacactgatactagaaagattaccagctgctcaaataaatgcatcaggacatcttttaatttaggactctgcaaaccgaagttaggaatcttgttccaaattcccaaaaacatacagccttgtgttccttcacggtattcttttgttttaccgaattctgagatgccgttgccatttagatggatttccacttaaggctaatataatgtcaggcttcgggttatctccgtttcacctttcctcaagcagtgctcacctcctgccattcctggcttagcctggctccaggtaatggacattcccagtcctcagaatcgtgtgagggaaaagaccacggggtgtatttatagtttgaatgcagagcaggcactctcagcacaaggcaatggaacggagttccgccaaagtgcagcacttcctatgcctgctgaggagcatttgcaggtcttggagctctgcagaatttagtccccagaaggaactttgatctactctacacctgttttatagaacagggaatcaaggagccccagaaaggccttgtgacctgcttagttgttgcagttgttccaccatttgaataaggtctaaactcctcagcatggcttccaaggtcctttaggacacgactgtctcctcactgtccacacctcccacatcttagcttagctgtcttcgtggcattgtttccctggagaaccacgtgtgctatcagtacacccgactccagccatatgaagcttcagtgcacccgtctgtccccaccatggggtcttggcacatgctctcccttctccttagagcatgccactcacctgtgcagcatgctgcttgtctgacctggctaacttctcatccttcagtatctcagctccactgtcatctcactgaggagccttccttgagtcccccctccccagcagtcagggtgtttctgctccccaagtccatgacaacctgtacttaatcactcctctccccttaacttattgtaaaatggattcactttattttaacttttaatttctgtgggactagtagacgtatgtatttatggggtatgtgagatattttgatacaggcgtgcaatgtgtaataatcacatcagggtaaatggggtgttcatcacctcaagcatttctcatttcttggtgttacacacattccaattatactctttgggttatttttaaatgtactgtaaattattgttgactgcagtcaccctgtcgtgctatcgaatgctagatcatacttattctatctaactatatttttgtacccactaaccatcccttctacccccatcccctaccaccctttccagcctctggtaaccatcattctactttctatttccatgaactgaattgttttcatttttagctcccgcaaatgagtaagaacatgcaaagtttgtctttctgcgcctggcttagttcacttaacataatgtcttccagttccatccaggttgttgcaaatgacaggatctcattctgattccattttctgtctcttgctctaggttgtcatgggaacaggtcccatatttatgttgctcaccatcgtatttccagaacacagctcagtgcctggaatacagtaaatgttcaaaagtacttgctggctggctggctggctggatggcaggcaagaagtgggggagaggacaactgacaaatgacactagatgaaaccagtcctaaaatgagaacccttgaagatgatgtcctcaggggttagtcctgccatctgcttagcttacaaactcccagattcagcttaggtttactgagggcctgctctctagtctgtctcctacctggtttcatctacaagatcccattttatccagacaacccccaaatgaagcaggacattttatctaccccttgcaggcatggaaactaggcctgagggggaactgtgggtgtcaggatggtgcttggccacgtggttgtggtgttcccactctccccttcacgggcagccccaccgcagagctctccaggctgtgatcccctcccagccccgggcttcggctctccccgctggtaaatgacacccatggcaaagcgcagctctgggcggtgtcctttggcttcacttgctgctgtagctggccggccttatgcctggctgatttagactttcctttatgtaagtaacggggggcagtttgctctaataaaattttatttgtttcctgcaaatgggtagcacatctgatatatcaaaggatcctgaaagctagggtagtcattttgttctcacaactcagtgccctggttgctcactcgtcaccacccctctcctgacagaactactctgagatgggccgacatctttctagccacaccttcatgttaaaaatgcctcagccaactcacaccagctagagaacagttgatggcaattatgggaatattagcaacactaagttctctttacatagcattttttcctgacagaagccaagacagttgaaatctggcttggcattcaatccataattaccctcattgcacccttcccctaaataatttccaaagtgatatgaatgaggttggaactgtagctgagcttagtatttgctttttttcccataaatagtcggtgtcatagacatactattttatctcttcatgcgcatgtagtcaaattgttagactgatgcttaataattgttcggagaaaagaatgtgacttggcaaactggctgttgtttctgcctcacactacggggaaagggaataatgataccctgtgtgtgtttgtgaacattctgaggtgtactgttcccgtcatcttagctcccaaagaggggatatcttcaggctttatcatcttcatgtcttctgctgcagagaagcctccaaatccatgggttctaggtgttcattgtatggttcatgagtgttttaggtgaacaatatttaaaaatccatacttacaaaggaattcaagtagaagatatctgttttgtctataaaggaatctgccattatcatcttttaaatcacatgtttgaaaatataatttgtattcctgggtcctcttatttatcttttatctttgagatgcattcttactctgtcactcaggctggagtacagtggcacgatctcggctcactgcaacctccgcctcccgggttcaagcgaatctcctgcctcaacctcctgagtagctaggattacaggtgcccgccaccacacccggctaatttttgtctttttagtagagacagggtttcaccatgttggccgggctggtcttgaactcctgacctcaagtgatccgcctgctttggcttcccaaagtgctgggattacagacgtgagccaccacacccggcctctggcttcttttaaagtatgacttgatacacagatgtttcacttatttatagctttccaagaacacgcacattacatgatgggaagtgagttccattttgacatataaattgatttctgcctcctcttaggaatgcgttcatgtcatactttgaaaaatataatgcttcgagtctgcctcttttttccagtgttctctgcagctgagtgtcgtgcatgtttttgaaatgggaagaatgatcttgtttgagttcccattgtgtcacatagcatacagagatcagggaggggtttctactcctcacctggctttactgagtcagttcaagttctctctggaagctcctggccctccaggaactctgtcagaggaccataggatcgaagagcataaagctgcaagatttggagtcagctgcctgggagtgtggggtcctgaagtgggcccctctgattcttaggagaacctctctcgtcctcacactggcccaaaaggcatcctgtgattctaatagaaatggtgacctaggcagcctcagagaccaactgaggaagtgcttcccaaacttttacttacataacaatcactcagagtttgctaaaatcttcccgggctctacctgcagggattctgattcagtaggtcagcattggctcgtgagcttgaatttctaaccagcacataggtgatgcccatgcctctgttgagggcccacattgtgagaaccatggttctgagagactgagggcaagctgcaggggttaggggaaaggtggcatgggctctggggacaggtgggtcttgggtacacttagtgttggagaaggattgaaggaaagggtgacagttaccagttagattcaatacttctcagcttttctatgatcagcattatttggcacacacagaaaccacaactttaactttccacatttaccactgttttatgtgatttgggtctagaaggaaaatggtcaggggccaattttctaggaaccagggaggttatgttattcctggattacaccaaatactggtcattaaaaaaaatcgttttattgcagtataatttatatgccaaaacttcacccactgtaagagaacagctcaaggatttcgggtaactttatattgtgcagccttcaccacagtccagtgttagaacatttccacggtcccagatagctccctccaagcctagtacttttgattgtttgtgaattctgttatgtatatgttcaaacacctttccaatgaataacaatgccttttagaactcttcgtattttttcattgttctagattgagtaaataggtcgcaggccacctgtttcattaagttagtcttgataaataagttcgtgaggtttgtgccatttgcctaaaatgaaatacttcaaccagtgagtattattgtaataatgaatatgtgccaggtactgctttgccatctcttaaaataatgctttagaagtatactcacggtttaaaagagtactctgtttatgttaatgcaatagtcatatatttgaacacccattgtgtagcattcagtgcactaaaggatataaagatgaataatacattgtccctggcttccaggggctcaggactctaggaaatgagatgaaagtgtaaactaagaaatagagtgtaattctgtaatgaagtccactggaaagtgtaaagcttagaatggcagagtgaacaagtggcattaaatcctatactttttgtgccatatactgagtggcattcttgctctggacattggtttcactgccccatctgaactcgccttccaaacatgatctctcttgagggccttatcagatacaaatcttttccttaaaaaacactgtgacgagagtatgccaataaaaggatacagttttaagcacaatgatcccaacagtgatgcatcctctgatggtctacattttatagtgagaatcaacaatccatttaatcagcaaacatctacctgtgctgtgttaagtattttggagcaaattgaaaaacaaaaaattccttgtctcattgagaaggtaagacttgcatatatacaatgaaagcagaggtgcaaagaagcttatggtaaagttctgctttaaatatgagtcatgtgaaaacctccaggacagacagtaaatgctgtgtggaactaggtttgctgtccctaaaacaggagtgctgaatgcctcttaaccattctggggcaggcagggcacaagaggcattatagaacatgtgcttgggttatacaacgtgtattaggccgttttcacactgctattaatataaagaactgcccaagactggataatttataaaggaaaggggtttaagtgactcacagttcagcatgactggggaggcctcaggaaacttacaatcatggcaaagatgaaggggaagcaaagtatgttcttcacaaggagccaggaaggagaagtgtggagcaaatggggaagagctccttataaaaccatcagatctcgcgagaattcactatcaggagaacagcatgggggaaaccatccccatgattcagttacctccacctagtctctcccttgacatatggggatcatggggattacagttcaaggtgagatttgggtggggacacaaagcctaaccatatcacaagccaaataccattgtaatggggggcataaagttaacgagggatttctttccccctcatatatttggactggactgttatttacttatctgtattaattaaatctcccaatttaaattagctgtgtagaaaataaaaggactggatcatattggaagtcgagaagatgtgcagttactagtcctattgcttcatttaatggtgttctcttttttaagcttttccccatttgtgacagaaaaacaaggcacctgctttccttagagcaccactgataatctttggtatgatcatgaaacgattgtgcttgagaagaaaaatgggcataaataaagctaaaaagcaaagatgccttatccatagcaatagtttatttgcttttcagaatctaaccttttccttcatttttcatatttttggattgggttcgatgatgcatatctcctatctcctcaaatgtattccagtatgaggaacatgggagaaatgtcttatttttattcggaggcaaccacggatgtggccatcaactggtgggtccatgtgacttcttcactagatctgatatgctctggttttgaatattagactggtcagagagcaatgtcaatccccctcctactccatggccagtaccaaagacaagcagtccaaatgacaacagccctgcagtgaaaggtaataacagcattttgtctctctgaaatgacagctgccttcctttccagtggcctaacctgttttctgtactactttgctaatttccatttgaacatctagggctcaagacagggctatgagatggagaatttcgcataatcccagaaattacattctgacttctttttctggcttaatgtcctcattcataattccctttatcaaattgtacctaatgtggatgagtcaaatatctacatgtggttgggtggtccccaagtttggttggaaataccaaggtatgaaaggcctctgaggtttgctatttttagccagaaataccattgccaccaccaaatagggcatttaatttgtgcacctcagaaagggccaggtttcatagttgtcaaaagaggtcatttcaagttcatgagatctgttctcttttgggacaggtcccccaagggagcctctgctcgactgaagatatcatctgtgtttgcagctctagctctgtttctttggtatcactgactttctcttgttggccacaggaagttgaaggaagtgtgtactccattatcatcaaaaaatgttcccatgatgctcttttaagtgttatgcaaataagttgcacctgctttgtctccaacagtggctgcctggggaatgtgaggattgtcccaaagcacaatcactggctcctcacggcaaggccatgagaacgctcagaagacctcctaagacccttgaggaggttagaaggaaggggaaacaagcatgtagcatcttttcactagagtcgtctttaagatattttgatatcctctagcaagaatagagataggctaatccagcgaaatcagtattgcctttttttaggcaataccctgcccactccccctccaactaagctacagtgagctctcttgtctctgatactcatatcaagataaaccagatgattccagggctaattgcacatggaattcaatgttacatagtaataacttgcatattacccactagtcttgatatagttttctcaccatcatagatacactgatttttacatgtagatacattaatatctacaaaagactttttttacaaaaagagggaggggaatccgaagtataaagtgatcggtacactatcttagcatttcagtgccattttgatgaaaggatcaaaggccctgtttatactgatataatcccattgcctctatcccctcactaaccacttttagcaacttgtcctaccaacacttcctgagactcttttcagccagatggcaagcacattcctagctgctctcagctagaaggatcacccatcagagacgttttcttcatgtttctgacactcccacctgttggagaagaaaaaaacacaggtcatccaagccaatgaacttagattctcatgtggaatgatttatgtattttaaacaaagccttcatcttatttagaaatcacttgcatgaggcactcttttgaaaatgttctcctcatctggaaaataatttggctgtataatcgtggtattcaggaagttagggcaggtgtttaggtggaagagcagaagggagtattccaatgaggctgaagagtgaggggaattgaccccctgggagaagggaaggcatgtcagggccctccttttaacaggaaaggattgaagaaggcagtgaccctgagagaagaggagaagccaggcctgggcgccaaacacttttgggcctgttgctttgaagggtagaaagagtggccataatatttctcctgacccagcagatttgaaaagattcctccagcagacagtggaaagccccttgcttcctcagccattcagtctgatttctgaaataactatgctatttcctggttgtggtgaagtggcagggcccgagggtttgatcagcttttcatgggctatggccattagtggggttggggtgcaggtgggagtttgttaacacaagagcttgttattctcggagcttcaggccctggtttggaaatgttaactggccaaccagccacgggagttggaattccctaactattgtcagagagagtgcaaagggatttgtctgattgaacaatctgcatttgaagatgacctggacctgcctgcatcccgcatggcagaggtggacatttggaaggtgcgtttgctcatgtttcctcttctctccccagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttg

SEQ ID NO: 36955 - DNA, 384241 bp, Homo sapiens
gggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattcttcaccacaacagggtcctttcaaggggtgtgtgtgtgactggggccgatggcgcttgggagtcttacatgccaaggaagttcacctacccttcctgccttcccggctctggaagagtcaaagcggtctcctgaagcaatcctggcatggtcagttccgctgggggagaaagtgttttcccgggacgtttctgggagaacctgtcctccttagttcccctttctctgcccatgtcccttccttatctcacccagggaggttctgcctctccctgccttgcagaggtctctgcaggtggctgccgctcctctgcagatggtgcatcccctagaaaggcgactgtgtttgtcgcctgggcctcctctctctctgaaagaagtatttccagagggagtgtttctcagatcctggtttaaatcaccctatcttctgggttgaaacagaaaggtctccagggcactggttacctgagttcttgcatctggcttgagatcctggactctaaccaggggtatcaaacctgctggtggtgagttgatcacgtgtaaagtgtccccctcccccgtctttggggctcatgtctaaaagacagattgcaaattggctctccaggaccaaaagttacccgcagctctgtgtagcccttagggtgtcttacttgtgaatttgatgtgaacgttttagaactgggagatttcacatacacatcctaatttccaactttaactttgctgagaaatggtctcactttcgcttgaaaacaatcgtttggagctgagagccgtcgtcgtagatggggaacagccttaccattttgtctcagttgatcccagtggggaacacttcacccatttctggcccctgtgggcatttaagtttgcaacctctcatctggaaagtttgtgtgttatgttttctttttaatttaaattttaatttttcactcttgggcttggtaagattgagtttggtaagaaacggcacatttctggggtattgtatctttaggggcaaagtgaccaccaccctggtgagctgggtttaaatcaaaagaaagtatttgagtgtggaagagtctgacgtgatttagcactgactgacagttttgtggctgcacctccaccctccagggaaaagtaaagtgatccctagtgagtgtaggtggcatcgtcagtggtgcagaatgtttgcttgctggcagcatggcactgtgctcctctgagactcttgcatactcttctgagatcggggtcccggtgggctcagtgagccctgccaacctacccagcctgtcttaccaagatttggatcctctgcaccacaccagaggactcctcaagtctctttaagtggcaacaacttaggccctggtgcaaacaaatttggattgttttctagaactttgacccctcaaacaaaatgccaatggtgtcttggcaccggaatgtgtaatttcttctttgaggttgcctttcacttccatgaatcagtttcagtctttgtctcttgctgagatcgggggcgatttttaaacatttttaccacggatcttctatgccacctgctctgctgttattgatggatgggaaagtcactttggaatgtgcaaggcatgacacatttgaaataggagatcctttaactcaaagtctggaagataataggaattttctgatgttaagagaaaaaggcagaattaaagtttgtaatgaaatatgggcgctctagagataggagtgtcttttttttttttttgacagggtctcactcttttgccccggctggagtacagtggtatgatcagagctcactgcagcctcaaactcatgggctcaagtgatcctcctgcatcagcctcctgattaattgggactacaagtacgcaccaccatgcctggctaattttaaaacaacttttgtagagaaggggtcttgtgatgttgcaagactggtcttgaactcctggcttcaagcaaccctcccacctcagcccccaagtgttgggattataggtgtgagccactatgcccctctggagtgtctattttttaaattgcctttctttttctcttccctgcctccccaccaagaggcagcgtagagaagtgggcatttgcacaggctaccaggcaagtccctgtcggtctgaatcctagctttgagacttcccaggcatattacttagcctctctgtatttcagcctccttgtctataaaacggagtcagtaacagtaccatagtgtggctgagcagctccaactcattgcaatatccaagattcttggaccagagcttgacacagagtatgctcagaaaatatctgctcttatgattgtccccagactaccccaatggtggggcagctggcacgagagaagactggctctgcagggttgctttgctatggaactgcctgccaggtaagagtcaaaactcagccatgaacttctggtcactctgtgtagctgctttgacagcatattccatttgggcagcagtagggaggagtgaggggaggggcagattggcagtccctgaaattgagatgtttagaatgggaacatataggaaagagggaaatttatccctggtactcagcattgcctgggactaattctggaaccactgaggagttccttagtatctgattgttcttggtatcagatatttcctctgaaagtaaatccacttacgatggaatcaacagtttatacaaaacacataaggttttatgatctcacttaagtcagcaatccagagcccagggcctcaggttcctttgagttttctgctccactatccctggggagtgacaattatctcatggtccaaaaaggatgctagacgctggagtcctcacacccttctttcagctagcaggaaggaagaaaggggtaaagaagggcatatagcacatgctcggtgtcacttgtttaagttgctcaagatccttctacctacatcctcttagctagggtttaatcacatacccacaccttgctgtgagggagcatgtgggaaatgtagtgtttatttcaggcagccactatttagaggatgtttccatttcaaaaatacaagcagagagaggatgttgtctctgccactctggtaggaggtgtgtaggatgatcgcaaggcaaagaaaccattgagagtaaccttcaggctctattacattgtcatggaaattggggacactgctatgggttgggagaggaaggatggaaaactcataaaccttgggaaattatggatttctgtgtgctcaggggagcttaagaatagattttcttgctttcgtatgatgataggacgaaactctaggttgactgcctcataatttctccctttttgtttccactctgtctatttcttataaaaccactctctgggaggtaatttaagaatgtgtttgatgacagggaactggggctgaagatccctattgtaaaattgcctaaattctagagtagaagtggaactcctttgacaagcaaggcagatttctctctatggcatttttttctttgccttttatttatttatttatttattgagacagagtctcactctgttgcccaggctgcagtgcagtggcaccatttcgactcacggtaacctccatctcctggggctcaagcgattcttctgcctcagcctcccaggttgctgggattacgggggcctgccaccacgcctggctaatttttgtatttttagtagagatggggtttcatcattttggccaggctggtcttgaactcctgacctcaggtgatccacccgcctcggactcccaaagtgttcagattacaggcatgagctacagtgctggctgtttctgtggcattctttacaggaacttaggacctgcatttgagctttaattttaattaaagtcttctctaagaagatttttggtagagagaaaaaccttcttcttttattttaaattttgtttttagagacagggtctcactgtgtggcccaggctggagggcagtgacatgatcatagctcactgcagcctcaaactcctgggctcaagtgattctcctgcctcagtgtcctgagtagctgggactgcaggtgtgtgtcaccacggcccttttttttttttttttttttttttgagacggagtcttactctgtcatccaggctggagtgcagtgacgtgatcttagctcactgcaacctccacttcccaggttcaagtgattctcgtgcctcagcctcttgagtagctggaactacaggcacgtgccaccatgcccggctaatttttatatttttagtagaggtggggtttcgccacgttggttaggctggtctcgaactcctgacctcaggtgatctgcccgccttagcttcccaaagtgctaggattacaggtgtgagccactgaacctggccaaatacatattttttaattttaaaattttttgtagagatagtggatcttgctttgctgcctgtgcctggtctcaaactgccagcctcaagccaggagtctcattctgctttggcctcccaaagtgtttgttgtttttgtaaaggaagtgactttggtagaaatagagaggcaataaaatatagagattcagaattcttagcaatgagttggagtccagtagaattgggtatgtatctctgatggagccgcttactccctgtgtgaccttgggcaagtcgtcccccagcagcaactttggtctcctcatctgtaaaatggggataatagcacctaactcatagggttatggtgaagaataatgaggtggtgcatgagaaatagccacagcaagtatcaatgactctaagtgagaccatcagtattacttgattagctgtaggaaactgtgtcaaagtgggacggagttcattctggaacttgttaaatgactaggcctctttcatgtacttagatagtttctcttcttgggtatatttcttcctgggtattgggtaacaccagtgagtgctcagttcagtgtctgggcccagaaacccatgcctggttagcattgtcttttcttctgagaaagatctgaacttgccatggactctctagaaaaaccccagtgtacaaattttctatgaaaagctagaattgatgattataatgagtaagttggctcttccttttcccatgtagattagaaaacatgtttttaaatcttctaattgaaattattcttaaaaaaccccaaagtctgacatgactccaactattgttgttttcatcaatatcaatcctatcaaatcaaagtttattttagtgtgtaattaacacatgtagactagaaaagtttgcacttttttatatcacaaaaaaggttaattttattttctatggaaagctagaattgatgataatgagtaagtcagctcttctttttcccatgtagattagaaaacaggtttttaaatcttgtagttgaaattattcttaaaaaaccccaaatcatgacatgaatccaaccattcttgtttttatcaatattcaccctatcaaatataaagtttattttagtgggtaattaacatgtgtagattagcatagcatatgtgtatttatataacaaaaaatgaatcaaaagttaattttattttgggcagtgttccctagaaacttataatatggccccatgcacttcaggttgaattttcttagtaaaatcataaagaggtccattttttcaaaaaatcaccaagtcaggctgcaagtttagaggttacttctattgtttcacttctctttcttcccagaagcagaccccagagacctgtgagccaaactccactcaccttttagcttattctaaatgtgtcctgcgggcttctctgtgaataaaaggcagaggctttttgacttcgtgtttgatgatttggcttttttcttttttttaccacctgacgggggatttcaggctcaatgtcccaatcgaaataagaatctttgagtgggttaacattgagtcttaaaaaggagggctgatttgttggagaggcaacaacgaattcatttttcactgtagagcactcaggaggagtctgaagctttgtcactgggcaacagaatgcctttctaagtaaatatggaaaatatgacctttgaaaatctagctgatatgatatatagattcttaggatataatttttaaaaaatatattatttccaagcactaatgatactccagagatactgcccacaaccagatgcagcatgtttatagtgtatctaggccaaaaaaaaaaaaaaaaaaaaaaaaaaatagaagatacagaagaaggcaattggtcaaaagattaactgaaggtttgaaaataattttatacacatttgtactgttggggtctctcttctctctgtctctgcttatccttctgtctctgtctctttgtttccatcacacatgcacacacacacacgtgtatacacacacatatatgtaagtagatcaatatgttataattttcacaatacgcatcttcttttgctacttttcagatacaggtcattaaattactaagtataatttaaaatatatggtctggccttttaactctgcagttcaattaattcttgggtagatagggggatctgctgaaaagtttgtctctgacgccttcaaaggtaagtcccttatgttctggcatttgctctaataacatgaattctttgacttcattcatccaatctcttcattgaaattgtgtgaaattccatagatagaatgttagcctttttacagagaatacaacatccacagtgtttacatatggcatttggaggtgtgatggctgcttgaaaatccagtaggaaatttgtctattcaccacatacattcatttattcatccatccatccctccatttatccacccacctctctattcatcatccgtttttctgtttatctatttgtccatccatgcatccatcccttcactccattctccttctaaaagttcttttttttgagacggagtcttgctctgtcgcccaggctggagtgcagtggtgcaatctttggctaactgcaagctccacctcccaggttcacgccattctcctgcctcagcctcccgagtagctgggactacaggcgcccaccacctcgcccggctaattttttgtatttttagtagagatggggtttcaccatgttagccaggatggtatcgatctcctgacattgtgatcctcctgcctcggtctcccaaagtgctgagattataggcgtgagccaccgcgcccagtctcttttttttgtttagacaaactctcactctttcgcccaggctggagtgcagtagtacgatcttggttcactgtaacctccgcctcccaggttcaagtgattctcctgcctcagcctcccaagtagctgcgattacaggtgcccaccacctcgcccagctaatttttgtatttttagtagagacagggtttcaccatgctggccaggctggtctctaactcctgacctcaagtgatctgcccacctcaacctcccaaagtgctgggattacaggagtgagccaccacacctggcctcactgattaagttctatgtgtcaagttctatttgtcaggaactattttaggtgacagaatacaatggtgaatgaaactgagaaaatttctgttgtcatggagcttatgatgtagcggggggagataagacattctacagatcatttcactcatatttaacctcatttttattaggtactttgaagaaaatggactgggtaccgggagaatatataatgggaagctaacctatgtaatggctggggatgcagtcagtggtctgggaattaaaaaaaaaaagcccaacttctcattctcattttctgaggtaactggagaaagtctgagttgtcaaggaactagagctaaaaatctgtattgtaaaactgcccatatcctggataatatatgcaacagggctgaaggcagtggctcatgtctgtaatcacagcactccggaaggccaaggcaagaggattgcttgaggccaggagttcgagaccagcctgggcaacataacaagaccctatctcaattaaaaacaaaacaaaatatgtgcaggagacttatctttgtgacattctatggagaaaccgtaaatatttatttgtatcatggctgcaagtaagatgagtaagtatttggtagaactagcctgttaccttgagatggcttctttcccagtttgacagagaacttcatctcctcttagttaataactcagataatgagctgacttcctttttgtttagggtttacagtttgaggtggctgttctaaagaagaaaaatcagacaatttcagaggtggaggagcaagtctgggccaatagattgaaaataaataaaaagagagagcacggcatttcagtgagaggcattttgagctgaaagtcagttttcagggagcacaagattactcacattgcctgccaaataccttcctcaccctgtgtccatctctgatatattacaactcttcattcctttggcttaggcagtattttctcttgttcagaagatactttttaagtagtttaacaataaacagtgttgactcacttatagagaaaggacttttgtcaagtctgtctttctgatttcattaaggagaaagtctcagttggtgttaatatatctttaacaaccctctaacacaaatctgggcacttagtagatatctgttgaatattctttttttttaattataaaggaactacagggaattatgagaatgtaaaactatgggctgggtatggtggctcatgcctgtaatcccagcactttgggaggctgaggtgggtggatcatctgaggtcaggaattcgagaccagcctggccaacatggtgaaactccttcactactaaaaatacaaaaattagccaggtgtggtggcatgtgcttgtagtcccagcttctcgggaggctgaggcaggagaatcgcttgaacccgggaggcagaggttgcagtgagccaagattgcgccactgcactccagcctggcgacagagcgagactccgtctcaaaaaaaaaaaaaaaaaaaaaaaagttagtttctacctataaaccaacttttttttgagtcagcgagggtacacttttacctaatgttgagcctggttctgttctaccctgagcttgattctgtactggctattcctccttgtgaacagagaagggaagttcagtgtctttcctggaaatttttggtgttgtaaggatgctcagtgttcctgaaggttgagaggaacagcaaggacaggatctggtagagatgtcgcttttattcagaagtgctaagctgttaatcattaccatggttgttattaccttttaattgccatttgtcctgcttgtttgtggtctcctgggcatctccttccccctcagcccacaagcagaaagttgccctacagagtcaggaggagaactcaaacccagaccagagagctctgatccactcctatgggtcttggaactggctaagtagatggaaattaactgattcaagatatgcaacaccattagttcaaccatagctgtgttcctggggtgaattctagctttcttttttctttcatcttgctacttcccagagaccagactttgggcctctagggaaggagtatcaaattgggcttgagagttcaagctcaaaacagacctgattttaaatcttggttctgcttctccatatcttcatgacctttgggtgggtaaaatatgatcctgcctctatctatctatctatctatctatctatctatctatctatctatctatctatctatctgtccatctatctatctatccatccatccacctatccaccaatacatccatccgtctgtccatccatccatccatccatccatccatccatccatccatccacccagctattcttccattcattcatccaaacatccacccatccacccagctattcttccattcatccatccaaccatccatccatccatccatccatccgtctggctatccaaccgtttttccattcatttaatatatatttattggatgcctaccacatatcaggtactgttctaggcattggaactagaacagtgaacagaacagcatcgctggcttcatggaatttacattctagtagaataacagtaataagtgaataacatagaacgaatatattgtataatgtcaggttgccatatgggctttgaagagaagtaagacactgtcctcacccttaaagatcttcctggtcttttaaaaggagaacagcacatggccaattagttctgagacataatgtaaagtgctacaccaagaatgtaaaaacactttggatggcatccctactcctcctcggaccggtgaagattccacagaggaggtgacatttgggaacagtcttacagcaggagtgggagttcccggattgacaaggggatgagggcaggggagggtgtttcaggcacaggacaggacaacgcagttgagatagtgaggagagagaatagggcacatgcagggaacaggaagaagagggtgtgagggagggaggagcaggtgggaggtgaacgtcatatcagaggggttggcccctgtgaaggcagtgtagtgactaggaagtggttgttgtcactgttttaaagtgggatgtgtgggggtgagtgaaatggccaaatgtttgaaaaagaggagcatgagatgcctttggcaacaatacttgccatgactcaaatcctgaaattctaggcctgcagtgatggaagtcaggcaggagaaactgaaatggccatttagaagcagtgggggtgccttaccggagcacctcgtggctgttgctatttttcacaccctaaagagacatttggaatttcatgtcagtcatattgttgattgttctattttgagggtggttactagttatttttatggttctaacaatagggacatctctcttcactgtatccttagacgcggagggccgtagaaatgaattttcctctgaaaggcatcctcccactccctctccctctccactgctgtcacccagtgggtacgtgtttattgagcacatgctgcacatggtggtgaagagttggtgttttggagaaagaaaggcttcgatttaaatcttgacttcttgctgtgggaccttaagcaagttacttaacctcttcgagcttctgttttttcatagctaaaaggatataataataaaacctactttatgtgaagtgtttcttagcaccctacctgacatatatacagtaagcacttgataaatggtagctatttctgttcttcctaggactgggcactgtccttgtccttactgagtttataatcctgttggggaggcaagatgaatgctcttgaatcaaggagacgacgcaagaatggatgtgcttacatgtcgtggtcaatagcattagctgcaccttacagtggatcttagagagaaatgcttggttggggccggagaggtgatttgagtgtgagtgagcacagtgctttctgagaaaccctttcctggcctgcaacactttaatttgtgggaaacctcaggaagtagaattgcaatctgtgatcgccccatcggctgacctcacttcaaaaatgtattggtagcatttcaactttaaatagatttgtgaccatttcacccttctaaatttgggttcccttcaccctttgggtggagtgtttatatcccttttcggttgaagaagctgacagatagtgtaggtgaaggtggagggtgaagtctgaaggacggtcgcttgtctcattgggatagtcagggcagtgatttttgtgggatggccctatattgaagatcttctttccctccctaaaggtagagaccattctttagagtttagtgagtgctgcaaatgaagatttgatcgttatttggatttttttgcatgtgtatgtgtggattttttttggtagttatccagatacattttgtggcaaaatttatggctgagggtattgataattgtttctgagacaaacagtgcacttagggaaacaggattgacatatagagtagagaaggacttctttttatttcagttggatattcatcttttggtggctagctttttttaaaaaaactattaatattatttttgattgacaaatcataattgatggggtacaatgtgatgttttgatacatatatacaatgtgtcatggttaattcaaactaattaatataaccatcagcttgtttacttattttttatggtgagacatttgaaatttacttagttatttgaaatatatgatacacttattattgactatgttaccctgctgtgcaatagatctccaaacctattccccttgtctatctgaaactttgtatcctttgatcaacaactccttccctcatcccagattctggtaaccatcctcctactctctacttctatgactacgactttattagattccacatatacgtgagatcatgctgtatttgtctctgtgtttctggcttattttacttagcataatgtcctccagattcatgtatattgtcacaaatgatataatttctctcttttttttaaagtctgggtaggattctattgtgtgtatacaccatactttctttattcattcatcctctgttgaacacttaggttgattccctatctttgctattgtaagtagtactgcaacaaacatgggaatgcacatattctttgacatattgatttcagttgctttaaatatatgcccagaagtgggattacttaaaaaaaatttaatttaattttttttaatttgagactgagttttgctcttgttgcccaggctggagtacaatggtgcgatctcagctcactgcaacctccacctctcaggttcaagacattctcctgcctcggcctcccaagcagctgggattacgggcatgcaccaccacgcctggctaattttgtatttttgctagagacggggtttcactgtgttggtgaggctggtctcaaactcctgacctcaggtgatccacctgccttggccttccaaagtgctggaattacaggtgtcagccaccatgctcggtggtagttcacttttttgtttttttgagaaacttttagtactgtttttcataaggctatactaacttacattcccaccaacagtgtatgggtccccttttctctacatcttctccaacatgttattttttatctttttgataaaagccattctaacaggtgtgaggtgatatctcactgtggttttaatttgcatttccctagtgcttagtgtgctgaacattttttcaagtacctattggccatttgtgtgtcttcttttgagtaatttctgttcagatcccatttttaaatcaggttatttgtttacttgctattgagttgtttgagttctttgtatattttggatattaacttcttatcagatacagcatttgcaaatatttttcccattctgtgggctgtctcttcactttgttaattgtttcctttgctgtgaggaagctttcagtttgatgccctcccatttgtctccttttgcttttgcttaatcattgcccaaaccaatgttgtggagtttttcccttatgtttttctctagcagttttatagtttcaggttttaagtctttaatcaattttgagttgattgtgtatgtggtttgtaagataaaggtctaattgcattcttctacatgtggatatccagttttcccaacaccatttactgaagagactgtcctttccctcattgtgtgtttttggcacctttatcaaaaatcagttggctataaatgtgcaggtttatatctgggctttctatcctgttccattggttgatgcatctgtttttatgctagtaccgtgctgttttgattacaattgctttataatgtattttgaaattaagtcgtgtgattcctccagctttgttctttttgctcaatgttgtcttggctatttggggtcttttgtggtcccatatgaacttagggattgttttttctatttctgtgaaaaatgacattggaattttgataagaattgcactgaatctgtagattgctttggctagtatggacattttcacaatattaatttgtctagtccatgaacacggaatatcttttcatttatttgtgttttcctcagtttctttcatcagtgttgtatagttttcagtatacagatagtttgcttccttggatacatttacacctaagtaattttttttttgctgctattgtaaattagtttgttttcttaattttctggtctggtagtttgttattagataagctagtatataaaattagaataattagataatctaatatagaaacactactgattgtatgttggttttgcatcctgcagttttattgaatttgttgatcagttctaacagcttttttagtggattctttagggttttctgtatataaaatcaccttgtcaacaaatagagacaagttcacttcttcccttcctattaggatgccttttatttctttctctttcctaattactctggctgggacttccagtactctattgaaaagaaagggtgagagtgggcgtcctgatcttagaggaaaggctttcaacttttcagtgctgagaaggatgttagctacgggtttgtcataatagagcccatagtgtttattgtgttgagtgcatttcctttataccttattgctgagtacttttttcatgaaagaatgttaatttttttcaagtgcttttttttcctgcatctattgagatgatcatatgatttttatcctttattttgttaacatgggtatcacatttattgatttctatgtgttgaaccatccttgcatcccagggagaaatcccacttgatcatggtgaataaaattcttttaatgtgttcttcaatttggtttgctaatattttgttgaggatttttccatctatgttcatcagggatattggtttatagttttcttctcttgtgtttttgtttggctttggtatgatagtcttggataatgagtttagaaatactcccttaattttttggaagagtttaagaagaattgattgacatccagatcaagaaacagaacatgctggtaccctagaagcatcatctcacaatccctatcaaccgtatccttcaggagtaatcactatcctaacctctatcacctatgattactttcatctgttcctgaacttatgcccacttttctgttatgcaactccattgacttatgcccatttttctgttaaaaaatttaaaaagtgcagagctttaagttactgaggctgagcctgagaaatgttagctgggacttttttagttttgcatagaggaagtgaaatccgtatgggagacaggcaccttctggaatcacccattggggaatggtgccgtttgccttctttggggaacatctgcttcctgtttcaatgttgcccatcggttccagactgttcaacaaggaagccagggcattctgacagtttttccacacaataatttagctctgtaaatactaggaaaacttgagctcacaaactatttttagggcttaacatttcaaaaattctgtattagtaagaatctattaaagctgctgtaacagacaaaccttgaagtctctgtggcttgacagaagggagtttatttcttactcatgtcactaaccagtgcaggtggtcctggtcaggacatcttccacagagtcacacaggaccccagggtcctccccattgggccagtggaaggggaaagggaaattgagaaagcacactcatttcacaacaacttcagctggggaaggaagtcacatcacttctgctcacattctatttgccagaacccaggcaaagaggcaaccaacggaagggggtcctgggacatgtcgactagctctatgtccaggaggaaaagaaaacaggttttgatgaactcagtaaatctcactccagtctccaaagccataatttcctttgtctttctttgcggtgatgtatctagttttatctctcacttgactggtaaaactaagatgcaaaactctggacgtctttatcttatcaaacatagcagggaaagagtgagttctatttgtgttcctaaaagtgaaataaagaagcacttttcttgtttttagttattagaacaatctggctcttgtcagactttctagtttttcaatcagtcagaattcttgcctctctggttgcctgttgtattaatccattctcatgctgctaataaaggcataactgagactgggtaatttataaaggaaagaggtttaattgactcacaattcagcatggctggggaggcctcacaatcatggcagaaggcaaaggaaggtcaaggcacttcttacatggcagcaggcaagagagcgtgcacaggggaactgccctttataaaaccatcagatctcgtgagacttattcactatcacgagaacagcattagaaaacccacccccatgattccattaccttccgccaggtccttctcatgacacatggggattatgagagctacaattcaagatgagatttgggtggggacacagccaaaccatatcacctgtggacatcccaagcagatctctttgaggccgggttagttctcttctaagctgacttgttatatagaagaatcctttgttggttctacttccagatatttgactggacacccaacaaatcaattatctattgctggatagcacataacctcaaggcttagtggcttaaagtagccactgttttatttagttttagtttctgtgggtcagtaatttgggctgggctcagctgggtggtctgtctgatctgggcagggattggctgttcttggctgggctcatttaccttcctggggcctcagcagggatgtctaggacaactggggcctctcttcaggtctttcatcttccagtgggctatcctgagcatggtcatatgctgatgggtgcattctctgggcatgagcaagggctgcagggcttcttgaagccaaggctcagaacatgcataacatcacttctgccatattccctggtcaaagcaaatcacaagcccaccccagaagtaaaggaggaaatagagaagagaatagagatgcctcctcttgatgggagaagctgcaaataatttgtgatattttttggaacccaccacactaatttcagtgtggtcctcgcaattgcttggctgtctaaaaacatactccagtctagtgtgcatttctgaaaatgaacttgatcaaaggcaggccccaaatgagtgctcaacatttacacctgataataatactacctacctcctagggaaatggtagggccagatgagatgctgtatgcaaaggatacggccaggacttagtgcacacgcaacactgaatactaccaccatgactactgaatactgccatcaaatactaccgttactaccacttggcactccctaaaagcttgagattcagagaaaggaagacaaagcccctgtacttgaggagggagagaataaagagagccggcgggggagggggtggcaggagagagagagagagagaggcgtgtgagtgagttcttgcaacacagtgtggtcagtgtgatcacagagctgtgatggagtgcggatgaggtctgatgacttactggtcaagagcatgggttcaggcctcagttcctccccaatcacatgtggggtcttaggcatctttctttttaatcttcagtttctttgtctgtgaaatgaagataatggcacagagcctacctcccagagttctatgtggattaaatgagacaggcaaacaacaacaaaaaccacaaacaaacaaaaaacaaaaatgaaaacaaaaatcatgtgattgcttattaaatgttagttatagaaaaaaatataagttcttaaatgtgcccttgtaaaaatgtcctaaagacctcatctttatttagttcttctgcaactctggctagcatcattgataaattgtcttaaaagatgaagatttgtatgcaggtggtttattggggatgtagctcttgggaacaacatctataagggatagagggaagcagggaagaggtagttgaactgtggtgcaatagttgtaatagaggccaaagccaattccatggctggagctgagacggcccttcagaactgggacaagccaatgcatcaagtgggcattgattgtgggctgctctttggaaggcagcattaccttgggcaaagcagctcccttcttcaggggaggagtcccagggaggacacagctgtgagcaattggttttcccagcagctgggggaatgagtgccttgtccctatagatggttttgagggggctgcatttgggggaatgccttctggggttcactgcgtgcttctatgtctttcttagaggttcatttcaaactataccttggttcattcacagtactgatttagttactatccagattcatagactgtacttgctggcactggaatatcatggacagagagtcctaatctgactaggcctagggaatgacatgggaatagcttgtcctgggtcatccagctaccagagaggagagctgggattcatatccaaccaacgatactttatacctcacattacttctgttatgctacacactcctgagtcacaggagattccaacttgtatttcaagcccagactgcatgacttcaatgtcctgttgcccttaacccctgtatcagattgcagccccactctggaaagttttcttgaattcttctatgtatgttttttaaactgtgggtcatcactcattagaagttcatgaagtcaatataataggtcaagaataccatgaagaaagcagaacagaaaatatcacagtgcatcactctcaggaagggtagatattgtttcacgaaactttttttttttttgagacagggtctttgtctgtcgcacaggctggagtgcagtggtacaatcatagctgactgtatcctcaacctcccaggcccaagagatcctcccacctcattctcatgagtagctgggacttgaggcacatgccatcatgcctggctaatttctaaaactttttgtagagatagggtctccctatgttgctcgggctggtctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacagagaggccaagggaattttccatttcctggatgtcttcaaagatttcaaatgccattaacttgagctgacatttattgagtactcactcggtgactggcactgttctaagtactttacatgtattaacttatttaatcctcacaacagccctgtgtggctgctactgttattgttgccattttatgctgagaaaacagcacaaagaattgagaaatttttccaaagttacagttaggattcaaaaatagacttggttttaggattgtgtaacttcagaattgatggtgacaatgacgttgatgatgaggatgatgatgatgatgatgaaggcagctaatatttcagtgtctgcaatgagctgggcattttcacaaactttatccctttgaatctttaccttccactaagatttgctgctattcttatcccttttgtagataagaaagcaagcttagagaagataaaacatttgcttaagtaactgcagagcgtagattgaattcaggtccattcgagtcagactgtctgttcaccaaggtgaagggctccgggggtcacagaggagcaccatggtgaggaaggccccgtaagagtgtggcagaatggcaaccaggaaggatctggtatacgggatggtgataaggcccatctctcatggccaggaaagtgtgcctgccacagcaatgaatgaaactggcaacatttgacaggaaggggaaattctctagtgggaggaatacttccatcaaactgttttttttttttcccagtgggggagtttgcacatgtgtagatttttttagccatagccttgaataaggaattcagaaagtggcttctagtttgaggactttcattggccacgtgatcacagtaggctgatttcttcatgcctaagttaccaggctgggaggacaggctgagaactatgcaagctgttgagtcacttggaaggaagagggttacatacagcaggcactttcatggaataatacttccctgaagagctgcactaatttattgaggcactgagctggatgcttcacacacatgatctcattgaatgtccacagcaccctaggaggttgatctcattattaacttcatgaagtgactgaggcttagagatattaaatagcttccagcctgggaaacatagtgaaaccccatctctgcaaagaataaaaaaaaatgagctaggtgtggtggctcgtgcttatattcacagctacttaggaggctgaggtgggaggatcccttgagcttgtgagggttgaggctgtagtgagctttgatggcaccactgcactccagtctgggtgacagagtgagaccctctctctaaacaaacaaatcccaggagacattaattaacttgccactggtctctaagctaagtagttgaagagggcaacaaacccaggtggtctgactcctaggcttgaaggtccaggttcagctactccaccagtatccctggtcagtctttggccagggcacagaaggtggcatatcaagttgtggggtctgatttggaaagtgtgagatccctcctttgtatcttttccaaagtccactcagaagagagtagtgtaaaaggagtgatagcacagcgtggtctggctggcatagtcagccgccctgtgatgggcagggggaagctgctttctgtcctcaagcagcccctaaacttgtaggccagactcataaatcacacattgataactcagtgtgatgtgtgctgtaatggtggagaggggggagaaatgccaggagcagctcacctcccagggtcctggggaggctgcacagaggagcctgagttctcagttgggttttgaggcagaggaagcagtgaaagagagaggaagaatgtcagtgaggtgcggggagaagcaagagagagaagacacttggcaggaagaagtagttgaagtacccggggatgtttagcttgaagaatagaaaatttggaggaggcagagaaaaggcaggaaactttaaaagcaggagagaaagacctccaggttcccaaagggagcatggcacttctcaagggggtgaggttgacagcattaggagagagagagagagaaagagagagagagaaagagagagagcgagagagttgtcaaggaagggaaggacccatggaggggagagcacaggtgaaaatgagaagtgatgggaaaatgggtgggaaataaatgaagttttgaggccagttgagaaatcttgcttggtggtttctattttctttgtgaagcagaaaaaaagaggaattagacagacctgcattcaaatctcatgaccccaggcaaatttcttatccttagcttcttcattttgaaaaaggggtgaatgataataggacctacctaataagagttgtcaggatcaaatatgttagtgcttgtgtaagatgcagtggcaccctggcacttagtaccaaaaaaaagtactataaatgttgtcacctattgagggagtccgggtttgggtgcttgatacatagaaatatcatgaatagcagcagagaatacaagaagaagagaaagcttgggggagaagatagagaattatgcgttgggtatgttgaggatgaggtgcctgtgccatatccgggtgtaggtgcccaaaggcaactggaagtcatgagaagtcagggatagaggtaaatgtttgggagttgttaatacaggggtgcatttttaaaatatctgaagtatgttactggtggcactcaaagatttttaatgatgtaaggtattcaacaacatggaactacgtagttttaaaagaaattctcttgtaggccgcgtgtggtggctcacacctgtaatcccagcactttgagaggccaaggtgggtggatcacttgaggtcaggaattccagaccagcctggtgaacatggtgaaaccccatctctactaaaaaaaaaaagaaacaaaacaaatcaaaacaaaaaaaccgggcatggtggtgtgtgcctgtactcccagctactcgggaggctgaggcaggagaattgcttggacccggagtcagaggttgcagtgagccaagatcgcgctactgtactctagcctaggcaacagaatgagactcagtataaaaaagaaaaaaatgtttttttcttttaattcttcgggttaaggagagtgtcttagtttggtgctatcatgtcctaaacatctttctaatgcatgcaaatctcccttttaagctaaaagaatgaagcaatctcagactcagagctatgtacctgctagaatttaataatttaaattttcattgtgttcttcatactcaccttctatttatagcaagtgttactagctctccaattctggaggttgtttcagataggatgcattagttctttttttttttttgagacaaggtcttgctctgtcacccaggctggagtgcagtggcacaaacacagctcactgcagcctcaacctcccaggctcaagcaaacctcccacttcagcctcccaggtagctgggactacaggcatgtcccaccattcctagctaattattttattttttatagaaacagggtctcactgtgtttcccaggctggtcttgaatttgggctcaagcaatcctcacacctccgcctcctaaagtgctgggattacaggcatgagccaccatgcctgacctgctttggttcttaaaaacagaatatctggcgagcctaacaaggaggctggtggttccagggttggtttaatcaaagacttaacactgtcatcaagcgcctctcagttatttgctctgccatcctcaaaatgtgatcagtgtctcccttcttggtcccaggaaggctgtgatagctcccagaatcacatactcacagggcaaagcaggaaggaaggggacataggacaaaggatttgtgtttaagtatttcatgtcacatttgcatgtggtgcttggagctgtggcagctatgttttgaccatgagggacaaggttggcaagctgtaaatggcagtgtaaaaagagggagaggatctgtctccttcacaatatccttgagcccctgaattcactaatcttgatatagctctatctcttgaaattttgttttgttagataattctcttactgcttaaaacgtcttaagatgggttttctgttctttccagtagaatgcattgtatctcacacaatttgaggttattgcctcaacctactctgaatcattgctcctcccccttttttcctggttgattagcttctcttgagattgtgtcttatcttcctggttttttgtatgtcgggtaattttggattgtatcctggacactgtaagtgttgtgctgtggagactctggattcattcgtatttctctgaaaagcattgatgtttttgttttagtaggccattgacttggttggacagtagactgtctctgggacaccagctcagatgtcagttctgttttttattttatccttgagtcttctttgggactgccccatgcatgcatggttcaagagtcagccagacatttgggtggggtttagacacagaatttggggctcttctctcttggctgtctctattatggaattccttcctcactttccagaagccgtgagtgacctgaaacctgtcctctggttctgtacaccagaaagacttgaggcttcatgttgaagttttagctgacagcagcttgcgttcaggggaaaagctgtaaaatgaccattcccttcttccaagtttcaacctctctgcagaatctgctttcttttgttcactttcgagtaatttcaggaaaaaatttttttttcgttgagagtttttacttgttacctatggaaaggttgggtctagctgaagcttgcttgcccataacagaaacgagactcttttctgtctaacacatgggaaaactaacgcccagagaggtgaagtcatttccccaattgtcagaggcacttgagccagagtgactccatcttgagtaagggctaggaaaataagaccgggacttgctgggctgcattcccagaaagaaaggtattcctagcctctagatgtctacagttaagggaacagattgataatgtttactaaacagagccaggcttggcagtgtccagctatcccgatatcttgagaacaaaggcattcctaattttgctttaaggataataatattgattattgcaaaacagagtaattaagaaaattaatcctttatcacaaacccttgtagcagaacacatctctccatgatttttaaaatcatatatatatgatttatatatatgattatataatatataacatatatgatcatataatcatatatatgcatgtgtatgtgtatatatatacacatgcatatatatgtatatatgtgtatacatacatacgtatatatgtgtatatatacatacatatatatgtgtatatatatacatatatatacacatacacacacacacacacacacacacacacacgaatattttacctagggtggacgtgctccttctcttacttttaggaaccccctactctgtctatggagtaactgttctttcaccactttactttcttaataaacttgcttttgctttgcactgtggactcaccctgaattctttcttgtgcaagatccaagaaccctttcttggggtctggatcaggactcctttcctgtaatacaatgtcacagagctcttaagtggcagagcttggggccaaacttaggctgctgcacccgatgtcccagctcctctgccctatctagctgtggatttgtgcctcgaaatagaattgcattttgaatgcagtttcattttcgtatggaaagtgtctatcctgtaaatgtaactgtagcagccccaaagctgagctgggcagttttatggcagcctggagtcagtcttgtccgcttccaatcagggttcctggactggctcctatattaaaattggtattagtagacaatgttccaggcagagttttggatagaaactatccatcagcaccaagaatgtgcctgatttggtaatctttttaccaaagtaaaagtcagtagtaagttgtggttaaaagagaggaagttcagagttcagtacgttatttctctctctctctctctttgtttaaataaaagaggaagttactgctcttatttttgtaccagcccgtcagtaatgggtacagagtaaaatcttagctaagctgaggtcaaacttcaaaacttagtaataaggatctcccttgttcctttgtagggcgactaacatgaaggttctgactcttaacccatagagccacaaaaaatagtcctaggaaaatcatatgattttatttattttaggaacagaaatggtcccttccgaagtagaggcatttctacttctttcctaaacaccatctctgctcagtgagctctcccaccctcaggtactgtgtttcaggcttattgctgtattgctagaagtatcctcaccttcgagattaagaaaagatatttattgccgggcacagtggctcacgcctgcaatcccagtcttttgggaagctgagacgggaggatcacttgagcccaggatcttgagaccagccagggcagtatagtgagaactcatcttgaaaagaaaaatttattgagctcctactgtatactggggatacagcaataggcaagatagcccttgctcctcatgtaacctacagataataaacaagattacaaacaaacaaaataagaggtcgttctagattatgataagtgatggaaaagaaaaaacctgtatctacttcttatagcagagacctgcattgggagttgctgtgatcaaacaggaaacggaaggtggagtttgcttctgtatccctccatccctgagtggaggctgggtgcttctcacgaccagggcctctgagatttctttttttgttttttttaaattattttagattaagggagtacatgtgcagtttcgttacgtggttatggagcgtgatgctaaggttagggtttctattggtcgcgccactcacatagtgaacctagcatctgataggtagttttttgacccccttcccctatgccctctccctcttggggtccctagtgtcggttgtttccatctttatgcccctgtgtacccaatgtttagttcccacttcgaagtgagaacatgtggtatttggttttctgtttctgcattaatttgcttaggataatggcctccagctgcatccatgttgctgcaaaggacacaatccaaataagcacaatcagaaatgaccaagctgacattatgactgatcccacagaaacacaggagatcctcagggatgactatgaacacctctatgcacacaagttagaaaacctagaggaaatgggtaaatttcctttgcacacaacctcacaagattgaacgaggaagaaatagaaatcaagatttattttctgttttgtttgtgtgtgtgtgtgtgtgtgtgtgtgtgtggttttttgtttgtttgtttgttttttggacaggatctcattctgtcactcagactgaggtacagtagcacaatcacacctcactgcaaccctgacctcctgggctcaggtgatcctcccacctcagcctccagggcagctggaactacaggcatgtacaacaatgcccggcatatatatatatatatatatatatatatatatatatatatatatatatatatgtgtgtgtgtgtgtgtgtgtgtgtgtgtgtgtgtgtgtgtgtgtgtgtgtgtatatgtatatttaaatttttatatataaatatatatctatctttgtagaaatggggttttgccatgttgtgcaggctgaaattgagatttcctaatgtaagaaacagagccccaaggggctcttcttgggctggtcgctgtatttcatcaggtgcctctgtgttggacacttacttccctccattgcatagattggatcctttatgcttagcctagactctgccctttgggatgcaaggagctgagtgaaggttctgggagagtaggcttaagcccagaagagggaggcctctctctggatgtcatgctagagcctgccttttagtctttgtgtttccactctccatcctcctcttctggagttcagaaccccttcctggtcaaattgcccccgggctctatgggatcctgtgggattctatcctttgagtctaccccacccttcaagtacttcctgtcttttcacacctaagtgaaagaaagtaggataagaacagcagttgttaacttgattgattgtaaattgccttcattagaaaatgttaattatcgcccctgggaagggattaatcctttaggtctctaggttactagactggcaaaagccaagtgtgccttggttgactgtttctttctgagagtaaagagaaaacatcaggggaggtagaaacctcagtcatggggtaatcattatggccatgtttatccccatacacgtatcttctgctgattctggagtcagctagattttgtgacccagcatagatgatatagtgacattgtcctgctgtgttaaaaaatttaagttcataagaaatgcataagtacaatctcatcaggataaattacacaacatagataagattgaagaccttttaactcttttgacgtctcaatttagtcccctctaccttccccagaagcctattgtttgtaaatttggtgtctcttatagaactctgtagcattccaaagtctgaactttctcccatgcatatggccacttccctgttgatgaacatttagattcttttttggaggggttgtgtctattacaaacagcatggcaatgagcatctttctacacatctcatcaatatgcaagtgtttctcgtgttcctcggaagtataatggcttagccctggggtatacacgattcagcttttaataggttttgccaaatgttctccagaatagctggaccactgtatactcccaccagcagtgtgtgtttccgtctcactgcatctttcccagaccatgatattatcaggccttaacacttttgccaatctgatgggagaaaaatggcatttaattttaatgatcctttcctgtccccttctcttctcttctcttcccttcccttccccttcctttcttccttcccttccttcccttccttcccttccttcccttccttcccttccttccttccttccttccttccttccttccttccttccttccttccttccttctctctctctctctttctttctttctctttctttctttctctttctttctttcttttctttcttcatttcctttcctttctttcctttcttactttccgagtctcactctgtcgcccaggctggaatgccgtggcatgatctcagctcactgcaacctccgcctcccaggttcaagcgattctcctgccttagcctccttagtagctgggattactgccacctcacctggctgattttttttgtatttttagtagagacggggtttcgccatgttggccaggtgggtcttgaactcctgacctcaggtgatccaccggcctcggcctcccaaagtgctgggattacaggcgtgagccgctactcccagccacctcttcttactagtgagactgaacatctttttacatatttattggacaattgtatttcatcttctatgaatgtctccctccccacttttttataatttcatattgatttgtaataatttttatttcaatctactagacactgatcctttgctcgttgtttgtgtttgtgttgtctattttcatcaagtcctgggtcctgtgtcactttagtgccataagggaatgacagactcccttattattggtttagctcttgaagcctaacaaagtgtttccaaacagttcattattcccactttaaggatgtgaagactgaggctcagggtcacaacttgtgcaatcttgggtagactttgaatctctgagcagacttagaagtagaccaaactgctgtgagccacagggagattattattgctaacttttccctgttagccaaacacttctgcttggtccctctagagagaagtctttaattattcatctctttccaagtaattggcgacaagtcctgcagctgggagttggaataaacttggttgctaaaagcatccatcacacataaaacaggggagatctggctccaaagaatggtagatgtagatcttcccctacggatttgttttctgaagatctccttatacactgacctcagccttttgctgacctatccttgtgaactgaaggctgaaaaaaccaatgtagccatggtccacatccatttatcactttcagaaatggcccctgcactttatatttcttcaggtcctgcaaaaaatattgaaaatcctttacaaatagaggcaaggtcaggccatccctgtgggatttccagggagcagtgcactgacccgttttgcagaatgggaagcaaaaaataaaactcagacttagacagctggcataagcaaggacttccctattctgagtgccaaatgtcaatttgaaatacttgaacttttattctctgggacatgtactggcattagtaagaatttctatttattgagcatttatttggggcaggcagatgataagttatacacattaattatcttatttgattttcacaatgacctatcagttacataattgattgtctgcattttatggataaataacctgaggctcagttatttgacttgctcaaggtgatgtaacaagtaaatggcagagccatgatttaaataacaaaacgcatgctcttaatcaccacattaatgtcttgatatcaattaatagaaccatttcccctccattttctctttagtttcagaactggtaagagtttgtctaataagatttttataaagtggtgacatgaatggcttgtggggatggagactggggccggctgccaagggtacccatctcacacgaagcatcaggtccacttgggtttgtttttggctgattacaatcttgaatcaaacttttcagtacagctggtctcccaagaactttctaatgttgatttgagcttccctgaatgaatctcagaaaataagaaagggagagagaatgcctgtgtattgagcttgacccatttcacagatgccgaaatagaagtgaggcgacttgcccagggtccctgtggtggattgtgttgttgtctcaattatttgctcccacctcatacaaggattatacatttcacacatggctatgtgacatacatgtctacttgcagaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccacagacaactgcagtgacacgtagcacgagtaagagctaaacttcgaatattgtaagtcactagaattttggggttgcttattattgcacttacctaccaaaagctgactaatacagtcatatagccagtaacttgactaagctggagcttgagccaggtcgaactcccaatcctatccatggtctttttcttatttcagtcttccctaatattccattctaacttacatcatattttctgtgtctgtgtgctgtctgtccttttttcttttaaataaatctttttctaccaaagatatagaacaggaaataatatttttctttaaagagtctgttttttcatttcaacccatttattttgaaggaaattttatcatcgtataaatagaaaaacagtgtcatcacaaataattcataactataagcagtggctcacgcctgtaatcccagcactttgggaggctgaggtgggcggatcacctggggtcaggagtttgagaccagcctgaccaacatggtgacactccatctctactaaaaatacaaaaattagccaggcatgctggcagaggcctgtaatcccagctactcaggaggctgaagcaggagaatcgcttaaacctgggaggcggaggttgcggtgagccgagatcgcgccattgcactctagcctgggcgacagagtgagactccatctgaaaaaaaaaaaaagggtaatttaaacaatattatgaagttctagctaggtactgttggcagacaagaatctgattttgaaatatcgtctctctatgttccaaaaaggagtttggcaaatattagaatggtgttcaaaacatacaagcaccaaactgatactttctcctttgataaatcaggaagattaaaaaagaatcagaagaacaatttcttcctagtatggcttggtgtgatgagtgtcatctgtattccatataaaattctttcagatatcaccaatgagtgatatgttcattacaatggggggtgtccctttctttggttcatgtataataactggaaacatgtatatagcatgtggtatgtgccaggtactcttcaagatactttagttatttaatctattgtcagataaggaaacagaggcttggagaggctaaacaacttatcctagctagaaagaggcagaattggggcttcaagtcaggtctgtttgattccagaggcaacatcctaaagcaaagtttccttctaactgctcacttgggacttttaaacgaagccattaggtgcttcactttcttgtggcatgccagagtggtagctgcttcagggcatcagcctggggccacatcaggacctacctgcacgtaggttgatcaggaccctggcagggctgtcaggtacagccacaaagcaagctgtttctgactgtgttcccacactttctcaggcatccaccctggtgtatgaatttgcttcttctttataacaaactacctctaaactgcactctagtctacagatcagctgggcaatgctgttgatctcggctgggcttgctcgtgtgtctttggtcagctagcaggttatctggggcctgattggtctaggatggcttcacttgcacatctggcacttagatgtgtgttagctggagcaatagggggcctggaccccgtgggtctccttttccagcaggccacttgggcttgttcacagggcagatgggcccagttcaaagggtctgagaacacaacggtactgcaggatgagctttggaactgctgcaccgtctcttccactgcattctgcatacgggccctaaacaagtcccaagccttctcagattcaagacatgggggatgggctgtatctcttatggagagagtcacatagcaagggtgtggctctagggaggaatgaagagtggtcaagtgcagcctgccatgctggctccttcaccagcctgtcagttatatgagccaatgggctgaatcatagtcatctttctctccacatgcctggcccgtgaaggatttgcctgcccagcagagaccgtggaatgaatgtgtgctccaggcactctgccttctctctcttctttgacttctctaagctcgttcctgcccctgtccccctctgtctctcttccccaggatcatggcattagtcggatccttcccatcattttcattttagctccagtatcacctctttgagccttccctgactacccttccagcattctctaatcccatcaccttgttttttttatcttttctttttttttgagacggagtctcactgtgttgcccaggatgaagtgcaggggcacaatctcggctcactgcaacctgtgcctcctgggttcaggtgattctctggtttcagccacccgagtagttgtgattacaggcatgtgccaccatgcctggctaatttttgtatttttagtagagacagggtttcatcatgttggtctggctggtttcgaactcctgacctcaggcaatctgcccaactcagcctctcagcctcccaaagttatacaggttttttttttttttttttttttaaatcttttcatagcatctgtaactgtttaaaatattagtttgacttccttttctagaatgtaagctttgggagagcggggtccttgcctgtcttgttctctgttacttctccagctcccagaatggtggctggcactcagggggtgctcaacacacataattgtcaagaacatgctacatcaaggcctgagtggctttgccacggctcttcttgtgactgcaggccttggtgccagcagccaccccagttccaagaaatggtctcttgctggccaacttagcaggaagaactggcagcgttcctgttacagcacttccaggtggctgcttttccctgagtccatgtggcttctccatgtctctctgttggagtcacaagttgtggaaattcacttaggccaacttagaccaagaagtggaatagttaatagttaaatgtcagtctgggcaacatagcaagacttcgtctttacaaaaaatttttaaaaatattagctggtgcggtcgtgtgcacctgtagtcctacctactcggggggctgtggtgggaggatcgcttgagctcaggagttggaagctgcagtgaactatgattgtgccactgcactccagcctggatgacagagcaagaccctttatctaaaaaacaagaaaaaattaataaataaaagttaaatataaggtctctggaggtatcctgtttgggttcagattctggctctgccacttcctagttgggtcacttttgggaagttacttaacctctttgtgcctcagtttttcacctacaaaaatagagcaaagtgtaaaaatatgaactacctcacagggttgtcaggaaaactaaattttgtgtatggaaagcactgattgctgagcagatggtgagcatctctgagtaggagctcctgctgccattattattattattattattggaggttatcatgtgtgattgaagagcaggaacttcagctgggcttcaggagcaactggttagaaaaacggaagacttggcccggcgtggtgtctcatgcctgtaatcccagcactttgggaggtcgaggcgggcagatcatctgaggttaggagttcaagaccagcctgaccaacatggtgaaaccccgactctactaaaaataaaataaaaaataaaaaaaaaattagctgggtgtggtagcggatgcctgtaatcccagcattttgggaggtcgaggtgggtggatcaactgaggtcaggagtccaagaccaggctggccaacgtggctaaaccccgtctctactaaaaacacacacacacacacacacaaaaaaaaaaaaaaaaaaaagaaaaaaaaagttagctgagtgtggtggtgggcgcctgtaatcccagctacttgggaggagactgaggcaggagaattgcttgagcctgggaggtggaggttgcagtgagccgaaatcgtgccattgcactccagcctgggcgatggagtgaaactctgtcaaaaaaaaaaaagagagaaaaaagaaaaaaagaaaaatggaagacttatcgggaatgcaggcagctgtgcgatttcagcttctctttgtttttggaccatgggttttctggttcttctttggttcctgcaggtctgactttctcctttttctgttgatggtctttcttggcctgtgtttgcaatgggtcaaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaataccctttagcacatttacctctaatgatactagattcttgcctcctgcctctgtaaatcactcggtcacttcccgatcttatatttggctgtcaagaatgtggaaatctcacagaacccttgaatttcaaagttggaagggaaaattgcttgtctatgcttataaaaaatacacacctacacccacgtacacatgtatttactaaaatagtattaggctaaatattcagttgtacagctttctgatttcattaacaatgtctgtctttccgtgtcagaagagatagacatttgaaaaaacggcagcgtaggattttgttctatggatgagctaaaagttctttcacctgtccacaaacttccacctagtccgtgtgccttataaaacacaaattctgaaatcccatgtaacgtgtcagctagattctgcctatcactgagtagagatgaaccatcacatctcatgttctagatttggggttacaaattcaaattcctacaggggccaggcaactgtcttagatgtgtgaaacgtcctagatataagaaatgcctgtaaatgaaaccttaagagtttttataagcatacaaataagtatgtaatattttgaaacatacttattttttggtgtacccacacaggcctagcatcaccagattcttctctctttttttttttttttgttttgccccaagagaggcaggaaatgagtatatttatgggagctttcctaattgtgaagtgttggtaagttcattatttttaaaaaactaaaaaccaacttgcaggccaaacaaaatgtgggccaccaatgtgtaatcactgatgtagataatgcacttcaattaatctaaaatcatcaactattttggcagccctctcagactgctgactcactgagcttttcatctgatgaaatccttaagtgattcacaaatacttaatctgaaaacctcttaatctaacttgtgttcctggacttgtaaattgggtttctggaccttaatacttgctcatgttaaatccattctgttacttatgtttaaggtcctacatctgtcttccagcctgatcacccatcttttcagccatgtgttgtttttgaattcaactcatttgatcctttctctatgtcctttttttttttttttttgagacggggtcttgctctgttgcccaggctggagtgtggtagcacgatcaggactcaatgcaacctcgacttcctgggcttaagcgatcctcctgcctcagcccccacaagtggttgggactacaagcacgtgccaccacacctggctaatttttttgaattttagtagagatgaggtctcactatgttgcccaggctggtcttgaactcctgagctcaagtaatcctcccagctcagtctcccaaagtgctgggattacaagcgtgaaccaccatgcccagcctctctgtgtcttatgataaaaaaaatactggatgagacaagactgaggaggaagacccagggaccctttttagcagagcttaccagcgggtgtccaaggattgaatttcccttcctagacatgttttgcttcaactaaaaagatatatatatatatatatatatatatgatgtatatcacacacatatgtgtatatcacacacatatgtatgtatatcacacacatgtgtatatcaaacacatatgtatatcacacacatatgtatgtatatcacacacatatatgtatgtatatcacacatatatgtatgtatatcacacatatatatgtatgtatatcacacacatatatgtatgtatatcacacatatatatgtatgtatatcacacatatatatgtatgtatatcacacatatatgtatgtatatcacacatatatgtgtgtatatcacacatatatgtgtgtatatcatatatatatatgcatgacccatatttaaaagtaggatatttcataacgaaataccagtattaggtatcttttgaaaaagtgtcgtaactgacagcccaagtctgcattccttcatggcaccagggctagaactgagaagtagctgactttttggggtggatatgggctcccctagtcatgctatatgcctcattttatgtgactggccgggccccataggcgtttatgtttgccactcttttagaggtccctttaaggttgacatatattcattgattgatcaactcatttacacacgcatgcagtcattttttggacccctgtctatgtgctctgcacaatgcgaggtgtgggatataatggtgaccaagacagattccaaccactcactcacagatcccacagcctaccagggaagccagatatggaacaattatatacgtaattttacttgtaagtgccacaaagacaaattgtattaagtagtaccatgtggctgtggaagtttaacttgtcactaatccaccaaactctgagaagacagcatattttccgtcattcccaaaagactatcacaggcaacattgaggaatgctttgttaaactccagggatatattccacatcacacttcccccgtccaccagattagcaactgtccaaggacaaaacaaaacacacactaaaaaggaaatggggttagtccgatatgtctccatctccttatgctggttcttttgtctgcagaagccacggtttctttttctttttgaaaaaaaaaaatgacatttgcgtacctctctgcgtttctctttctccaggattcttctgggatcctaggcagtgtggtttggtgatctcactggtgagatctcttggagccctggaatgcaattcatctgggccagaagagttgaactaatttaaggacatctgagtgcttcactgatgtatttgttctgctctgtcccttcaaaataccactactcaaaacaatgttcagctggagaaagtggttaacactggaattttctttttttctgagacctaagtgacagggaagggtggatgaaggaaacatatcctttgaaaatcctttagttagaatcctttggttgcaagtaacataaatgaactctgattaatgtaagcaaaaaagaatttgttagaaggatatggggggggagggatggacagagatgtgaaggaaaagatgaagaaccaggctttagaaagtcctgaaaccaaatgaattctagggatctaggaagcagggactaatgactgtttccttcaggacaccagagatggggtgaataactctgtaaaagatgcaaatttcccacctgggtaacatagtgagaccctgtccttaaaaaaaaacagtagccaggcacagtgcctgtagtcccagctatgtggaggctgaggcagaaggatcacttaagcccaggagctcaagactgcagtgagctatgatggcactgctgcaccccagcctgggcagcagagggagaccctgtctcttaaaaaacaaatgctaaattttagagagaatagagagaatcttttcttaaaaaggtgctaagtctggggaaggagcttctgattgtcctgccttgagtcacacgaccatctctgacttgttgacccctctacaatcccatataagactccccaagagtagattctgagcaggtaaagcccatgggtgttcccaaaagtcggcctcaacctgaagccacttattcactctgagctcatcaccaatggcatgccgcactgtcaaaactctctttctgtgcatttgtctgggccactcaactcaggaaagttagttgttctgtgtgagtccccatgttctcactgatttcatttcagtctttaagctaaaaatctgtgtaaatggtaatggagaatggctacatcacacttagtatgtgtcaaagcagtatcctaagtgccttagtggtatcagcttatttaagactgacagtactctgaggtgcagtcacttctttttttttttttcctttttttcaaaacagagtctcactccgtcatccacactggagtgcagtggcatgatctcggctcaccgcaacctccgcctcccagggtcaggtgattctcatgcctcagcctcctgagtagttgggactacaggcatgcaccaccactcctggctaatttttgcatttttagtagagatggggtttcaccacgttggccaggccggtcttgaactcctgacctcaggtgatccacccacctgggcctcccaaagtgctgtaattacaggcgtgagccaccgcacccggcctgtcacttcttgtcattcacagtagttatgttctgtaaagtcactgcaaacactgaattaataaacactgaaccattgttcctaggtgaaatacaaagttgggttcctgtgagcctttggtcacagcattttcatccactgatcaacccgtaagcttattctgtgtgtgtttctgtttaaagacaccttaatatatattgttgactcattaacatctaactcactgccaacagcactccaactcgtgcctgatcaaagcttatataacacacgcatgacacatctcggactccttgcacttaggaacaccagatagcacttcaccattaccctatgggaccattttacagcaacgtcaccctcaaaaagcagaaaaatgggaaaaagcatgctgctaatataccacagagagaatgcttgtttacagcatgagagctgaagtctgaaggtagaacatggttttgttcatcctcagctgggaacacatgttggctgactcaaatattttgccactccgtacatgtccgtgagtgatcatgaaagaaccttgagtatggatttggcggttataaataaattttagcaagaggtgaatttgcaaataatgaggattgactataacccctgttattagctctagttaacagatgggggaatggaggtaaacagctctctgcaggtcttgcagccagggagtgtagaggaggctttgtcattctgggtgcacagcctgcgtccttaagaggcaatgtagtgttggctgggtgtggtggtggttcatgctgtaatcctagcactttgggaggctggggtgggtggattacttgaggttaggagttcaagaccaggctggccaacatggtgaaaccccgtctctactaaaaatacaaaaaaatcagtggggcgtggtggcacgcgcctgtaatcccagctactcaggaggttgaggcaggagaatcacttgaacttgggacgcggaggttgcagtgagctgagagcgtgtcactgcactccagcctgggcgacagaatgagactccatctcaaaaaaaaaaagaggcagtgtagtggttgagtgcagtgtagctcctgctgagagctggttttcatgttttgtgggcacacaggaagtagagaatgctgagagctgggcactgaagcagtaggagatatgggagtgggaaagtggttttctttagtaagtctgggctgttttcatagcctaggatgaagttcagcaatactcaaccttgaggttttccaggcaccttctccttgacatgaatctcctgcaaacagatgtcatagtaatctgggaataaacctttgttgttggtcctttagctatccttttttttttttttttttttttttttttttttttttgagacggagccccactgttgccaggagtgcagaagcatgatctcagctcactgcaacctccgcctccccagttcaagtgattctccagcctaggcctcccgagtagctgggattacaggcatgcaccaccatgcctggctaagttttgtatttttagtagagacggggtttcaccatgttggctaggctggtctcgagctcctgacctcaagtgatccgcccgcctcgacctttcaaagtgttgggattataggcgtgagccactgagcccggtgccctggtcctttagctttctaagacagcagcatagtagttcagagcataggctcttgggccatagcttcctgagttcgaatcctagctctgctgttttttaaactctgtgaccttgggcaagtcttaacctctctgtgcctcagttttcttgtctgcaaaatgggattaataaaaacaccgatctcataggattgttgtgaaaatcgagtgagtatgtttatagtgtttaggaaagttcctggtacacaagacatgctctgaaagtgtattaatattatttgtccttagactcagtagtactctgggggaatcgaatccccacccctaagccaggcagcatggtagaagctaggtcagctggcaggctcctgggtcttttccattctgctgcaggagatgcctgactcacctcttgtgctcacacagatgacagctaaatagaagggctctttcctcctagtattagcttaattataggggctccctagaacagtggggaaaatgagctttgagaatccccccaccacacacacaaggcccacactagcacctgaaagaggagtgaacattgcttcctgcctccttctccccctccttctcacatatgcctttgtctctgtgattctgcacgtttaatttttaatcccgggatgggttctattagtttttgtgtattttctctgccctggtttgagctccaaaaggtctgtttgggtctctgtgggtgtctgacagcctctgcaggcctttctgaattatataactcaagctttgtattttctatttgttactgggggttctttctgtgctataattttactcttagaaaatgaagtagggtactagaattttctctgggatcccctagggtttccttctgaatattttttcctgccatattttcttcgctaaaacatttttttttcttatttcagaagcaatacatcttcattatagaacattacaacaagatgcagagaaagaaaataatcttatcaagcagaaatgttaataccttgctatctacccatgtctctctgtctctgtctcctcaaacacacacaaatggggtcaagatgacataagagactatctgcttttcaattcacattttacgatctttttttttgtatggttctgtagtctccactgcttggcttgacgatctttaacaggtgccctccggatggtcatgggggtattttccatttctcactgttacaagcagtgctctgatgaaacaccttttgctggcattcctaattatgtcctgagagcagacttctagaagttttcagcagtgaggttaaagggaatgtttgcctctcctcttcactctgtgatgctcctgggggcccaggcccatgagtctctgtgtccatcttcccaagatgaaagacaaagaatgggcagagcattgacagggccctgtgttgactccttttctctcttttcccagtttttttttttttttttgagacagagtctcgctctgttgcccaggctgaagtgcggtggcgcggtcttggttcactgctacatttgcctcccaggttcaagcaattctcccgcctcagcctcccaagtagttgggattacaggcactcaccaccacacccagctaattttgtatttttaggagagacggggtttcatcatgttgcccaggctggtcttgaactcctagcctcaagtgatccactcaccttggcctcccaaagtgctgggattacaggcgtgagccactgcaccctggcccattcccgttttttaaaaaaatattttattccttttagactatttagccacagttttccattctattccttgggataagtgaaaacttgatttttaaaaaataattacaaaattttaaaatcatggtaaaaaacacataacataaaatttaccatcttaactatttttttaagtgtacagtatcattttaagtacatttacattgttgtgcaacagttaggacttttcatctcgtaaaactgaaactctatacccactggcaataacttcccatttcttcctccccaccgagcctctggtaaccaccattctgcttcctgtttctatgagtttggctattttagatgcctcatgtaagtggactcttgcagtatttgtcttttcatggctggtttcttcctttttttcttttcctttctttctttctttctttctttctttctttctttctttctttctttctttctttcttccttccttccttccttccttccttccttccttcttcctttcctttctttctttcctttttttttttttttgacagggtctccctgtttctcgcaggccaggctggagtgcagtggggcaatcacagctcatggcagccttgacctcctgtgctcaagggatcctcccatctcagcctcctgagtaactgggacttcaggcacacactaccatgcccggttaatttttttcttgatttttaatagagacaaggtcttgctatgttgcccagggttgtctcaaactcctggcctcaagagatcctcccatctcagcctcctgagtagctgggattacaggtgcacactaccatgcccagttaattttttttcttgatttttaatagagacaaggttcttgctatgttgcccaggctggtctcaaactcctggcctcaagtgatcctcccacctcagcctctcaaggtgaagggatgagcctcccaaagtgaaggcgtgagccattgctcctgggatgactggtttatttcacttagtgtaatgccctcagagttcattcatgttgtagcatatgtcagaattttcttcctctttaaggttgattaatattccattgtatgaataggcaacattttgcttatatattaatcggtcaatggacatttgagttgctttcacctcttggctattgtgaataatgctgttgtgaacatgggtatacaaatatcttttttttttttttttttgtagagatggggtctccctatgttggccaggcttgtctcaaactccttggcccaagcaatcctcctacctcagcctcccaaagtgctgagattacaggtgtgaactactgcacctggctgagactccacttccaattcttttggatatagatcctgaagtggaattgctgatggtagaaactgtctcgggaagatttttctggggatttggcttctaactgcaccacagctccagtggaaacatctattcattaaactggcatttattgaggaccagctttgttccagtcactgaacaaggctgggggcatagcgtggcttacataggtccccaccctccatggagctgatattcagcaagaagccagacaatacacaggtaagcaaattgaaaaaaacaggatgagatccactggcgataaatgtcatgatactgaatcaggatttgacaacagagtgatgtggtgagtggctactttagatcagaaaggccttcctaactgggtgacaggtgacctgagaactacaaggtggggaggagctagccacacagaatttgggaaaataccattctgggccctgggatgagcaatggaaaggtcttgaggaggaaagtggctaggcgtgatccttgttgctggggcgtggtgggtgtggggccagatcataaggggccccacaggatgagcctctgtgctaagtgcagtgggaagccactggagagttttaggtaggcgagatgcaaaggatcagatttgtatttaacacaccttccattggctgccaagtagagaatggattgttggggactggagcagaagtgggaggatgagtcaggagtcaattgcagatttctaggtgagagatggtgtctttgtctgcacgggcagcagtgcagagggagagacacaggcagatttgggaggtaaaaggacttactggtaaatgggatatgaattggaagagggaagcaaatgcacagctgggcacctggtacactttacatatgacgtctttgaacttcgtagcaatcccataaccacattttgtagatctgtgttgtccagtagaaatataacatgagccataaacctgagctgtgtatgtaatttaaaatgttcttagcaatcacattaaaatggtcaaaggaaacaggtgaaatgaactgtgagaatgttttctttaactcagcatattccaaatattcccatatcaacatgtaatcaatataaaattattaatgagatattttacttccccgcatagcaagtcttcaacatttgatatgtattttacacgtacagcacatctcaattcaaccacacttcaagtactcagtagccacatatggctagtggttaccatattggtagcacagttatagatgaggaaagagagtctcagagagtataagttcttatgcaagcttatagaattaggacttgaaccctaatttgactctggcacccgtgttgtgctcaaagcactgcatccacccccaatgatgaagacattttcaatgtaagcaaaagtcctggagatttccccacatcatatacatggggacataggaactaacatttgtcatatatttatattttcctttccaaagcagatcaaccccaagttaccttcccttagctctcgttttctgcctctctttgcaaatatcacttcattaaaaattgtgaacattctctttgccttcccttatgggcttcctgtttgaacaccacatccagggcaccctgggaactgaaccatctccttttctttttctttttgagtcagggtttcactctgtcgcctagactggaatgcagtggtgtgaccgtagctcactgcagcttcaatctcttggcctaaaacaatcctcccacctcagcctcctaagtagctgggactacaggaacacaccaccatgcctggctaatttttttatttttattttttgtagctgcaaggtctcactgtgttgcccagactggtctcaaactcctggactcaagcagtcctcccacctcagcctcccaaagtgctaggatgacaggtgtgagccacaatgcctagcccatatctccttttcttttgtggcattctagtagccctttggttcatgcgatcatttagttgttcagcaaatatggatgattgaatggatataataggtgcagggcactcccaggttctcaagatggatgatcttgggcaagttatttaatttctctggattttagtttccttgccagcaaactcaagataatagtaatgcctacttttaagtagttattgtgaagattataaggaattaacaataacgataataataagtaataatgatacatgttgtttattagagcctgctatatgccagacactaactctatgatttaaccttctcctgctaccctttactcttattatttctttaggagtgaaattcactaatcattaagctttttaactaactgaatcaattctgtttcttaagcagatgggagatcctgtggctttttaccactatccacagctctttttttctttttcttttcttttttgagacggagtcttgctctgtcacccaggctggagtgcagtggcatgatctcggctcactgcagtctccgcctccctagttcaagccattctcctgcctcagcctcccgagtagctgaggttataggcgcccgccaccacgcccagctaatttttgtatttttagtagagatggggtttcaccatcttggccaggctggtctcaaactcctgacctagtgatctacctgccttggcctcccaaagtgctgggattacaggcatgagccactgtgcctggcctatccacagctggtttcccctctttgcccccttttctggcattctcttctgattcactctcaactctgatttccaagctacccagctccttcccctagtgtgaatctgtatttgcactggatttatttttaaatgggaaatgaaagccactgtgtgctggaaaatatatatttcagacacgaggaagctggcggggaaatattttttggatgtctttctagatctcttaaaaatcctgtgagccatcaccaggttgatcttgtagtaaggtggccttggccttagtgtatttctttttgactcgatattgggcggcaggaggtttgaggattgtgatactaacaacattaacaacaacaaactttcattgattgattgccatgtgctggaaatgtgctaataaattacatttattttctctttgaatcctcaaaccaactctttgagacaagtgtgttgtattacagctgtagaaactgaggtcctaagaggtcagtagatttgctgaaggtcacagagctgagatccaaatctaagcatcacagcaagaagtatccttaaccatcatctttgctgttggttggcattagtctggctgtgctaagaaagtttcctttgacttgcagatggatcaaggcttttcttgagagaggcttctcttgcctggttctccttgattcttttactctaggagactcagttcttctcaaatccctgtctgtgggactttgggcaaaacattcaacgtcatctttacctcttagagtcactgcgagggttggactatggtgtgttaggtgttttttttttttttttttttttttttgatgaagtctcactctgtcgcccaggctggagtgcaatggcatgatcttggctcactgcaacctccgcctcctgggttcaaccgattcttctgcctcagcctcctgagtagctgggattacaggcacgcaccaccacgcctgactaatttttgtatttttagtagagacgaggtttcactatgttggccaggctggtctcgaactcctgacctcaagtgatcggcctgccttggcctcccgaagtgctgggattacaggcgtgagccaccgtgcccagccgtgttatgagttgaacagatttcttggcttcagcaggggctcagtatgggcctatcatcattttcatttatctccttttatgcctcatgctctatctgtccccttcatctctgcctgtagcagccacagaccctctctttccttggtgcatgtccctccttcccactttcctaatttcagcctgacttagttctctacctgtcagcttggacttaaggaaaggaagttctcttttcttggggggtcactggggccatgggcgtctttccactccatttcttttccaaagctgcctctggaacgaatctgtaaatcccagggcattgcatgagttttcttttctttctttccttctttctttctctctctttctttccttcttgctttcttgctttctttcttgctttcttgctttctgtcactgaaagcaaatattgtagacagatatgcttgtaggatagaaataaaatgccccattctttgaaacatattttgttttttattttagattcatggagtatgtgtgcaagtttgtcacatgggtatattgcgtgatgctgaggtttaggcaatgaacttgttacccaaatagtgagcatagtacccagtaggtagtttttaaaccgttacccccttctctccctcctttccgagttcccagtgtctgttgtttccatatttgtgtctgtgtataccccttgtttagcttccactataggtgagaacatgtggtatttggttttctgtttttctgtgataattcacttaggataatggccttcagctgcatccatgttgctgcaaaggacatgatttcattttttttatggctgtgtagtattccatagtgtatatgcaccacattttctttatccaatccattgttgatgggcacctaggtggattccatgtttttgctgttatggacagtgatgcaataaacatgagagtgaaggtgtctttttggtggaatgatgtgttttcctttgggtatatacccagtaatgggaatgctggattgaatggcaattctatttttagttctttgagaagtctctaaactgcttcccagaggggctgaactaatttacaatttcaccaacagtgtaagagcgtccttttttctccgtaatctcaccaaggcactgcataagctatctgagtggccagcaggcagaatgcttgaaggattctccagctgggggtgctgggcccaaaggctggcagctgtatggtcctggcctttttctctccagcagggtccccatgatcttcccaggtctagttttttcttgagcacacctgcatctgacagttaattgcaagaatctgacttgctgaactctcatttctccctcctcctttagcgcatcaagtccccttctttgttttcccagcttggttcttgcaaggactacctagaggaggacttcaggcaatccctttctccctggtgggctgctgtgttctcaccaataaatcaatgctctctctagtttcaggctgcctcttaggacagatgctgataccaagtgacttttgaggttgttgagttgagacacttggaccaaacagcggaaggcacagcttggctcagctaaaggaagctccgtgaaagctctctgagtgggcctattggctccatgagttggcaggctggccctcctctaggagatggtgggtcctcatgggctgtagcagggccaggccacaggagcagactgctggaggagaacatttagggccatcttccttgctgcctttctgtgatctcttcacccaggaagctgaatgctgttggcaagcaaaagggtgcttggtaaccatttcttttttaagtgtgtgctggtgccagggagggagaaatcctcaaaacccattgtgtctgactcaggcaccactggtttggccataaccgctagtttatcctccctccctctgccaccctcgtcatgtttctcgaccacaacctgtctggaccttccctgggttggccagggcttgataatctttttctgtaaggagttatcccttcctcatctgccaggatggggctactgtgcagggactgggtaacaggcttgaagttgcaagagggctggaagggtctcactagcaagcacacattatgtcttatataggtccctggccttgtgcttcagaccctatcacagcttttccacagctggggctgttgagaatgtaagtggtgacatagctggatggctaagatggggggagtatgagacctgcaagcgtgtgagtctccttttgctagcagagtgtgaatgaaatgtatttattttcccaataaattcgacatgactgatcattcatccacccacttacccacccatctactcactaacccacccactcagtcatctacacagctgttcactcgtccatccatccatccatccatccatccatccatccatccatccatccatccatccgtccatccacattcaatgtagtgtaatgattaagagcatagagtttggagttatcctgcttaggtttgaatcccagctctgccactcaccaagcatgtgatcttggttcagttttaaaacctctccttgtctcagtctcctcagctataaaatgagattgatgttgaaattaataacagagcctaccttacggcattataaaggttatgtgagtcagtatgtgtaaggtgctttcagtagtgcctgggtcatagcagtgctatctaagtgttagctattagcattatggcatctactcacctgtttatcatctataatagtcattaaaggtcttcaataaatatttctggtctttggccttgcaggccaatggtaggattgcactgcttgcctcccttgtgggtaggtggggccgtatgagtagctctgaccagtgagttgtgatccaaagtgatgtatgttcacttttatgctgggacatgtaattgctggttctagattatccagaaaaaatctttgagttatggctgctctatcaacttgctcctggagacatagaacttcttccttagctgatcaggcatgaggctgtagtatgtgagaaaaacaaacttttacctattttgagggttattactgcaggataacccagttctatctctgtctctctcatctatcatctatctatttacaataattccagtctcattttatttcccttcccttttctttttggcacctattactagctggcattttcttatattttttggagtttcctcccaaaatttatttgttattaattataagaatatgttttccatgagaaaaaggacttattcacttatctaattccaatagttagaatggtactttacacatagtagacactcagcacatatttttaaaacaataaatcagttaatgaatggatctacttgacttttagtaggtcctattgaacactgcattccacagctccttgaaaatccttactgaggcagctaatatttaagaaggaacaccctgacctttcactgtccagttttattgcctgaatcaagaaaaatatccctgagatagacctcactgcctctctgcaaacctcttaatacccttagtcaattgtaagaagctgcttggaaccctgtaagatggtctttggccagatcaagtcttgctcctcttcctctgaatcttgtaggggcctttaatctttctgtaactgtgattccccagaacaggatgcctttgttagcctagcatcttttctgttacttctatgaaacaaggagagacgctccctgggacccttaactatttctggaagcaaaatgacccttgccccactgaagacttaggagcctggtcacttccaaccgggcttttcatctttgtgactcccagtcatgggcaagaggctagctagctccaatcctaatgcccgtgccatcaactgcttcatttctggtttcttccttgcttttgtgataccctcattgactctttccactgtaccctgtggacttgcctctatgggacacttcctccccatcctgcctgaagaggaaagagcctgcctttcttctgggaacatcatcccattcagaaacaacaacctttctggagtcaggagtttgctttcctcttgttctttattgctgcttcctggagattgcattcttgtttaaaagctcacctgtaagactctgatcaaatgtccattcttccctctcacttcatccctgaagatgaatgggacatttatctttatatatgtatgtatgcctaggggaaaaaactgaaggaacattatgtatatatataatgcgtgtgtgtgtgtgtgtgtgtatatatataatgtgtgtgtatatatatatataattttttttgagacagggtcttgctagactggagtgcagtggagtgatcatggctcactgcagcctcgacctcctgggcttaagtgagcctcccaactcagcctccctagtagctaggactacaggcatgtgccaccatacccagctaattttaaaatttgtatttattattatttttggtagagatggggtctcactatgctgcctgcgctgttcttgaactcctgggctcaagcaatcctcctgtctcagcctcccaaagtgctggaaatacaggcatgagacactgcatccagtctatgatattcttatgtttttacaatgtgcttattattgagtagggaaattatgagtgatgtgtgtgtatgtatgtgtgtgtatacagatgtatgcatctgtgttcaatttttcctgttgagagtgagtaaacaaatatttttgaaaataataaaatacataaatgaggggcaggggctctcttggacacttccaaaagtactttgctcaattttctatgttaggcctatctgcaagaagcataagggtttgtcaggagctattatgattatttattctacaaatcccagttcaacaaagaagggtgaggcttgagtgttcaattagagaagctggccagttgtggtatcatatcagctctacatccaatgctcagttttcaaggggtcatgttgctctgaaaggcctggtgaggttgatgagtgtcttaatgaagccacttgtgaaagataatgtgacatgtttgtccatcacattgacgcaggaaaggagctttcacaaaagacagcacagaaattttgcaggctcggaccagaagggaatttgtcagtgtttagcttggctgacatcccacaccctaccttcttgtgcagttagaatcccttctagtgtaatgtgtgaaaaaccataggccccctgcccacaccctcctagagctgtatcaccaacagctttcaagtgtgtgcaaattgggagacggctggatcccacatctctgggtgacatttgctgaaacaaatgcctgttaataagtggcacgattcccttggtctcagtgataaagatgtacctgttactgggagcccttgagagaaatctttggtgaaggccttcacactcattttaattggtgatagacagatgtgttgagaaaacttacattttttttctccatccgtctcaattagaatgttatgaaatagcaccccctttgctcttcgtgctttatgccctagactttaaagactgacaacgagtggttaaaaaatctccattgcttcaggatgcagtatcagctgatttggtggattaaatcgttttaaggtcctgagctttaattcttacttcagtgattctcaaaccttgttttgcaaaaccccagagctttaatcttaagggatgagcctgctatttccaagacaacaaaattatttctacttcatattaatacaaaacattaaaatatacattgtctttgtaatatagtttattaattcaaagcacttgcattcccatttatctggtcttcatacaaaaccatgtatgagtgagtaggcagatggtcttatttattacttcgttcaatatatagatttttgagtgcctaccggtatacagcactgaacgaaagagaaaaatactagtttggatgggagctcaacacaatctgaggggatatattggacccattttgcagaggaagaaactttggttcaggaagggaaagtgaactctgaagtttgacataaagttagcttcagaactagaatatctgccttctgatctcagcctatcacctatctcaggttctgtctccacgataccatgtgattggaactggctcattaacctggggatggatcaatcagcatcttttttttttttttaacaggattggatggaaatctgcattccttgatcactcagtctatagggtgaacttacaatggccctcatgcttaatcttgaaatacagggatggtctgatggagtgtgctggagaccctgctgagatctttggacaactcctctccagtccactacctgaatcctttctcttctcctcaaaaaaatctgagactatccaaatgaagagtaaataaagggagaagtaagaaggaaacatgagacagagaggcagcaggagcagaatgaaacttggggagcagagggagaagccaagaaaacttactggacttggagccaataaattggccatggcatgaaggtttctgccagcaatatggcagcccattccagctctttccattttcttttcccagctgtgctgccaagcaccatgcttaggctggtttaacagagattatgctaggaggattttctaacattcatgtcctgattaccccttatctgattccttagcagtagccttcagtggcctcagagaattccaggttcagctgtctgaacagttcaatgactgtttgtaagttctgacttacgatcaaggcaggaaatgtgaaaagcatttttaaaaaggaaaaaaaccatccggcgttgttaacatttttgttattccagtattttcccatgcatataaatatgtgtacttcttttatttttcacaagagtactctcacaccataatattgttttataaccctcttttccactgtgctctagtgtaaacattttactgtaccaaatctttttccacaaaaggatttttaattactgcatagatttctattgaacggatgtactaaaatttacctaaacagctcttattattcaacatgattcaaccattgttacaaataatatagttgtatatttatctttatggaaagctatttctgaatactcctaaggataagttcatgtattagttaggttttgctgtgtaacaaatcatcgcacaacttagtggtgtcaaacaatgactatttacttacctctgcaggtctgcattttgggccaggtagttctgctggactaggctggaatcagtggacataggctctggttacttatgcatttgcaatcagctgggggactgcatgggatgatggtggtatgtcatcttccagcaggccaggttgtttccatagcagttagagttgcaagagcagcaaggaggcaaaccctgatgcacaaactttttttcaagttttggttgcatcacatttgcttctgtcccataggccaaagcatgtgacatggccaagcccggagacagtttgagaagacattaccaaaggcatggctacaaaaggcatgaaagtctcaggaccattgttgtaatcaactcatcacagtccccaaaatgggagtttctgggtcaaaaagtgtggccatttaaaggttttcattgtcacattgctctccagagaaattgtaactaatttacacaccacctagagtacatgcatttccaaattcacttgatcactggatataatcattggtttaatttccccccagaaaataatattattgcttttgaagagtacatgctttgtgagggaagctgtcttgaatgtccagcttccaggtgcaagcgcctgcatgtgtgcacaggtgacaccatgtagaaccgaagaaccacctggctgagtctagccaacccagagaattgtgagggaaaagaatatttttttaaggcagaagaaaaatgtatgttcattgtaaaaacctgaagcaatgtggtacctttatcatcaatatcttccccagtatttgattcattctgacattatgttgttgggttacatttatttctattacatttaggacctttgagtctatattcattagtgaaatttgtctgccatttactctttttttttggtttgctgtctttgacaagtttttgctattttcatcaaaacatctgggaagtcttccatcttttcttgttttttaatgcttaggaagagcataaatggcaaaggatttagaatattttttagaagtttgagtggatttaccatacccccaaagcaaaacaatttctgggcctggtgccttttccaagattagttatttgataattttttctggtgtatttcatgatcatttttggtatactttcaaatgtgttatgtttttttaagaataagcatttaattgagtctctaatttattagcataaaactatatatattgtcctgtaatgatgtgaaaaattgccttgccatctgcaattctcttttctcattcttactgagttcctatttttagtttttgaaaattttcttatgagctttgccagagtgtcactgttttatttttcccctcaaacaaccacctcttaaatttattcttcagttcaacttttttctgtttccagatgcattaatttctgctttttaattatttcctcagttttatcactcttcctagtttcttgagctaaatgtccctatgtactttcaattatatctactgatttgtcaaaaattggatagtatgctcgtctcctactatgatagtgatttttcaacacctttgtatttttttaaacaaattttgttttgtacatttctaatgtacttttatgttataggagttagagtttcatgattctccagtcttattgtgaagttactcagatctgagttcaaattctcctgtgctgcctaccaaatgatgaaccagttttagattctcctaaaagcttggtgataataatgccagtgttgcttatttttaatacttaaattaaatgatataattgatgttaagtgctcatcatagtgccaggcacatggaacacacactgctattggttatattgttattattgatgtactctttatgaatacaaaatatccatctttgtcctatgtaatatttttatgctttacattttatttgtctgataattaatatttctgctcatggcagcttttcccaccttttcattttcattttggatcattttattttcagcaagtctcatgggaaccatgtatatttgaattctattttttctttaaattatgaatctttgtcctttaatgggataattcaatccattcacattttttttttttgcaagacacagcatttggcaagtgtttacttctttcttctcccaatccactttcctgcctttgaagattttagaaccagaatttatgaaaaaaaataaatatatttgatttcccatgaattgctattgacacatgcattatttcatgcaattcaagacttttttaaagatgtgactctcaaacttacttcattactcactttttatgttttttggacccatttccctcttattgaattaattgattgattcattaattcaatcaacaaatatttattgaaaacatactgtatgcagacactgtgctagggtctgagagaaacgtatttgatgtaaacctggtctgtgtcttcactgaatctacatttagattcacaaaattagagacacaaaaatagatgacaaattaaagcagatataaaggaaaccaataagggtctcaaggagagattagtgaacgtgcatgtgagtatctatttagcaagtttaatgaggggatgctttttgtgaaggtgacatttatgctggcagcttaagaagtggcattagctgtgtgaagagaggaaggaagaaaggcattccaggcagaaggactagcatatgcaaagggcttgaaaggggaaagagccttatcctaatgttttcatagaaattatttttaaatactcaacaattagcttttgaattaaaggaatgcacacaagtgaagttaatctcttataggcaaaaccaaatgaaggattggaaaatgcctctgaagagtcagctggaaggctcttcatccatccatccaaccatccatccatccatccatccatccatccatccatccatccactcatccatccattcatccatccatccacccacccatctacccacccatccatccatccattcacccacccactcatccatctatccattcatccatccatccaataagcagtcattgagtgcctactgtgtgccagaccctgtgccaggtgttgatcacaaataatacaagcacctcctggagagtagagcctagttgtgtacatgggatggagggcccatgataataaagctggtacttctcatggagtgggatgggccaggggcatggggaaggcacacgtgctgtgctctgtagagctctgagcagggagggacgcagtgggaaagagctgagaacaattcctgccagatggctttattctttcccctgaaggaagtggggacttcgtgctgtgacatgatacacaagaacagtgtttcctgtgggtttgcaagggcattttgaatataaacactacagctcgctgatgtgtgaaaaaattattttttttgctttttcagactttgtgaagggataatcagatcaattttataagtctggaaaacaggtatttggggtgaattttaatgcacacattatagtggctggaaccctaaccaaaggcagctgtcacctgttggtgggttctcttaggcacgttgtttgttcatctagctgtcacctggcagcttatgccctccagttcctggaactgaccagttatctgcaactgactaagttctggtactggatcctgtgtgatttgactctaacctccaagaaccttactgtctttagctgtgaaatgcggagaagactggactacttgatctctcaacactctatatatctttaaagttaaatcatttgttcagtcatttgccctttcttctgccatttctctttccctctctcccatccatccatccatccacccatccacccacccatccatatatctatttaatatttatattatttatgttatttatttatttatttattttgcaatggagtcttgctctgttgtccaggctggagtgcaatggcgtgatctcggctcactgcaacctccgcctcccaggctcaagcgattcttctgcctcagcttcctgagtagctgggattacaggcacatgcaccaccatgcccggctaattttttttttttttttgagacagagtcttgctctgtcgcccaggccagagtgcagtggtgcgatctcggttcactgcaagctccgcctcccaggttcacgccattctcctgcctcagcctcccgagtagctggaactacaggcgcccaccaccacacctcgctaattttttgtatttttagtagagacagggtttcaccttgttagccaggatggtcttgatctcctgacctccagtgatccgcccatctcggcctcccaaagtgctgggattataggcgtgagccaccgcactggaccctgtctaatatttaattgagtgcctgttgtgtgctaagtactgtgctgggttctcatccagtggccagtaaattagacaatcctcccatcatagagcttgccatctagtagggagacagacaagcaaataattacacaggtaataatacaattacagttatgataagtattacaaatgagaagaatggggtaggtgagcatgtgtattaaggctatcggtctcattttgagggccagagaactctttcttgacaaaatgaagtttaaacaaaaactaggtgaagattggcagaaaagcatcccaggcagagggcacagccagtgtgaaggccttgggataggaaggggcatggccacatcaagggaggtaaaaatacataacaaaataataatatgagtaacaatggcaactactactgaaggaggaccgcctatttgccagggaccatgcgatccttaactgtgtggttttgatcaaatcatctaaactccttgcaccttggtctatgcatctataaaatggggtgatagtgatcgtgtatacttcatcaggttcttctgaggcgccaatgaagtaacgtctgggaaatccttaggtctatgcctggaccataggaagtgtttaagagacagccgttgtgactgttatttttatgaatggtattgggtgagaaaaagttcgtgttgcatctcagggcttgccttggaccctgttgatgatttctatgttgaggtcactcttggagtttctgcagaagtagaactcttggaagtctgctattcagcagatgagtgaaacaagtgcttctccctccgctcccacagaaagaggggcagagatgccagccacagcttggctttcaggcagcaggcacattgggatcagtgattggcatttgcaacattggttggcatcacagagagcatggaaggtcaaggtaataattatcaaggacagtttaagggaaacagtacattccattccttatccattgtaagaccagtacattccctgttctttaactcttgggaagacatctcccccagatctctctgctgaggatcagggccatttctctgttaaaaatgtcaaacagcaacttaccagaggaaacagaatggtggaaatgccatctcagcattcaagaagccccagtaccaaactttgcatgtatatacgtttgaaacaagctttgtaaattacttttgttcatttgtaattacttatccataagaactctctctctctctctctctctctctctctctctctctctctgtgtgtgtgtgtgtgtgtgtgtggtttgttgtcacctgggctggagtgcagtgatgcgaccatggctcactatattcaaaatcctgggctcatgcgatcctcccacctcagccttctgaggagctgggaccgtaggcacgtgccaccaggcccagcaaataaaatttatttatttatttatttatttatttatttatttatttatttatttatttatttattgtagagatagggccttgctatgttgctcaggctggtctcgaactcctggcctcaagtgatcctcctgtctcagcctcccaaagtgcagggattacagttaggtatggagagagaaggaaataaggaagacacagttattactctttaggacccataatttaactcaagtgattttgcccccaggtggtatttggcaatgtctggagacattttgtttgtcacaacttggggtggtgggggttgctactggaatctagtgggtagaggccagggatgctactgaacaaaatatacaagacagcctcacaacaaagaattgaccagtccacagtgtccacagtgccatggttgagaaaccttgatctaactgcttatgacataccacttccataaagccgagagatatcaattcttatgcagttatcactgtgtacaggaaattgtgtgtttgtacatgtgtgtgcatgaatgtgtagatataaagggataaaacctttatcttcctttcctaggtatttttacctctgtattatcaattgaaataatttgtttttgaatatacaatgcaaagtttgaaatcctacaggtacaacaaggtatacagtgaataaagaatctccccattccacttctgtcctcaagtcttcagttctctggaggagtactactgtcattagtctcctatatattagtagagagacattccgcatatgaaccttatacccttagtagcacctcacacatatttttttccttgttgcctttttttttcctatgtgatgacgtatcttagagatattttcatatcagcgcatatagagcagcctcattcattttaacagctgcacaggttttttttttttttttttttttttttttttttgtggctgtcccatacggtcttctgttgatgggcataggttatttctagtcttttgcataacaaacagtgctggagtggatctccttgtacctaactgtggacacacatgtgcaagtacgtctgtaatccaaaatcctgcaagaggaatttctaggttaagatggcatgtgcattttaaatttggctagagatttctgcagtgatgtctgatcctgtgcaccgtgcattcatcatgtgacccatttctagtccttcttgaccgccccctctcctatggggatcctgagctgatagggtcacttctgtctctcccccacactggaacagctctctctaatctacaagattaattttttttcctaatcaaaacacaattgccaaggatagtttgaaaaatattaattgtgtctgtcatcctggggctctgagcacgtgagcgtttgggatataatctttgcaaattgcctatagttcatacagcacagcaagagcctctctctctgcagccagtcctttatgatcgatcatacccaccccctctcccaatgggctgtatcctaagggtaagtagacagcatgggttctcttgcttaaaaaaaatcgttaactcaacgggggcgcctgctgcttgattgggagtatgtcggcatttagagcctgctggctgcaatctcactacgcagactggaagttgtggggtgtttttatcagcaggaaacagctttgagagcggaaggggagtgagagtagatggatagatgagggaattcgaagaggaggaagccgtgggagaaatgtcttcttttaaagacagacaaggcagatttctccagcccatctctctggaatgtcaagtaggaatgaaatgggaagttgggttaattctaccaggcctgcccagcaaccagcctgttcaggttccccaggagttgcagcctgttgtctgagactgtgaggttctcttccctgaagtgtcttgtgggaattggctggtggcagcattttctctgaggtcccaaaaattcgagtggtcaagaagacaccctgcaatgatcattccccaacattggaggccataaaagtcagtctgggtttgcaaatacacactggaagtctcagagctggtgcagacatctcagagctggtgcagacagacactgtggctgagtgtgtgtgccttgttcgttatggtttcactgctactggattggtacctggtacacagtaggcactgaaaaaatattcactgaaagaaagagaaaacttgatggcagttgtaggtctgggtctgttggaatttttacccccaggaagagatttgattttaactcaaagccagttgataaacagcctcacccagcagacagagggcagcttgggggaaactggagggtatgtagggtggggtggggctcttatctgtatggacaatgccatatattttctgaaacttggatttttctccttataagggagaagatccaagaagacaatgaaaaaacatttgcccctgcctttagaaaaaataaccttttaatttttggaataatttcagatttttagaaaagttgcaaaacatttacagagagttccactgcatacccctcacccaaagtttccccctaatgctaacatcttatgcaactgtgatgcctttgcccctaccattttgaggttaacaattaagttagtataatacttattctgtaccgagctctattctatatcattttcctgcagttgtttatttgaccctttcagcatcctttgaggaataagcactgttatagcagtccccattttacagacggggaagctgaggctcagctagactctagctagtgttcgaaacctaagttgtctggctccagtctctcacccctcaccattattatctgcacagtaatgatggtaactgtcatctcttgatgataatgcgttcaggaactgagctcaaaagtttttccctccctcccttcctcccttccttccttccttccttccttccttccttccttccttccttccttcctccctccctccctcccttccttccttccttcctttttttgagatagggtctcactctgtcacccagtctggagtgcagtgtcacgatcgtagttcactgtaaccttgaactactgggctcaagccatcctcccacctcaacttcttgagtagctttgactacaggcataagccatcatgtctacctaatttttagttttttcttttctttttttttttttttcctttttctgtagagacaaagtcttgctatgttgcatggctggtctcaaactcctggcctcaggagccctcctgcttcagcctccccaagttctgggattacaggtgtgagctgccacgcccagcctacttatgttatttctaaaccctcccctgactcagagctgtggtaaagagccccgcttttgttgtcctgctcaggacaaaaatacatggccccaggcttttgtgagtaggatccggaagggaacttaagtgtgtgtgtgtgtgtgtgtgtgtgtgcacccacgtgtgtgtgggggagtgatagagattctcctggtttctgtcctagttttttctaagcgtatggagacaggtctgctccgtacatctggggattggtattaccacatcatttcccccctaacagcagcaaagattctcaaagcttcatcagagcatgaacaatcagaaatgccttaattttgttagtcacaataaataatactttgattaattagcaagcacatgccttgggaatatgagaaagtaaatgatttctaccctagatctttcagatagctgggagggaagagagtattaaaatacgcttttaactatgggttttggatggagaagaggagaatgccggagaggggaaagcagcagtggaattgttcttggagataggagaaactgaaactctttccacccagggtctttgcagaaagtggttcccactgcctggaatactttttcttctctttacatggtgagctctcactctagtctcaacttaaatgtctccccctttgacaggcccttgctaacatcctgtttcaagttccttctggatattgattaggatggtaagcttcatgaggttaaggatctctgtttcatccactgctccatcctctggtgtctgcaacgacgctggcacaccataggcccttattaaatatgtgtcgactaaatgaatatgtggtcttattaaatatgtgtcgactaaatgaatatgtggtctatttcaagtcctcgtttgtgtctgccctagaacttagcactgtttgccattagcttgtctatttccttgtgaatagctagattccctcatgagctataagggccacgatggcagggggtgtgtctaccttgttcaccaagggtacccaggatgaacctggcctgcagctaagggggtgggctctagggtcagattacttgggctcaaatcccagatttcctatgttccagctgtgtgatttctgctaattgtcaagccactctgtgcctcattttccacataggtgcaagaggggtgataatagcatctatctcttggggttgttgaaagaattaaatatgtcagtattggctaaaacacttagaggaagctgggcgtggtggctcatgtctgtaatcccagcactttgggaggctgaggcaggtggattgcttgaggccaggagttcaagaccagcctggccaacatggcgaaaccccatctctactaaaaatacaaaaattagccagacatggttgtgggtgcctgtgatttcagctacttgggaggctgaggcagaagaatcgcttgaacccgggaagtgaaggttgcagtgagctgagatcgcactactgcactccagcctgggtgacagagcgagtcttcatctcaaaagaacaacaacaacaacaacaaaaaaccacaacacttagaagagtatctagcatatagtaagtgcttcagtgctttatacatgtcagttattggtagtactcaaaatatttgggatttaaaagttgggggatttttacataaaaggcacttttcctctttgagtggtaaaatctcccctaagaaagaggcaaggacagatggagatgatctgagaggcccaagagatccttaaaaccaggctttttaagaaatctgatgttttatttctccgtattgtcatggaaaaggccagcttttagcatgcctggtgtttctggtgttttcttctcttcactgttttctacatttctttctttgcattggtcctttttttttcttttttttttttttaataaaaaaaaaatagcacagctcggagtcttgcttgctgacttactgctagagtgtgggatccattgcttccatttagagaagcagccggccctggaatgtggccgcagggctgccaggctgactctgtgagctgagctggcgaggaatgcactttgcagcttgcactgagtttggccttacgtctgtggaatttcttctctcttcttactcattcgtgtcgttaaataaataacaacacaagcagtgcatcctcccggttataatggcaaacagtacaatgtgttacaacacacagtagcttgaagaggatatctctctcctgtggtagatgcttcattccccagaacttcactcctcacccccagaataggttgcccagttaacaggatgcctggttcagtctgcattttgggtaaacaaggaacacctttttagtataagtatgtcccaaatattgcatagcaccaacttatcctaaaacactatttgttgtttatgtgctattcaggtttaactgggcattctgtagttttatttgctaaatctgacaactccagagagtctcctagaaccagtttcctgtattttcttccagtaattttccaagcatgtgcaacctatggatatcttggcagacttactcctggtagaattcccatcacctagaacagtgcttaggacattgtaggtgcttaataaatatgggttgaatgagtgattgactctgtacccaccccatttttcttcacataagtggaaatatattatagtgttgtttcatatgtagcttttccttttaataatgtctcatggggattgatacatagagctgcctcatactcctctaagggtttcctagcattcccttttatgatgcataatgtatttaaccagtcccctgatgatcgacattggtgctgttgagagtctttagctattataaacaataaggtagtgagcattcctatatatgtttacctctgtgggtttgacgacgtgcaaggataggtgtcgcattggaatcatgaggacggaggatatgtgctttaaaatgtggattgatgttgctgaattgctttctgtacaggatctgttcacacttccctcagacagcttgttccccatctccttaccaacatagaatattatcaaactttttcattttgccaatctgatcagtgaaaaactagtatctcgctatcatcttaatttacatctctttgcttatgagaacatttttatgtttgaaagctctatttctttttctgtgaactgcttcttcttttttgcctatttttttctacttattgatttttaaccggtttttgtttgtgaaagaacatgtctgttagcctggcatatgttttatatataatgtaatttataaaattggtgtttaactttgaaaaagtgatttattatggattttttaaactctgtagacattaaaaaattcctcagtagtcaatttatgagtcttttcttccacatattctacattttgtgtcttgcttagaaaggcctcttactcaatgagattatagaggaattctcccatattttcttttactactttaacttctttttttttgcatttaaatctttaatccatctggaatttattttggttttaggagggaggtgaggatctagctttattttttaccagatggccagccagttgtcccaataccatttattgaataatccatcgcttcccacagaattgaaatgctgcctttatcatatattaaattgtggaggagggattttatactcattttctgacagcctccagtgccagctaggcagcaaggattttagggggtttcagctgactagaggcaaagatcctgacctgaaggataaccgcaatttattaaaccagaaatactctgtgtaggaacagtgggtttcctgggtggggacagggttggggtgggggaaagtgagtgtcccgtgctgggaggaatttagttacagcaagatttctcaaccttggcattattgacattggggggtggaataggtctttgttggagcctgtcccatgtagtgtaggatgtttagcagcatccttggtctctacccagtatacaccagtattaacttcaccctgatttgtaacaatcaaaaatgtctccaaacattgccctgggtggcaaaatcatcttcagttgagaattactgctttatcaagcctgggtcgagcagacctcccatccatttcttttaaacagaggcagggtcttgttccgttgcccatgcagtgcatgatgtgatcatagctcactgcagcctcaaattcctggctcaagccatcctcctgcctcagcctctggggaagctaggactataccacatgcccagctaattttttagtttttgtagagacagggtcttactatgttgcataggctggtctcaaactgctggccacaagcaatcctcttgcctaggcctcctgaagcactgggattatgggcgtgagccactgtgcccagcctgaacagaccgttgattagatgcatgtgaggccctttcttgttctgagagtctgtcatcagcagtatcaatggctccagatgtctgggaggcaggaagggaggtgcctatctatctcagagaccagaacacccagatttctggtatgagtgtggggtctgtggggaaagggtggaaccataccggtcgactccgggaggaacagaggttcccacctagccctacaggtgaatcttgcaaaactccctaggacctgcctgggagcctagccattccccctgctaaccacacccccagacaacaaggcctggccatggatccaggaacaatgactctgagaaccggaggtggcagatgttttgtgatttaacagcatatcggtttattgtcttatttttcttaggagtaaaagagtccatgggtgtattgttgggggcagcaggaagcacacgtgtctattcggagatttggggcagcaggtggggagagaaagtccatctagacgagggaggtgtgggagtgagatggaagaggagagggaagtgggtggaatccctgggagctgggggaaggaggaaaacacagagaggagctggctgaggtttgagcaaggcctctggagattggtgagagctggggcggcggggattctttatgacagtgctgcagagggaaaaaggattgttgctgagttgggtggaggtaggtaggagtgatttgaagaaggaggtccccttgggaagttgcattagtgggtgaatgggggttttataggccaggcagagaatatggggagggcaactccagcagatgaacagcttttgcaagacacctgtgtggagcatgtggcaccacctgagcgtcctccccaggtgcggctctaacacaggtgcaggttatgttgggagatagagagccagaactcaggagtgccttgggtgccttgctgtaagatttgggctttccctttatttctttttttttgagacggattctcgctctgtcgccccaggctggagtgcagtggcgccatctcggctcactgcaagctccgcctcccgggttcatgccattctccagcctcccgagtagctgggactacaggtgcccaccaccgtgcccagctaatttttttttttgtatttttagtagagacggggtttcaccgtgatctcgatctcctgacctcatgatccagccgcctcagcctcccaaagtgctgggattacaggcgtgagccaccgcgcccagcctgggctttccctttatttcaaaacactcctcacccactcaatatagaaaaccaaaaaatagaggtgagcaaaaggaagagagtgaagaacagcgtggtgtcacccacccagtggccacctccataaacgctgtccagtttcctctgcacgtccttagcatgctccctgcacacccactgggacaccagctttgtgaaggcaggggtttgttttgttttgtttacagagctaggcgaacagttggcactcagtaactgtgtaatgaatggatctgtactgcaaacctgatatcacttgctcttttcacttcgaagttcatgattcgcttccttgttagtagatacctttctgggacaggtttttaatgggcacaaattattggactgggtaaataggccacatttcacggaaccaacaccctcctgctttttatcagttttcttccacattcctctatcacaagtgctttcatttgtttgggctgctgtaaccatgggtggcttaagtgacggaaatgtattttctcacagttctggagctggaggtctgaggttcttggcgagaccctcctcttggcttatagataacctctttctccttgtattctcacgtggcagagagcagagagaggaaatcagctctctcatgtccctttttaaaaattcacatacatttaagttcaagtgcagttttattacatgggtatattgcatggtggtgaagtctgagctttttgagtaaccatcacccaaataatgtacattgtatctactaagtaatttctcatccctcaccctcttcccaccctcccaagtcactatcattccacactctatgtccgtgcacacacattataagctcccacttgtaagtgagaacatgcggtatttggctttctgtttctgagttgtttcagttaaaatattgacctctagttccttccacattgctgcaaaagatgcgatttcattccttttatggctgagtagtattctgtggtgtatatagaccacatttgcttcatccattttgagtcccttcttataagggccttgatcccattcagaaagtctccatgatctgatctaatctcatgatctaatcacctcccaaaggccccacctcctaaaagcaacacactggggggttaggcttcaaccaattaatctgtagaggacaaacacgttcagtccatagcaggaagcagtgccgccatggggaagagcattgtcgtgaaaccttttgcccctcttgttgagttttctcctccagcacaccctgaacatgctgacagtgtcaccttcctctttacttgtccctcttccgctccaagttgcctcctggcttcccagtgtctctgtgggcttgagaccagagcttgtcataagagatagatgacgtcacttgatggaaagagtcaagtgcagtgaccagcacatagaaggcggccatcaacattggtttcatcctttagagcaaagtttccccaagcgcctggtgtgcactggtgagatttggggacggggtggtacttaagacctggcactaattaacactagatcactgtgtgggaaacatagtcccttttctgttctcttcaaatccttctgatcgggctgaggagaaagcctcaggttggtgctgatgtgcttttttctcccagacccccatcctaacagaaacagagcaggtctcaggctcgggccgttaggcaatgatgtcaagccagaatgaactaacattattttgttctcgttgtgttttattttcatgggaaacttagagttatattcagagatattgatttttttaatcccatttaaaaataatgttttaattgagataaaattcatataatgtaaaattcacattttaaccatttaaaatgtacaattcagtggttttaaacatatttataatgttgtaagccatcaccactatttaattccagaacattctcatcacccccgaaagaaaccctgaaccccattagcagtcgctctccattttttttctctcttccctgcggcccctggtaaccaacaaactaattccgtttctgtagatttgcctatcctagacattttgtataaatagaatcatacaatgaatgatcctttgtgactggcttcttagaataatgttttcaaggctcatccaaggcatgtatcagtacctcattcctcttaatggttagatcactttccattgggtggatggaccatattttgtctatttattcatcaattagtgagcatttgagttgtttccactttttggctgttataaatagccataaacgtatatatgctttttttttttttttttttttttttgagacaaggtcacccaggctggagcgcagtggcacaatcacagctcattgcagccttgaactcccaggctcaagtgatcatcttccacctcagcttcccagatagctgggactacaggcatgtgccactatgcccaactgatttgtttattttttgtagacacagggtctcactttattgcccaggctgttcttcaactcctgagctcaagtgatccacccacctcggcctcccaaagtgctgggattacaggcatgcgctaccatgcctggtccaattttttgtataagcatgttttcaattctcttgggtgtcttcctaggagtggaattgctgggccctataagagctctgtgtttaacttttgcaggccatttcctgagtgactttaagttgaaaagtaagtcagtttaaagaaaactattaatcatattgcagatggtgtgtggacatgacaaacgtcataaacgtggtttgcagtgatggaagagtagaaatcctgcttggacatgacctcctccatcaactgtttcccactcacctttccagcctgtggtgcctctgttcccaggagcctcagtgcagccacgctggcctctgaactgtcttacatgagatgtccttcttcaaagatactgccgtttgtcttgtcctgggatatgcgcgacccacattttttttttttttttttttttttgagatggagtctcactgtttgcccgggctggagtgcagtggcaggatctcggctcactgcaacctccgccttctgggttcaggtgattctcctgcctcagcctcccgagtagctgggatttcaggtgcgcaccaccatgcccagctaagttttgtatttttagtagagacggagttttgccatgttagccacgctagtctcgaactcctgacctcaggtgatccacccacctccgcctcccaaagcgctgggattacagacatgagccactgtacctaactgcgccacccctttataccctccagggagctggacttttcagagatcatctttcacttagaatctaccgtttaacccttaattgcatttcccctcatattattatactcactaatgattttgttggagaatcttttgcctctgctataagccacttgagggtagcatctatattcaagtagtccattgttcctctcatagtgcagcctcacctgatcaatggtgaacagctgctgatgaacagaaccttccctggaggcccctgttctactgaatcttggtcagccccgtgtcctgatgcttgccctgcttgctgttactttttgcctgtggttttactgtttagttaacttcttcttttcctttctttctttcttctttttttttttttttttttttttgagacagagtctctctctgttgcccaggctggagtgcagtggcgtgatctaggctcactgcagtctccgcctcctgggttccagcgattctcctgcctcagcctccagagtagctgggattgcagacgtgtgccacctcacccggctaatttttgtatttttagtatagatggggtctcaccctgttgggcaggctggtctcgaactcctgacctcaggtgatccaccctctttggcctcccaaagggctgggattacaggtgtgagccaccgtgcctggcctttatttatttatttatttatttattttttgatatggagtcatgctctgttgcctaggctggagtgcagtggtgcaatcaaagctcactgcagcctcgaactcctgggctcaagttgtcctcctgcctcagcctcccaagtagctgggactacagatatgtgccaccacgcccagctaattgttgtattttttatagagactggtcttgaactcctgggcttaagcgatctgcccaccttgacctctccaaatgctgggattgcaggcaaatcagattgtttcacagacttcagaatggaggctgaggttcaaggaggtggacaccaggcagccctgggaggccatcttccatccagtatgtagagtaaggaacaggaaagcaggtgtaccgagaggcaagaaccatgaatatggacaaggagaagccgagagaacacaaggggagacccaactgtcttccagttcccagttctcttcctttccttcagccagaccgaccttcctcctattgggcccaaatcatgtcaaaaaaaaaaaatctgactggccaggcttagtcaaggaggggatcatagagtcccagtgccatgggtgagggaggcagtcagtgtagacatcatatcactggggagataagccttcaatggtgcccactattgggtgaaaaggcagacctggagctctgaacttcagcttccccttcttcccaaggttgtagaagtgggaaagccaagctagtcatttctgagtgcgggaggagaataatgtgacaaaaatggttaacatcagactagctagccttgaaagcttgagtctgaacggtgatatcttaggagaggggaaaaaataagcatgaagctgtggctctgctccatttctggggaaggaagctcttctgacttttctggctcagtgcaggaagggttgaagaatctcttaaaatctcctgagtcctctttgtccttcatctcagaattcctgtgcaggtgatgtttggctgtatgctccacgaaaggaatagggaacttggctccctccctccagggactgttgctgctcctctgagtttccttagcttaagctgtgccccctgtgtgccatttgccttgggacagagatggcccccattttccaatcctgttgtaggggtgggaatgctccccagtatgtgaaaatatccccaagctgtgttttttttttcttttcttttggggcaggctcttgtgttgcccaggctggagtgcagtagcacaatcatagctcactgcagcctcaaattcccaggctcaagcaatcttgcttcagcctcccgagttcctaagtagctgagactacaggcatgtgcctccctgcccagctaattttcattttattttattatttttgggatgaggtcttgttatgttgcccgggctcatgtcaaactcctggcctcaagtgatccttctgcctcagcttcctgaacagctgaaatatccctaggcttttaagcctcagttacttaatcaacacagtggggccagtacagcccatcattggcatttgtggatttggcagtggtggttccttttctcattagctacccagaagatccttagcacagcatcataagtcactgtcttgaaactccaccctgaattggatgcttggtgagcatctgggagaggcagaatggtgttggaaccaagattgtgggctctggagtgagatttctctgtaagtctggacaccaccccttggttgggtgatcttgggcaaattaattaatgtctctatgcctcattttccttgcccataagtgcggatgacatagcacccacctcacaaggctgttgggaggtttaaatgagttaagacctgcacagcccttagaacagggagctttcaatatgtgttggccacagctcttgtgcccaatcgatttcactcatttgggcaatgcctgggttctagatgaagggggaggaggctgcctgtagtgtcttcttcatgggccagtccagctctgcagtggactgtactggtgatgtccaccgtgcctcagcttttaagcatatattctccttgaaaactatttaagcagaacacactggggtcaagccagtccaagccagatgtttggggtcctgggtgcttctgttttctccatgtctgtttacctttaacaagatggatgggggctgtgaagcccctctgggcagccttttctggctgtgacatgcaccagaaacccacttttggcctgtttgcactgtgttagaaaacagcaggtgcagttggcagcctctcccctaccccttctcccgttagcccctgatctctggggactccttagactaatgcagttttaatgaatacacattactgtttacatgactgaaatgagaggctggctgcttattttatgctgaggtttacagccctgccttttaaaaccctctctcccttgctctgcttctggccatggcgatattttctggcggcccctatgctgtccctccaaataaggaattcaccatgaagtcctgcagcagtgtcagagccattgccttgccccggaaggagtgaactgtgtagaacaaaagcagaggctgggagctgtagttcacgcctgtaaccccagcacttcgggaggcagaggcagaaggattgcttgagcccaagaggtctagaccagccctgacaacacagtgggaccccagtctctataaaaaatacaaaatacaaaaatacaaaaattgatgacctgcacctgtagtcccagctactagtggacactgaagtaggatgattgcatgagcccaggaggtggaggctgcagtgagctttgattgcaccactgcattccagcctgggcaagagtgagactctctatcaaaaaaaaaaaaaaaaaaaaaaagcagaaagatggattctttatttttttaatttaaaaatactttttacaattcttaaatgcttgcttatgatagaacaattagaaaatgaaggtatacaaagagaagaaaataaaaatcacctctaattccactactcagaaaaaactcgatcgttaacattcctgtttatgttttagcatattttaatcaatctacatttatatgtattttaaattaaaattagaaaccaaacttaatacatgttattcagaaatctgctttttaccctacctcacaattaatatatgatgaatgtctttccgagttaagaaatatagatctgcagtatcttttctttaattttaattttaattttttagagacaggatcttgctcagttgcccaggctggagtgcagtggggtgatcacagctcactgcagcctcaatctcctgggctcaagcgattctcccacctcagcctgccgagtagctgggactacaggtgcatgccaccacatgtggctaattttttttttttttttttttttgagacgaggtcttactatgtagcccaggctggtcttgaactcctggccacaaacaagcagttctcccacctcagccttccaaagtgctgggattacaggcttgagcaccatgctcgatattgcagtatctttttttatgcatcattgtatcctattctataattgtttctatggtctcatttgtagaaaggttaacattaaatttcgaatagttatatgtactcactggttcaaaattaaaaaggcacaagagctttaatacttttattgaaagatttctctcctatccctagcccttaggccactctgttcacctcctttttggcacccaatattcaactaataataccaatttattgtgtatacttctggaaatagttcataatgtacatgcacatcatatacatttatttttctcttcctcaaacacgtacattcaaatgttagcttaccttgctttcttcacttcacaatatcctgtatcttggtgtttgttccatgtcagtgcatatagaacatcctcattcttttttttgaaacagagtctggctttgtcacccaggctggagtgcagtggtgtgatcttggctcactgcagcctctgcctcctgggctcaagcaatcctcctaccttagcctcctaagtagctgggactacaggcacacaccaccatgactggctgatttttgtatttttttttttcattgttgttggtagagacagggtttgtccctgttgcccaggctggtcttaaactcctgggctcaagtgatagggtcacctgggcctcccaaagtgttggggttacaagagtgagccactgcacccaatgtctcattctatttttatttatttattttttgagacagagtctcgctctgttgcccagaccggagtgcagtggtcttgggtcactgcaacctccactttccaggttcatgtgattcttccacctcagtttcctgactagctgggattacaggtgtgtgctaccacacccggctaatttttgtgtttttagtagagatagggttttgccatgttgcccgagctggtctcaaactcctgacttcagatgatccacctgcctcccaaagggttgggattactggcgtgagccaccacgcccggccacctcattctgttttatgattgcatcgtggtccatagtatgggcatccctggggtgtttccaaaattgggatatattgactcagaaacccttcctgtggttctgtccaagctccttgttcatatgacctggcctggggtgactggaggaaggatgtccattcggagattaggagggactgcagctctcgattatgaatgggattggcctccacaggcctgagtgacaaggacaaagcagagctggtgagccccatgccaggtggcggtcactggtggaaggccatttgtgacttctctgcagttctccagatggaccacatttaaaacagaggcactgccattcatttctacttggttgaggaaaggtttcatcgcaggcccagagagaggatcagatgttttttgcagtttctggcaagacattagtgggtatcagagggtaagtgatctcgtaaagctgactcaaagcaagagaaaatttcgtgtctgtcttagaaacacatttgcctccaaagggaaggcagggtgtggaggactaatcaacgcatttcacatttggtttctttgtctttcttggtgatcttacgtgactagccctgaatattttgcatatgtcaaggaaacatttcaaattactaagatgagaggaaaatatggggaatgaataaaatggggtttatcagcaagaacagcaaaagacttcttagagccggctggggattgttttgtgaatctctaaacaagaggggcagtttgacttggggatgggggatgttttgacacttggagggatgggagggagccaacaaagatgtaaagcaaaactgggatggtggtgatggagaagcagtgggggtttctatgggaagacataggaaataatggtctgtccttcacagagtaggtgaggtctactagaagatacttatcttttccctaaatttcagtcaacttcacatgattaagtttccattattaaagacttgttctttgtgttacctttttattattattattattattatttttttttttttgaaatagagtttcactctgtcacccaagttggagtgaattggcgtgatcttggctcactgcaacctccacctcctgggctcaagagattctcgtgcctcagccacccgagtagctgggactacaggcacacaccaccaggcctaactaatatttgtatttttagtagaggtggggtcttgccatgttggccaggctggtctcgaactcctgggctcaagtaatccacccgcctcggcctcccaaagtgctgggattacaggcatgaggcaccatgccaggccttttgtgttacttttgtaagagatgaaatgaaactaatatctaatcaaatctaagcatcaagcaattaaaaatattttcttaaataactattgagttaaataggactcaaaagtacaattgcagagaggctataaatgaaaaaaaatagagtgctatataaaacaatggataagatcagccaatgctgtgcttgcagataagttcatagctttaatacttttatgattaaggattgagatgacttgctttgagcataatctggctattcacttattctaaggaacttgtcatggctcaaacatgtttctagtatcctctttagaaattccgtttagatacagttttctttattaaaccttctaaggtgactatttcaaagatgaaacattcattttgttgtttaaattaacacgtattttttaaagggttatgtaaatgtgttatccatcaagtatatctttgagccttcatcacagtgtgatgtaagggatataagttgttaaggatccagcagtagagaaaatttctgcacaaaagtaactatagctctattacttttggaatattccctaggatacatccaaaaccaaatcaaattatactacttataaaacacatttggaaagatactatgtgaatatgctttgaatactgaggcttatgttagaacagagtcatggacgaatttgcaaaaaaaaaaaaacctccaaaatttcctggagtctgacaaaaataccggatagggttcctgaatatattttcatgatctttgctatataaccagatatctctatattttgaaatggatcatattttattagtttttcttagtacacaagcaacatgctatcattgcagatgccagaaagtaggatcacattgttgtgctatagatctccagaacttctttatcttgcaaaactcaaaaactctatcatttctcaaactcaaaactcaacaattctccattccctcttcctccaccccatggccaccaccattctactttgtctctatgaatttgaatactataggtatctcatataagtggaatcatccagtatttgtcatcttaagatttctttctttgtgtaacgttatcaaggttgatccacattgttgcgtgtgtcagaagttcccttctcttttaaaggctgaatatttcattgctttatagactgcacttttttatccattcatttgtcaatggacagttggattgctctcatcttttggctattgtgaataatgctgctatgaacaggagtgtacaaatatctcttcaaggccctgttttcaattcttttggctatgaacccagaagtggaattgctagattaaatggtaattctatttttaatttgttgagaaccaccatacttgttttcatagtggctgcaccattttgcattcccatcaacagtgcacaaggatttttccacatcctcaccagcacatgttattttctttttctttttttgatagtagccatttaatgggtatgaggtggtatctcattgtggtttttgatttgcattttgctaatgagtgatgctgagcatcttttcatgtgcttattggccatttatgtgtcttctttggagaaattctattcaagttgacttctatgattttgcattatcacatctgtattgattcaagcaagccaactagaataaattctggcatttaaaccgattttgtggtttttctgcaaataaattctgcccccaaataacctccaactttctggaagcagtcagcaggagtacagttctgaagataactttctttaaaaaaggaaattcataaaatatcatgcatcttccttttttgacactaatggaacaatttaatgtaatttcagagggaagcagagcccctggaaaggctggtgtgataagggaaggttacccagctttcctgtcaggcggtgtgtgggagcagagagtggcattctctgcatactcttggggagaagagtgggtgagacaggctgctcagggctggggcagagcccaggggaaggggatggaaggggaagaacagcccttcaagagtcctgcagaaattggtggaagttatttaacagaagtgttcggctccacccagcacattctgttgccttctacatacagagtgtgttagtctgttctcatgctgctaataaagacacacctgagaccaggtaatttataaaggaaagaggtttaatggactcacagttccacatggctggggaggcctcacgatcatggcagaaggcaaatgaggggcaaagtcacgtcttacatggtggcaggcaggagacagcatgtgcaggggaactcccatttatgaaaccgtcagatcacctgagatttattcactaccatgagaacagtatgggggaaaccacccccatgattcagttatttccacctagccccacccttgacatgcagggattattacaattcaaagtgagatttgggtggggccacagccaaaccatatcacagggtaatgaagaatgtgtgcccaagtagtagagggcttaagaaaaccactcttgggctctgagtctctctaggtctcagtttcctcatctttcaaatggcaatattaataagacccacctcatagggattgtgtggggtttaaatgagaaaagacaggtaaggtgctggtaccttataagtgattaagttgccattaaggtattggggacttagtgcttgtccttgaagagctttcggtctcgtgaggagacagcctgatcgttataaactattatagaaaatgggaagaaataagggttgaggtgtgataaagatgtgctaggccaggcaagatggctcacgtctgtaatcccagcactttgggattacaggtgggcagatcacttgaggccaggagttcaagatcagcctgaccaacatggcaaaaccctgtttctactaaaaatacaaaagttagctgggtgtggcggcacccatctgtcatcccagctacttgggaggctgaggcaggagaattgcttgaatctgagaggcagaggttgcagtgagccaaaattgcacaactgtactccagcaagactctgtcaaaaaaagaaaaaataaataaaaaaagatatgctataccctcatatcacaataatgccaggaaatagatcattaattctgaaccctaattcttgggtgggcatcaaggcaggcctcacaagaagaaggcatttgagttgaatcttataggctcagctgggttccaacagcaaagacttagggaaagggcagagcaggcaggggaacagtaagagcaaaggcttgaaggcatggaagttcatgggtaattactgactgagatgtttggtgttatggtgcatagaacactatcggatgataatgaaaacattgaattccagcatgtttagaaggacattggctgataaaaatgacgtcttaatagttatctgtggacaaatttgtaaatgtaaaagagttgtagactcaaatcctacagaaattaggcaggagacctaaatgagtgaagtgggtgggtataaaacagaggtggtggcaggaacccatgttgaattgaatagtgggtgttttgtttaaaggggcaccagtagtaatttttcctctgttggaatatgatcctagggctgccagctcttctactttttcaagagaagccagaaatctggatttcatgcaaaatttcttgtttttctttttattaaagacatggtatggaccaaaaaaagatgtctctaggctagatctctgcaacctctcatctatactctatttgcatttttaaagactatatgcaaatgttatttagcagagctacctagtttttttgtgtgatgatagcatgtgaaagagctatgatacatcttggaaatgtcaactttgaaatatacagtgactgtgttggtcactacagaatgatctctgcagaaacttcagttacattttctctaaatgacacctttgctttgacaacacattttcaaaaagaaaaatagcaaactacccttcctccagggccttagccacagtagctcctgccagcataacacaatgctgcaccttactgagggatcaggaaatgtggtttgatttataattatggcttcatgggtagaatggtggccaatgtccacatgagccacactcagtggctaagatccagagggcatttaatttaggtagccagtgttacagacatagtttagatttttgcagccttgaccaatcttaatagatctgtctgttctttagagttacctttttttcctgcctcctagctacctacaccttttaatgctaaatgtagttagctagtgaatgctgttatttgaatcttaaaatttcaggttgggacagaaccttaaaattcatgtatttcaaccaccctttgtatgaggcaggaatcttggttatgacaggtgacagaaaattcaaactagcttaattcagaagggaatttattgcctttataaaaccaaaaagtccaagggtagctgccttcaggtattgtctgatccaggggtttgttatgtttccaggacatggtttcctttattccatctctgcttatgtattggctcccttctcagatggaagagactcccctcatcaaggtgagatggctatggaagctctactcacatttcctctaggttcaagtccatgtagagaagagcacctctttctcttgttatatctcacaggctctaaattagctactagggccagtgaaaaagcaatgtgctgattgaccacccttatctactcttggagttccggatggaattaacactacctgaattatgtggaccaagagtgggaaaggaatagttctccagaaggatatttggtattgttattaaaataaggttaattgaatactcactgaaccatctaatgcttgaattcccttcatagcacgccattggtgactgtccaatcttcagttactaacatgctacccccaaaatggtgtgtttgtgcagctctaataatgacagggtttctcctaatactgagatgatattggcatctccatagttccagacattatttctggtcccaaccataatcaacctgttttgacacgggtgaacatgtaagggaagggattgctcattgtggtcacagaagtaacctacccaatagaagcacaccaacttgaagcatgcttccatgatcactgagggaggaaaatgattggcaagtctcgtattggtccttgaagcgctccctataaacacttgtcactgccaagcgtgtatcactggccaaagcaagtcacattgtgatatgattagactttgtgtccccacccaaatctcatcttgaattgtaatccccataatccccatgtgtctagggagagaactggtgggaggtgaatggatcataggggcagtttctcccatgctgttctcatgatactgagtgagttctcacaagagctgatggttttataaggggctcctcccccttcactcctcactcttctctctcccgtagccatgtgagaaggtccaagcttgcttccccttcgccttctgtcataattgtaagtttcctgaggcctccccaaccatgcggaactgtgagtcatttaaatctctttcctctagaaattacccagtctcgggtagtatcaagatagcagtgtgagaaccgactaatacgcatggccatgcctaacttcaaagcggctgggcaagtatcatattgctgtgtacttgggaggaggggagaatcagaatatttgatctggcgaccaccacacaactgaacttctctatttctgtgttcttcttgttaaccatctagtttctgtttcctcttgtgacacatatattaattaatttttcaatacccaaacacaagcctctaatatttatctttgtttagttacttcctaataaactaagatatctctacatcctgatcctaaaattcaaaggctccacgtataccatggtgactagttaattccaatatattgcatagttgaaaattgccaagagagtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacggactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacatcttagtggatcactcctctctcccttttcattctgcaggacttgcccattggggctctttcagacctgactggtcattgggtatctgtggccatgataatcactctcttcctggacgtgaccctcctctcgttaaccaggatgcctgtgttcttaaggttggccgtttccaaggacagagagcttgcatcccatttctaggggactggggatccaaggactccattcttgacattgtcttgtcagccttgaagtgccgaaacccagcatccctgtctgaggtcatcctgtctctcttccaaacatgaggacttcttaaattttttaaaaaaagtttttacttgtataaattgagaaggcacaagtgcaattttgttacatggatatgttatttagtggtagaatctgtgcttttggtatgtccatcacccagatagggtaccctgtactcattaagtgatttcttatccttcactcccccacccaacccttccaagaaggatgactattactcaacagtcattcagtagccattggagaatgactattattccatactctgtgtctatgtgtattatatagttcccatttataactaagaatatgcattatttgactttctctttctgagttttttttttttaagataatggctttgggttccatcctgttgctgcaaaagacatgatttcagactgggcatggtggctcatgcctgtcatattagcacactgggaggctgacgaaggaagatcacttgagcccaggagtttgaaaccagcctgagcaacttggtgagactccggctctataaaaattaaattagccaggcatcgtgttgtgtacctgtggtcccagtttcttgagaggctgaggcaggaggatctcttgagcccaggagttcaaggctgcagtgagctatgatcacacaactgccccccagcctgggtgacagagtgagaccctgttttagtcaggacttcaagaccagccttgccaacatggtgaagccccatctctgcaaaaatacaaaaattagctgggcatgatggcgggtgcctgtagtcccagctactcaggaggccgaggtggaagaatcacttgaacccgggaggtggaggttgcagtgagccgagattgccccactgcactccagcctgggcgacagagtgagactgtttcaaaaaaaataaataataaataaataaataaaaataaaatcaaaggtcttactcttttttatggctgagtagtattctattgtgtgtatgtatatatagatatacatacatataccacacacatacgtgtatatatgtatatatatggtggtatgtgtgtctatatacacacaatgatatgtatattaatatatatgtatatataaatatatatacattttctttatccagtcatccattgattgatgcttaagttgattccatatctttgctattgtactgtgataaacgtatgagtgcaggcatcttttatataataatttcttctttggatagctgcccaaaattcaggtaaaagatctcagtctacaaggcagctcccaagcttcaaaaaattgtcctgccagatttttaaaagcaagttttctcaaaagcttcgatgtatacattggtcgatttatttatccattaaagtatttattgaatacttcttactgcgtatggtggtggtggtgctgaggtgtctcacagtgaacacaacaggcgtagcctctgctattaccaaaattattgtctggtaaagaatgcagatggctaaccaggcaggtgcctgtacggtgagatatgtgctgtgatggctgtaagcgcatggtgtgagcgtagagttgggtgcttaattgaaggcatcaggaaggcttccaggactaaatgatatcaaagtcccaccttaaggatgacaggtttaactaagtaaaggaggatgtggaaagaagggggagagtgctccaggcagaggaaatagtatatacaaaagcacaagaggattgaagaaccaaaatcactttggcatggctggaatgaagggcatgtttgtgtattttcagggtaggggatgtgtttagggacaagctcagagaaaaggaagtaaggaaccctgtcataaagggctcatctgtcctatgaaagagtgtgtacattttattctgagagtacagagccttttcttttttctaagcattacatgattagatttgtcttttagaaaccactctggctgccgttaaaaatgaatttcacagtgacaaggctggaggaaggatcttgggttaggaggcggtggtagtaatctaggcaggacttgaggacgcctgagtggtggtgaggaaggagagaggtggatggaagattcaagagatatttagggggtgttattgagagaacttagtgattgatttggcgtgggaggaatgagaaagtcagggatggctccctggtttctggcttgggtactaggtgcgctggtggtgcttttgacagagatagaaccatgggaggaggaacatgttttgagggaaggctgtctcccttttagacacctagttggtgtccaaatggcacagaccagttggcgtgtggatatcttggggcttagggcgtggatctgggctcagggtggagatctgagccttagctgcacatcagtagtcattgcagtcatggagtgtgctggggttttgccaagagctcatgtagattcaggcgagaagagaggaggggcccaggctgggaatactggctttggaaatactcttgaaatatatagaaatgaaagaatgtatagggctgtttccacagacgtttattttttatttttatttttttgagatggtgtttcactcttgttgcccaggctggagtgcaatggcatgatctcagctcactgcaacctccacctcccaggttcaagcaattctcctgcctcagcctactgagtagctgggattatagatgcccacgaccatgcccggctaatttttttgtatttttagtagagacacggtttcaccatgttggccaggctggtctcgaactcctgacctcaggtgatccacccaccttggcctcccaaagtgctgggattacaggcatgagccaccgcgcccggcccacagacatttactgagcaagagcttgtgcaaggcactctggtatgcatgcagtcggggaccctctgatgaatggaactcaggccttgtataaggaagtgacctccatcagagggtggagacgctgtcagtgaacatccatcacagacaagtgactgagctaggagctggggtaaggtagaaagaggaggacagtgggcgatatgagctgggaaatgcacctctgttgggggactggggagggcttcctggaggaggtgattttggtatctagtggttttgttttgttttgtttgttttttttgttttgagatggggccttgctcttgttgcccaggctggagtgcaatggcatgatctcggctcactgcaacctccgcctcccaggttcaagcgattctcctgcctcagcctcccaagtagctaggattacaggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtggggcacagcgtactatgaaatgtgactcttcccccgggacccccgaaaaaatcttctgtaacattttatatgtgtaagacatctctctaccatctgctatggtcgaaatgggatttgtagagagctcatgtgattctcaaacctcctagtaactctgcttacatggagagacagctgtctccaagccagctgttgtcttttggaaagctttaatctgggggaagataacaccttgagaaaagatgtcaggattggaggcagatgttgacggagccagtttctaatgccccaaggcagccacactttgtatggattgtatggatgggcaggtgcacaaggtgagttatttttttccctacccagaaatttatggaagcctggcatggtggctcacccctataatcccagcactttgggaggccaaggtgggcagatcacttgagcccaggagttcgaaaccagcctgggcaacatggtgaaaccctatctctactaaaaatacaaaaattagcctggtatgggggtatgcacctgtagtctcagctactcaggaggctgaggtgggagaactacttggacccaggaggtcgaggcttcagtgaaccatgttcatgccaccacacttcagcctgggtgagagagtgagaacctgtctaaaaaaaaatatgaagttgctcttttgaagagcattctaatgacttatctggagattctaggaaagaaattaaattcagctttcaatgtctgtctttctagatttcttccttctaacgttattgttgttatgtcctcaaacaaaaacatttagtacttattatgagcttcatagggttgttgtggattaatacatgtaaagctcttagtgcaatacacgacacatagataacatttaattttattatcgttactgttgggtagcactcagttcatgaaattcccacacacagtcaagtggtaaatgctattactttgtaaatatcatcgatgaggaacctgaagctcacagaggttgatgacttgcctaggatcgctcagaaagcaggcagcagagctgattgccatggtaaccatttccaagcttcagtgcccagagatggacccagtctggcatgggcttatcccctggagcactgtgagtgtcttgacagataagtaaaggaagtctttaatttctgaaaaatgcccagctgtgattggcattgttaggggtcagtgaagacacgctcaaagaccttactgtccagcttttttatctttcacctttaatgccgctgttagccccaggagctaaccaaaggggagttttctttatcagttccaagagggatgccatggttgtcccaagattctggagctaaaggtgggaccaggaccagaattcagtttctgtgtttccaaattcagttctattctcctctcagtagaccaggaggcctccagacaagacagatggcagacagctacagtagtttaaaatagcctgagctcacttctgaggtagacatgtgcgtggagtgagctggaagacagggacccctgtgtgggaaagattttggcaaagagaagcccagtggggagttctgatgctaggctgagtgtcatcaggttggggtgagggtgtgagaagagacctgagcaggtgccaacctgaggctgagtggggaggagagaagcgagaggacaggtgccaggcaagatgcggcactgccaatcagtagaagcttcctccctcctttccagctgtgctaccgagacggggaggtcaggtggtcgttctgggagggctggtgccttttacttcccggccttctggcctgctgggtcttggagtccagtgcaaaataatgaagttcctataaagacagtttgtatagatccttttaggatgacttgaaagcctatgcatttccttaacaatgatcaattcttggctaatcctctttcatccatatccgcacccaatgcttttcactccatttccatactggatgttttgaaataaatcccagacaccatataatttcagtaattatcaatctcaatatcacagaaagtcaaatagacattatatatcttctaatatgatgcaaatagaagtggccaatgctatctatgcaatattattactaaagatctaaccaaatttacaggaaatacagagaatatgtaggaaattctacatagaaataacttgatttcttcacgaaaccaatggcatggaagtgtgaaaaaaatagaattaaaagatatagcaatctaagatagtgtgtggacctcatttggaaataaattcaaacaaatcatccataaagaaaacattgtgagataatcaaggagaaggaaacattaactgaaatataaaatgataataaagaattgttattgcttttactgggtgggataatggaattgtggttgcttttttgttgttcttatctgtggagatatgctgaagaatttatgggtaaaataaaactaagcgatgctaggtggggaggaacctatgcatttcctattttttggcaaaaaggccccaaggtgtagtccctagcacctatgttcgaacaatgtgacccagcattcctgctgatccctgactgaaccaggtatggctccacttgatcctctctctggggactgggagttagcattcagaaatgccagctagcctccatcaacagcagactggaaggatcaggcatctcaggaatcatgcaatgtgcatcaaaaaatagagaaagcttatcttcagagagacagacaagtgaagctggctcagaggtcatgtggaccagagggatgggggaagcagttgccttggttcctgacaatcctgcattgaagtcaaactgctgttcctttccctggtttctgtttccttgtaacagacttattcctttgcttgaactgggggcttttagtggggttctgttgcttgcaaatcttaagtactctgagaaacagctaaggagatgaagatggaaaactttgtcatgaagggaatgggttactggaatctttctggagggagaatttcagaattacgaggatgcagttctgattgaagggggtcttgtgggtatctgggatttggaagtgagaatgaatgctgtagcagatgctattagctacccatccaatggcgattccttctttgtttctagttttgttcggtggcaatgtgcccaggggacagtgcatgcatgacccatgattatttccctttcagtgattggtctggaagtgggcactggacccagtttgggtcatgtaggaaagactctttcttttcatcctttcttcctgctctggaggctgttaggtgaggacataattgttggagctatggcagccacattatgactatgaacaggtgcctagatttgtagcaacactgactgagagcactgtcattcttgagacactcatacctccttctttcagactttattattttggggatgatatttattgatgagccccttttggttaagttgcatatggttggctcttctgttaattcaagccagaagattcttaattgatacagttaggcttcataatttggaggtttgggaggaaaatgaggtgaaagagcatgcattgttggggaagataatattttaaatcagaaaattaacattttctaccagaagaccttcaattattatattatagactggtttgcagagccttttgagagtggtgtgaactgatatccatccatccatccatccatccatccatccatccatccatccatcatcttctgtttgttgattttctatccatccatccattcatccatccatctatccatccatccattcgtccatccatctatccatctatccactccatccatccatccatccatccatccatccatccatccacccatccatccatcttctgtttgtcgattttctattcatccatccatccatccatccatccatccatccatcatcttgtttgtcaattttctacccatccatccatccatccttccattcatccatccatccatccatccatccacctacctcatccatccatccatccatccatccatccatcatcttctgtttgttgattttctacccactcatccatccatccatccatccatccatccatccacccatttgactttctttttacgaaactttccctttgatcaatggaggatttccttcctggacttgcttggttctgtctattatcagctgggtataaaatgcttttccttcttcagttaggtcacgtgtagagaattgatattagatagctatggtgaggagtgaatgggattctgcctggcctctctctagggacactttgccttctgcagtgtctggcatttctaagaaacgttgatttttaggcattgaggaaaaaagctgttttttttttttttttttgacattaaaagctctagttttcccttattttattccctggagcttctttcaacatattcaagcactgttggcttcaggcgtggctttgtgggctggaaagggccagggtatgttttcagaggaatcctgtgggattgaattaggaatgctgccttcaggggataagtattattttaataggaagatattctttattttttgattcttaggaattgctgtttctcatgtagatgtacttacctttgttacattaataagttccataaaatattttcagcgtatagaatttttatatatctagaccattgtctgtttcaggttaggaattgtcagtgtttatacgtgcgcctaatcccttgtagtctgttcgttactgggatggtggtgatgggggcactagagggtggaatttgcgcacatggagagaggagatggtgcatgtcagtgtgttttccagttgaggcccttggggttgtgggtggggaggaaagaggaggaggaggaagccagtgtggtaggagtgtgatccacattctcaggaagaaccatatttgatttcatttagaaaacggaattcttacttcttgaacaaagttggcttttcttctctgaacgtggcctttgcaaatgcttgagtctttgagtatggtgatgactgagtgagaggagggatttgcttggggcagcaggcacatctggaaccattgaccacaaacctggctgagcacagagccacccggatgatgggcttaataggtacaaactgggaacttcccctcaggcatgccaactcaggaggttgtcaccagtggctgcagcttggagtgatctggggatcttttaaatgccccaatgccctgcctctacctctgtcagtgaaagcaggctgtctgggagtagaatcagagcagcagtattcattaaaggctctccaggtgactgtcatcagcatccaggtttgagagccactgtggggaaataatctgtactttctataaagccagaagcagtcagttttctgaacatcactgattagaccgtagccattttccagtatggacaaagtaggttctctcctgccatcccccagctgcagcaaacttctcactaatgggcatgctttgagaaacaccaaactgcagggacccaaaggagcatacaattaacgttaaatcacaccagctttgggcatatatatccctcctccaccccaaaatctcttttaaaatagtgttttaaatgtattttttgtagtatgttcacaggactcaaaaaaaaatacaaaatgctgcactattcacaataacaaagatatggaatcaacccaggtgcccatcagtggcagaatactatgcagtcataaaagagaatgaaatcatatcctttgcagcaacatggatggagctggaggccattattttaagcaaattagagcaagaacagaaaatcaaatactgcatattctcactgataagggagagctaagcattgagcacacatagacataaatatgaaactagacactggactactggaagttagagggaggggtgggtttaaaaactacctgtcgagcactgtgctcactgccagggtgacgggatctgtacaccaaacctcagcatcttgcattattcccgtgtaacaaatctgcacatgtacctactgtatctaaaatgaaagttgaaatttaaaaaatgtttaaaatccacacagttttaaagtctcttattctcttctgttctccatccacccatttcccacccccttctctggatatcttttcagaaatcttttccttcaccccctttgttgtcacacaaaagatgacatactgcaacccctattctccaccttgttttttttttttcctgctaatatttggctagtaagcaccagcatggtgtaatgactggcatttgttctgatttgttgagcatcctcagtgactggcagaagctcacatggtgctgccagtctttagatatttgaattacttcccctgtccaccccacgtctagaagatctctctaagcaatgcaaagacagcttccttatactactttttaaaatagatgtagagtatatatatatttgagacagggtctcgctctcacccaggttgcagtacattggtgcgatcttggcttactacaacctctgcctcccaggcttgagtgatcctcccacctcagcttcctgcgtaggtgaggtcacaggtgtgcaccaccacacccaactaatttttttttttttttttttttttttgcatttttggtagagacagagtttcaccatgttgctcaggctggtctcgaactcaagcgatccacctgccttggcctcccaaaatgctgggattacagatgtgagcctggcccaagtattcattttttaatagatgtaaagtatggataattcataatttattaaacaagtcctgtagggatggactttaggtgatttccaatttggggccattacaaacaatgccattaagaatagtgtggccaatgcatcacttcagatgtgtagaaatccatctgtagagttcccataagtgctatttcttggtcaaggggcatgtgtagagtatctttagcgacgggaaatttcacgaaggcatcacattttccagtttgctgtagcaggcagctctgcttctgaaattgtagtaggtacagggttttcttttctttttttccattggtggctttgaggaactttcagatgggatagttgaaaaatgtacatctaatggttttagaggagatgcttctggagctgcagttctcctagggcctttcttgaatgacctgcaggcaccatctggtgtttgttaaaaatgtggaccctgagccctattagactctttgaggcaaggcccaataaatttttaacacaagcttcccaagcgatgcttctgtgcactgaagtttcagaaccactgttctaagggatttgttgtagaacaatgccgtgagaggacatcttttcatatgattagcacagtggaaccacactggtttactcgggacaaagtctgcgactgccatgaacattgcaagctcaataatgccaagcaaagactgagtcttggcatcgggttgaaaataacatttggctatcaacctctgatgcagcatttacaagtttgccctcaaatgcccatagaataggaggaacagggtcaacaacactgaaaatagtcagataaccagttgctggaatctcagtgaaatatccattaactcaaaggcagatggcactggattggatctacccttcacagtcaacacctccaacaagatggaacaagaccaactggaaacagctttgtctatcttccactgtcctattcctagactaagagactcagcttcgtaccaagtgggaagtcactctcttctgctcaaaattaagtttttgaaatgaccacaggcctcttacgatggctaattttcctacattcattcagagaagccagcaagggaaggggaggcagttaacttgtgcagtggtttgtgtagggaactgctggtggtgaattgaacgttcagttgtgtggctgccatacgttaggtgcatagaagagaccgaaggaactagggtgtgagtgcattgtggaatcagagaatcagattgtggaggtgggagaagagtctgaggcagttcaagagagctgcagtggatgagtgcttgctaaaatcccagtgctatatgtgtagttctgccctccaaccatggcttgagaagaggactggaccattactagcgaaaacatcactaggaagggcagcctatacaaccaatcttctggcagacacagggcctggatatatctttccaaagaataacccagtacttaagacaatgcagctgcgtttacagagttttgaagggaaatgttatcatctacatatttgattctcagtcaaactgtcacttatgtgtgaaggcaacagaaagacagttttcagatataaaaaggcactgcaaatctaccaccactgaaaaagttaattgaagatgtactctgattgagagcagatccaaaattaggaacttaagaatgaagaagtcatggtatggaggaactgggatgagcacttccagtaattaaacataatattgagtccaaataattgttataagtctccaattaagtgtcagacaacaataattatttgtgaatgagtagctatatggtgtaaaattagcttcatgatctatttgagtgcaaaatcctagcatataaatgaagactgggaagtagataacataggagcaaggatatgaaaactttacttaatctatcatcttttattggttttacttaatttttcatctttcattgtggaagacagtcagaaaacatgctgttaactttctttaatcacaatgaagtaaaactagaagttaataacaaaggttataaaaaatcaatgacttaaatataaaatactttccttaatgaccctgggacgtgttcaacatagtgctgtatgttcctgttggtccttaccattgcaatacggcaaaaaagaaagaaagaaagaaagcatacaaagaaagaaataaaactgtatttatttgcaaacgacatgcgtatctgtgcagaaaataccaaggaatctataaaacaaaccaatcaaccataaacaagccatcctacaacacataagtgaattcagcaaggttgccagatacaggggaaacatacaaaaaacaattgtatttctataaactagcaatgaatacgggaagactgaaattgaaaatataatactattgacaattgattgctcaaaggaaaaaaataattagctgtaaatccaacaaaacatttgcaggacttatgtactgaaaactgtaaaatgttgatgaaagaaataaagaatatctacataaatgaagacatactgtgttcatgaattgaaagactcaatatagtaaaggtagcagctatccccaaattgatatacaggtttaatgtgattcttataaaaatcccaacaaaattactttgtagatataaataagattattctataatttatatgagaaggcaaaggaactagcatagctaaaacagttttgaagaagtagaataaaatgggaggaatcagtctaccgtagtcaagactatgtgatattggtggagggacagacacataaatcaatagaacagaatagataacccagaaatacacccacacaagtatgctcaattgatttttgacaaaggcacaaaaggagttcaatggagaaatgaattttcaacacatagtgctagaacaattggatatttattggccaaaaaatgaacctcagcccaagtcttgcactttatacaaaaattaactcaaaattgatcatgctattaaatgtaaaatataaaactatacaacttttagaagaaaacataggagaaaatttttggaatctagggtcagggaaaatttcttagactttacaccaaaatcatgatccataaaaggaaaaattgaatagtcggacttcatcgaaactaaacgctattgttctgcaaaacgctgttgagagaatgaaaaggcaaactacaatctggaccaaatatttgcaaatcacttatctgacaaaggactattatctaggatacataaagagccctcaagtttcagctgtaagaaacaaacaatccaattaaaaaagggcaaaagctatcaacagacatttcaccaaagagggaacacagatgacaaataaacacatgaaaagatgttctacatcattggcttttaggaaaatgcaaattaaaagcacaatgagatatcactacagatcaaaatgtcaaaaatgaaaaataatggtaatgccaaattctagcaagggaggctgaggaacaactagatcacccacacatggttgctgagaatgggaactgcagtagccactctggaaaactggcagttttttaaaacatgccaactgccctatgacccagcagttgcactcttgggcatctatcctagataaatcaaagcttaaaggctcatacaaaaacctctgtgtgaatatttatagcaagcaaggaaaaaaaaacccacaagagaaacctaaggtgaactggagtaagaatatagatgagaatatataatattttatattctgatgaaatatagtgttaggatatataaaaaggattgtgttgatacctctaagagttagtcctggaaaacagaacaaagcaaagcaaacaaaagagccaataaaacatctacttctaattatatatttaatcatatatatagatcatatatatatcacgcatatatttatgtaacatatacaatgaatatatatagcaaatatatatatgaacaacatgcaagttagaagtgagaaaggacttataaatccagagatagaaaaattataagacgagatgtgctattacaatggtgttcagactggtactctcggatttatgtcgtagcttttccactactgttttctgaccttgggtgattatttactctctcagtctcaatctcctccactataaaacagggataataacgcagtagttgtatggatttggttaaataatgcatgcaaatagctcaacccagtgttggatgcctcatagaactaggatgatagctgtttttcaatttttggtattaagtttgaaagtccaagaagacagaaatgctcaaattgtctaccataaaagatagactgcctagattaggggttggcaaatgttttcttacaggactagatagtaaatattttaggtttatggggcatctgagcaactactcaatgctactattgtagcatgaaggcagccgtggacaatttataaagaagtgagcatggctgtgttccaataaatctttatcaaaacaggtggcaggcctgcaggctgtagtttactggcctctagtctaaaccaataacaagaaggaagtaatgaaagttttcaaaatcctcaccaaaacctatataacaaatgatccttttggtttttaaaacatttctctagaccatagggaaaaaggacactgtctcacttctctcctcttaccctagcatcatacatacacaaaaatctaacaaagataaggcaaaaaataaagccatggtctaatttcacttataaacacagagaaaacagtcctaaataaaatcttggcaagttgaatcctctaggatattaaaagaacaatgcatcatgatcaaggaagcttcattctagaaatacattatgatttattattaggaagtctattaatacgtcccatcaatatgtcaaaggaaaaatatgatcatagatgcaaaaaaaagcatttgttaaaatttcaatatttgttcttggtgaaaattcttggagaaaggactaagaacaaaaagatactttttcagcatgatgaagactatatgtggccaaccagtagccaaaaatatacttaattttgagatacttaaggaattcccattaaagttaagaataaatgaaagatggttgatagcaacactgttatttgtcattgttttggatgttctagtcaatgaaacaagaaaagaaacatataaatactaattacatattggaaaaatgaataccaaattaacactattcacaggttatattatttattttagcaactctaaaggaatccattgaaaaactattagtacaaataacagaattagttaagagggctgattacaaaacatgtcaaccaaaatcaataactttcttagagagcatctctaacttggtggatgacataatggaaaaataatcccttttggtctccagatgccaccagctcccttttcctcctccgcatgcttggcagaaggccagaggaagtactgtagtcctctactacagagggaagtgtaggaaactggaatattaaccatggattggcaatctgtgtgtctaaaggaaagtggtttacattttcttttaaacgtcacacttggcatgccagatccccatggcgttggagcataccaaagtgatagagcgtgggcataatatgtttcaggcaaaatgtttagcatttgcacagttaggttctcaccaatggtgtgttccttccatagacatgtgagcctggagcttggagcattggagtttgagaaatggcttgatgagggcattgagaagcactagaaaggatatggatagcaactcgattcaaattttatttttgtctacttttctaagtttgtttacttcaagcacttaaactccacttctttgagcctttgttgccttgcctacatactgaggataattaaacctttctcctagggtcttgtagcagtaaatatgattggatgaaaaatacgaaagcatgtcaacaactgcttgttaaaagttagttacctttctgcttccttcttatgcttgactagctcccttgactctttgaaaacatcagaaagcctagccttaaactcctttttggaaactaagcattgggtcccagagcctgaggtttcttaacgtctgcccctagtctggttcagcttctgcctgtttctcaactttgctctcatttcaggaaaggagacaaatgaattattcacgattattgtctcttgaggggcagtgactgtctcttctatcttgttcttccactcccctccggagcatccagagcaactctagaaataggagtgtagaaataaaacccaggaaagagggactttagaaacaagaggcaatgccatggacaggggtggcagaactgttgcccttccagtctttgctctgccatccaccagacttgttgcatgggaaactcagtcaaactctgaagcttcggagtgttctccactataaaaggagaaaaatgatcatctaccttagggtggtgttgtaaaggtcacatatgtgtggccaggcacagtggcttatgcctgtaatcctagtgctttgggaggctgagatgggaagatcacttgaggtcaggagttcaagaccaacgtggacaacatagcaagaccccatctctacaaaaaaagttaaacaatactaaccaggctagttgacatacacctgcagtcccagctacttgggaggctgaggcgggaggatcactggagcccaggaggtggaggttgcagtgagccatgattgtgccactgcatttcagcctgggtgatagagtgagactctctctctctctctttttaaagatacatgtgtgaatgtgtcttatttaactatgttacacatacatataaatataaattctgtttattaatagctcatataatatacagactctgcgcctgtacaaatgtaaaggcaatgcattttacgtaggaaaaatggttgagtcgaatgatttaatttttttacaaatcacacaatacttgcatgaaatagcaacaggtgcgaacctcctaggcagataggagtgcagtgctttgtttcacagataccatcaagcctaacctttattgtgggcttactatgtgtcaggcctgttctaggatcttgttaatgaactgattcatttttttctcataacaacatagaggggaaaagatcacatggggaaggcaccaggtccctggactttgcctcgcgtgctcctggcattttgtagagaggtaaggacttggttccttatggacttttaagctcatgattggtttggtctggtttcaattctcatcttcatgtatgctcttagaaataatctcattttaggagagaaattcagagtcaacacggaaactgaaaagctctagtactgcctgaagtctcagaataaagggtgccttcattttcacttttccaaataatctatgagagggacttttagtagatccgtaagatgtgatactaacatagtatctgcatattgtgaaaaatttataactgtatccataaaggttatttgactccattgcctcaaagtctatataattagaattccatgatgtcatctttgagctttaatatagcttaaaattatccttctgtaggttgtgtttctttctgaaacattttaaatttagaaaattaacttgttaaacttttttaagttaaatctttagatttttttttattcaccctgctgtgggggagtcagaatgacaaatgcttgaatcatcaaagtcaaatgttagggcattttagcccctctgggaaagctaaggtctccatggcccaagaatctaactctacttatggggatgatgatctcacatgatctcatgatctctgtgttttgccaacattccttcttggcaggacttaggagtgcagatgggccccagagagcatgccttgctcaagccaggtccccctcctgctgccactttgggtggctggaaaaacctcacaaagggtgcagtgtctgcggttgggagactggtctcaattttcctccatcacctgctcataaactctcatgggtttctgggtcacagtgcagccctaggtcaatcttccaaaagctgatttgctgaatttcatgtgaattgactagcttcatgtcagcattttagggaacatttgattggtcttcatgcctgctttctgcctttgcaggctgagaaacaatgaggggagagaatgagggacagagagaggaggggactgaggggccaaggaggttccgatgagcaaaaatggaagagaaagaacgtcagagaggaggctattgggggatgaggagagagaccagagatcaagaagcatgaaggtattgagggccagagaggggacttctagggacatggagaggctgcaggacagagaaagggctaggggaacgggacagtggttctttcatttcaatgatcaaagttcccagctttttgacaccacaggggcaccctgacaattctggcaataagaacatgaaaggcctggtctttatttcactcaattcctgctatgtgtggtgagtgtgggtgagccaaggggaaggtgatcctattgtcaggaggtaatttaccatgaataggggatgatatggaaataatgtgtgtgatccttcccctgccactgttgggatgtctttttaatttccttccctcatttgtcacagccgtgaaaatactttttctgatatgatgaatgacagatggcagggtgccggcagcccttctggagggatgggaggttgtgtgtgtccacgataggggcccaataagtactggctgaatgagaaaatgaggagcctcactgtgggctttctttggggtgaatggaggtgctgagtgacctctcagcttcctagaagtcacaggccagaagccgtggaatctcagtggtggaaagtcctactgatttgaggatcagggagggagagaatcagcaatggtgtgctgataaatgtttagtagttggctctctggtaaaaaagaaaaagaaaaagaaaaagaaaacaaaaacaaaacaaaacaaaaaaaacaaacaatgaacaaccctggtatgcagtgcttgccactggtcagtttccatggtcagtttctcaccatgggcaatttcatgtgccatcactgaacacagagtagggaagagatccacgccattggctcacaagctggccctaccacaccaccaggaggaatatatattgggcaacgactaatagcaatagaaaaactcatgcttctttctcctggcatgacttcatgtatatgacatacatcctctcattttatgcttgtagcaactctgaaacctaagatttatttcctcattgcaggtggggaagccaaagctcagaggggttaaataatgtttctgttattgtacagcaaatcagtggcagagtggattctaagattcgtgccttctctactcacttcactgggctgtcagaggttaagggaagagttacataagccacctctgattattagagaatgacagggctggctaattctgcctggatagtattgaagaggagcttcattcaggggcaccgctttgctaaagagaccacccaaagaatgagtagttttgagtcaccaggtaccctgaagtggtacctgaaggtacagctggtatgatggatgacagatgccggtaccttgctgtcatccatcatatcagttgtcagttaccaggtagacctagcggtaaagggtaagttatatctcttgcctaaatgtcagtttcctcatctgtaaaatgggaccctgaaagtctactttagagggctatagggttgttaagatttaatgagttaagtccataaagaacctaacgtagtgtcagacacataatagatccagagaaatgctgattcttagcaggctaactttttctttttgaattcctctttaggccagaactgactagtataggcttttcaaactttagcgtgcagaagaatcacctgtggatctaattaagatgcaggttgtgatccagtaggtctggggaggggccgggcctggaatcctacatttctaacaagctgccagatggtgctgattctgctagtccatagatcacacgttttctttcattctttctttgtctttgtcttttttttttttgagacagggtcttgtgccgtcatccaggctgaagtgcagtggtgtgatctcagctcactgcaacctccaccttctaggcttaagcgattctcttgccttagcctcccaagtagctgggattacaggcatatgcaaccactgctggctaatttttgtatttttagtagagacggggttttaccatgttggccaggctggtctcgaacttctgatctcaaacgatccacctgccttggcctcccaaagcgctggcattacaggcgtgagccaccatgcccagcccatggatcacactttgagtagcaaggggctaagggatcctgacatagcattttggggtcctgcagcttcaacttactctgctgcctgttcccatgacctctaagactgctcttctcgagacagcatccttgttctgcactggttcctttggagcagctgctcagccctgctaaaggcatcttgctcagtgcaatattagtttgctgcggaagatctgggacctgggctcctctcctcattctccttgatcttagttttggttctgccaggactttgctgggcaatctttgtcatgtcctttcccctttttagattcaatttcttgatttgcaaaacaagacagtaggagagagtcactttctagtttaggcattctgaagttctgtgaatctgtgataccagctggttggtgcattttcctgccaggccataagcagtacttgcctttatttctgggctccagtgggggtcttcagagatacatagatgcatatagtcaggacaagagttaggaggagtaaaggtaagggttcaatccaaaccttttggaatagtaacagggtggcccagagagatgaagaatgattggggcacaggaatcttcttgctttggggcctaaacgacatctccagggaatggctactcattgggcacatatgagccaggcactgtgccaagagctaatgggagacacttgtcattctttctggccacacactctggagccgctttttttttttttttttttaatatttgtgaattcgccacctcataaacccatgtctctttaatgcacaactcagaaacccactcgcccaacctcccttgcagctagagcacagacatgtgacctaggatctgtcaatcaggtgagtccttgctggactctgaattggtggctagaagcagcagacactgtgtttgatctgttctggagggggaggtgttaagtatgtccagactgcagagtcagctatggtggggcttctagcaagatctgtcccttgtgaatgttgaatattcacagcatctgtagtgcagattgcctggtctggactctggagtggtggcagcgggttctgtactgtggtcaagatgtttcttctggctttctaaatgtgtcctaattggattctcagggcctcccaaagcttgtctttcctggttaaactggttagagtgggcttccatgtttataaataagaatcttgactgcttacaacactttatgtgtgttatctcattgaattctttttttaatttttgagatggagtcttgctctgttgcccaggctggagtgcagtggtgcgatcttggctcactgcaacctccacctccagggttcaagcgagtctcatgccgcagcctcccaggtagctgggattacaggcacacagcaccatgcctggctaatttttgtatttttagtagagactaataaggttcaccatgttggccaggctggtctcaaactcctgacctcaagtgatccacctgccttggcctcccaaagtgctgggattacaggtgtgagccaccgtgcctggccctccttgaattctcacagtaacctagtgaggtaggtgttattatcctcttcttgtaactgaagaaactgagtcaagaagagatgaactaacttgctcaaggttccactgtcgataagtggaggcccaggatttgagtccagatcctctggttccaaagcacacattcttaaccaccatgcatctcctgtcagagatttgtgggtgtggaaaggtccttgcaaatcacttgtcagtagtacagggtttcatgagatctacacctgggctgggcacgcctgttggttttttactgacaacgcataatttttcgaggagtggtaatcagaggcaaccgttctagtgacagtgattcaggcgtaaacacttggctttggcccagaggttgcactgtgtgagaccacaggtgaacactagaatgtttacactcttccggagtctgtaggtggatgccagggacagagaatgagattgtaacccagagaaagaaagaaaagaaagaacgaacaaacaaaagaaagaaagaacgaacgaatggacaaaagaaagaacgaatgaaagaaagggccagcccctggggcctccttagataaggaagagaaaggagaccttgcctcaagctcagaaactggttaaaacacgagcccagtcacctagtgataagcagtgcttggttctattaactctgacaacatagtactatcttgggcagagctctttggagaagcaggttggctaactggccaacctcagttgattctcatggtcttggaactttcctgggggtccaacttcctccgttctgcccctcttttttctctaccttctatcgttttattctttgtctcctttatttttcttcaacaaatatttttgagcacctattgttaacaattcaaccaatatttattgggtgtttgctcggtgccacttacagttctaagtgctggagatacagcagtgaactagccagacaagctgtcatagagtttccaatttagtggcagtggggtagtccagtaggcatgaagccaggcaggtaccagttgttgaggtggtggtagttccacccagtactaggaagataacattcttatccccattttacagatgaagacactgaggcaagagagcttaaattaattgcctgaggtctcacaggtaggctgggatctctgtgagatctaggagtgccagagccacttgggtccagccacccacacctcttccctgtgcctcaggctgggatgacacccagagcctctcctttctccctcacctgggcccagagaccacctccttccctctccttgcattgctgctgcccatgctaaccgaaggagcctcgccgtggggcggatgtggcctccccagtggcccacttcctcctgcttctgccaacagcagcattggcccctatgatttgaattttttttttttttttttttttttttctgttgatccctctagcggcaccagatgtgggtggggtggagggtgggtacacccacactcccttaagcctggaagtaacctaggttccagactctgtgtgtccctgaatggtaatagtgactctcttcttagctgtctgtcccactgggtcctcccactccccaactggtgctcctgcttttcctcagaatgggggacataaatctccttctagtcccaacccattgtcaggcagggcttcctcctggagggctgacttcccaggactgggccagctaaaagctaagcagtatgggtaagagcacggggttctggagtcagacagacctaagttcaaaccccagtactgccgtggacaagctgtgtggcctcagacaagttgattaacctctctgagttccttttaaaataggctgaggtctgtagggataaggtacctgaggtcttagtgcctggcacagagtaaacccacgtgttggctgtttccattattgggtagaacagaggggcctcctggcatcagtgggcattttgggcctgctgctgtcttgtctatctaggccttggttttgcctttcaggctggtgcctctttgcagtttcactttagcaagtgaaactttatttttcctgtttctcctgatctgtttcctccttattttccatagtgaataatcacacataagcctttcttttctcagggcaaggttgctgtctgtgaaggagtggaatgcctgagcatccctggtaggaaaggaagagtgaccagcatcaatggggtactctattccctgagtagcaagccctcttcccgccttgtccctggctcccacacctgttatcctgccggcagtcatctccagtatcccagaggagccatagggatgggtgtttgaatataagaacactctgcagctcagatatgcggcattacttttcctgtttgactcagttctgcagagggttgctgagtgactgtcatgtgcaaagcacgtgggaggaaagatgaataatgagagcaatcgaatgcccattcccttgcatccagggtgctctactagacctgcgttcttccatcattctttcagcccacgtggttgccaatactgggagttatcagtcttttccatttttgccaatctaatggataaaatatcttgtattaatttgcatttcccagatattcatgagattaggcatacgctttttgggcacttgtatttttttctctgggaattccctcttcgtattactttgtcaatttttctagtggcttttttatttgagacagggtcttcctctgtcacccaggctggggtacagtgtccagatcacagctcactgtaacctcaactccagtgatcttcccaccttagcctccctagtaaatgggactacaggcacacaccactatgccaggctttttttttttttttttttgtagagacagggttttgccatgttgcccaggctggtcttaaactcctgggatcaactcatcctcccaacttagcctcccaaggtgctgagattacaggcatgagccactgcacctggtcccctgtctttttttttttaattaattgatagtaactctttatatattctagatgccaatccgtgatttagtctaaaaataaatccccttggtctgtcctatgtcttttcttttggtttatgaaatcttttgtaatacaggaacgtcacacttccacagtcaaatgtgtcagtcttctaaatagatataggtaccttgtatatactccttgatatatcacattgattggtggtgacctgtttgtctccctggctgtcagactgtgagaaacttgagggcaggggctgtactttattcttctctgtctctctagggactagtgcaaagctgggcacagagttttgtgcctgaatgagttttttttgtgtgtaaacgtggtataaaacaggtcttgtgactgaatgagggaatgaatgaaaaagccctgtcctgccctccctgcagagatggggtctgctgcagagatgggagtgagtcagggagtgaatcacaagctcttccgtggctcagctgacatttcaaaagccctgagcagagaagcccccctcattccaagagagcctccgcctctttgagcaggcacagtgaagctctgctgattatcaaactctgtgtgtgtatgtgcacgcacgtcaggggtttagcagttaaaactcttagtgctgcatattctgcgtatgtgtgaacaaggctttaaaaaatctctcagaggacctgtgtatgtgtgtgggtgctgggggctgcatagagagagagttaaaagagatgagggggtgtttagaatcgttgcaatgtattgcatttgtttctgggagggtggggcgactggagggggttaaatagctcccagaggcgctcttgtgagcggagcttcctgaaatctctttatctgtggccacatgctgttcttggttgtccacgtggttccctggtgtccctgttgctgaaggcacttctgttttgttcttggaggcttggcttctcattgccattttctaaagcagtagagagtgccagttagattgttagacccaaataatctgaaatgtgtgaaaaaatagtaaatatttactgtaccttttgtggaacaggttattgccatggaaatgcactgtacacgaatctggatgatggagggaagctggctcaggagctatgggagtgtttggataccatgccgcctgaattggcaggtttaggagtgagtgccgtgggtttagaatcacagtgtggttgggtgaggctgaaacacttggtccccagtcaacctgtactgagaggggcatttattcattgcttcccacatgcagggtgcttcctagagcattctccatgcattattgcgtttaatcatcatgccaccccaatgaggtgccattatcctccctgttttacggagacacagagtgtttgatctacttgcttgaaggtacgcagtcaatgaatggcagagccccctgactctgttctctggagcttgatccttccctgctcagctgtttctctcactgtgatttaccctagagaaagctaaccagctgtctaccggggttttattttccaatattgacttcggggctgacatttagaaaccatcaacaatttccagcttctcttgaaaatgtgcacaatctggctactgtgtggggcttccctagtggctgctcccgagcagccatccaggttagccgggcatcagctctgcagttggcgctgggcatcctcctgttgcagctggggagaaagcatggggtatcacacccaggggctccttgaattaattgagaactgtctgttgagagctcctcatcctgttagacttgacatttaatttagctgttgttttcatttgccaattagagcttttgagattcttttgattttcttcctgtggtctcaaggaatttgtgggtggttgagtgaagatcttcatggcaggaaaggaaggctgcaacaggagatgtaatgcgtgagcacattcattcattcattcattcatttacttgtttattcatttgttcaacatattcattgagtattggatgttgaagttacaacagtggaagtatggcaataaataagacagacccagtcactgctctcaaggagcatatagtcaaagagggcagtcagacatcaactatgatgcacgttacagggaaggcatccatcttttttttttttctgtgtcacccaggctggaatgcagtgatgtgatctcagctcactgcaacctctgcctcccgggttcaagcgattctcctgcctcagccttccaagtagctgagattacaggcacccaccaccatgcccggctaatttttttttaaattttattattattatattttaagttttagggtacatgtgcacaatgtgcaggtttgttacatatgtatacatgtgccatgtagtagagacggggtttcatcatgttgaccaggctggtcttgaactcctgacctcaggtgatctgcccaccttggcctctcaaagtgctgggattacaggcatgagacaccacgcctgaccagggaaggcatcgatcttagactgacttagtggtgtctaggtctctgaaggaggtgtcagagaaggtctccttggctaatctttgtgaccaccggagctctgttagtttcataagacataagtctcagcaactgttgcagaaagacccttcctcagtaaggatgatgggctcctcgggctcttgcccttcccgtcctgggaggaaccttctatcaagagccatggctagtcatttcatccattgggaatgagcttactggctccatttatgagagttagtttagactgaggagtaaaggaggagtgaaggagtttgggagttgtcagtgataagcatgcacatttggagttgacaggacagcatggacactagagcctgaacaccttagttcagcttagctgcactgcctattatgtgatactgggctggtttcttaactgttctatgcctcagtttccccatctgaagttgggaataaaatactcatctcatagggttattgtgaagagtaaatgagtcaagctgggtgtagcggctcatgcctgtaatcccagcactttggaaggccgaagtgggtggatggcttgaggtcaggagtttgagaacagtctggacaacacgatgaaaccctgtctctactaaaactacagaacattagctgggattacacatatgcaggtgtgtaatcccatgaaacacatttcaaataattgctaaaatttttcaagctgtggcataagagacaacagtcctgaagaggactgaaaggtcttgggatgcaggggagcttaatgtattaaaaggtgacattttggatcagtagggaaaaaattacacacaggtgtgtgtgtaatcccagctacttgggaggttgaggcacgacaatcacttgaatctgggaggtggaggttgtagtgagccaagatggcaccactgcactccagcctgggcgagcgagactgtctcaaacacacacacatgcacacacacacacacacacacagccaggcaaaggatgaagagaagcagttaataaatgtgagccattcacgtgtgtattatgattatcacgtgatatcagccagtcctgcttgagactcacttttccgacagttctttcttcggtggactgtacccatgcccctgtgtgccatatatttgtgatttccagccttcctttctgataacttcaattcattgctcttcccaggcaagtccttcaatggttatggggtgccgcgcttgccctcatccccagctgagtgttctgcgtttggggacttgtgtttataagtgtgggaggctgtcccctgggggttactgcccagacagttagggttgtccataataacagaaaagtgcatggagagagaaggtgcaggtccgcctatttgatgttgggtaggatgtgctgcttgatgaccggtgaaacatttacttctcccaccatgggcgagaccttggatgtgtcctttacctctctctttgtcacttctgtcctgaactgcccatgagtgaccaggggcttccgacagaagtgtctcacaatccaaccacacagcagaaaggcattttcctttggatttgagctttgtccctgcactgactttttgtgtcatctcctcttcattcaatgtgagatactcaccttgattcatagaatgttttctcattccaggtttgtatttttttaatcaccaaaagaagcacttatcataaaagactgtgatgatgtataactgtgtatttagtttgaaaatcttcaccttatagaagcaataaacaatatttaggtgtattatcctgtgaaatttttataaatataagactttattacgaataaacaaaaaaagagatcatatcctatatactttttttataattttttttgagagagggccttgctgtgtcatctaggctgaagtgcagtggtgtgatctcagctcactgcaacctccacctccagggctcaatcctcccacctcagactctcaagtagctgggactacaggcacgcgccaccacgtccagctaatttttgtaatattttttttttgtagagatggggttttgccctgttgcccaggctagtaactttttcccttattaataccttatttagatccaccttatgttttaaatggctgcagagtgtttcataatatggccaccatattatttacattcatatttataatttgtctaaaacattagcaataggcatttggattatttccaagttttctctataatgaacagtgcaacagtgaacactcttgggcactgtagtggggatttccatagaacaattcttagaaatggggtgtttagggcaaaggatattaacatttttagttgtaatagatattgctaaattgctctcaaatgttgtgccaatttatgcacccaccaacagcgcacgaaagtgcctcttagaaaatgtcttttagaagataaaatacctattgttaagccatgaaacacatttcaaataattgctaaaatttttctagctgtggcataagagacaagagtcctgaggaggactgaaaggtcttgggatgcaggggagcttaatgtattaaaaggtgacattttggatcagtaggaaaaaaaatggcttatttaatacatggtgctggcataattgggaggccatgtggaaggatgctgagtttgattcctaactcatacaaaaataaattacaggtggagtaagctataggcagtaaaaaaaaaaaaaaaaaaaaaaaaaaagaatattagaggaagttttaggagcatacttctgtaaccttgagtgagggaaatccagaagccataaagaaaaagattagacagtttcaattatgtaaaaataatttaatcttttaaaaggagaatgtattcatgaattgcttatgtaataagaaagactattaaaaataggtccagtagataatgtacaatggtttccaatgtgaataaagttgaagttaataaagaaaagaaagttttaggacatgtcagggagtttttgttcaaggattgagattctgcaatgtttattctaaataaagatgaatgatagactagtgcacatgtagtaaactagtaaatgtgtagcccataaaccttgtaagccctggaagggtaaagaaaaagggaaggaaatgttgttttctgcctctttattttttgttgttttgagaaagttgagtacccacccaaagccccaggtgtcccaggagagagaagattgaaaacatgccatcaaaacaggagcttcagcctcagccacaagctccagtgtttactgggggccagtgcccttattcccacgtgaagcatctgccttttttgcccccttgaagtctgagtctctcgtctgttcctggagatttttagccaagcccctcctccccacccctcaccttagtatttgtaccaccctctgaatcaaccccaaagacacccctttgtactcttcccttcatctggccatcaccagggtactgtggtcattgaagctgagtgtgtgccctcactttccgtaaactcacagttcctttattctgcaccttcagggattgcaaatcgttaagggtatgccttcaaataccagccctctgacttcctagctcaataacctcacacagctctatatctcagtttcctcatctgaaaaacagtcatgaaatggcaccacctcctagcattaatgtgaagattgttattattatgtgttattaattattattatgttatcctattaatatatgagacagaatctcactctgttgcccaggctggagtgcagtggcacaatcttggctcactgcaacctctgcttcccaagttcaagggattctcctgcctcagcctcctgagtagctgggattacaggtgtgtgccaccacgcctggctaatttttgtatttttagtagagacagggtttcgccatgttggccagggtggtcttgaactcctgatctcaggtgatctgcccaccttggcctcccaaagtactgggattacaagtgtgagccactgcgcctggcctatcttattattattattattattactttttgagatgggatctcactctgtcacccaggtgggagtgcagcagtgcaatctcagctcactgcaatgtctgcctcctgggttcaagcgattcttctgcctcagcctcctgagtagctgggaccacaggcacccaccaccatgcccggctaatttttgcatttttagtagagatggggtgtcaccatattggccaggctgatctcgaactcctgacctcgtgatccacccacctcggcctcccaatgtgctgggattacaggtgtgagccactgcgcccagcctctttttattattatacttagcacggcacttggcacttaggaaatgttcagtatatgttagctattattggctactgttatttcttcttcttctcctcctcctcttcttctttctcctcttattcctcctcctcccccactcccttccaccccctcttcttattcctcctccttctcctcattattattttaagtacctccttaccaatgcctacagaaatagactgacctagtaccaggatctagaggagttcaatcaagttcgtctgttgccttcaaggtaacagcgtagtggtggttccgagccagatgccagacccagtctgcctttgttcaaatcctggttttacacttaatactgtaggtacctcgggcaagttacctaacatttcttcacctcaatttctccatttgtaaaatgtatataatgatagtacctaccacgcatggttgttaggaagattaaatcaattaatatttgtaaagtagagcagccggctcattgtaagtattgggagtattggttaaaataattacaaaataaacaatctcacttagatacatcccttaccccctgtggattatgtcaagggtgaaagaaacagtgtgcttgaaatcctgctgtgcgccgagctgtatatcagaggtgttatggtgattcgtcatcattctcctgaccactttccatttttcttttagagtcaacactggccaatctttagggaggagctctgatcattgagaaactgacactgtggaagggggcatttctgactctctcttcctagctccatttgatcttcctaaatctttcaataatgtgtcattggggtaggaccaaagaaaaacggggtgaatgtacggttgctgctttgtttcccatagtgggagtgactctgatgtttcacaaaggcaggggtggagaggcagcgcctcgcaggaaagccttcttgctaaatcgaggacttctgcacagaaatagatacaaacttgcttactgtttaaatagaatattagcgattatcttttatccagctggagtctcctcggtttggtactgcctcaaatgagcagcctgcaatcttgggtgtcacttcctcactggttctgctttccataactgtgttgaaatcactcccccagaaggtcaccaaaagggaaaatattagtgtgtgtttattggcacgatcttgcaggtgctgggctaagtgtagacatgatttattttcatttaatcttcaaggtagttctaggcgatgtccccccactttgcagatggggacactgatgtgcaggaaatgaagtgacatgctgtagcactgttggtgctctgctgtgtcccctcacccttccatttcattgcattctggcctggcttccaatgggcagcaactgcagctgttcacctgagggcttgctctgccgtagtccattcggtccataggcatgtcaggctgtggaagcacaggaggagaggtgagggatggtgcaggagagaggagaggatgattaatgtcccccagggcccatcctcaaccaatgacttatgggaaacaacctcctagagttgtattaagctccagtgacccagaatggtaacaagctcacaaacacttccttttttaaaaaatttcacaaaaatactttattatacccatacctccttgttttagcccatcccagtacggtggtatcttcagaacacttccactttcccctctcctcacctcttccctcccacccttgagatgtaatctttggaccacttttacttctttgctttctctcagcaccctttctcccctactctatggtgactttgtgtttttgaattgaagtcgtttcatgtctgtgtcttttttttttcttcaactgttattttaagttctagggtacatgtgcaggatgtgcagatttgttacataggtaaacacgtgccatggtggtttgctgcacagatcgacccatcacctaggtattaagcccagcatccattagctattcttcctgatgctctccctcttccctccccactctgacatggcccagtgtgtgtcattccccaccaccaaatgtccatgtgttctcattattcagcgcccacttataagtgagaacatgcagtaaaacactgcctttataggcttccttcccttcactgtcttacttccccactccctactgctgctctctgggatcacctctcacagaagctgtttgtactttaatcattgtctgagagtctggggtatcccaaactaagataattgcccaaggtcttagctaaattcaacagccctatttgtctttatcctccttgtggcaatgccactactaatggatgtcccttcttaaaattcttccccattttggcttttgtgacacgtaatagaattcttctacttctgattatttctttcctttttcattaattggcagctctttctttttaaaaaaatttgctagatttttgcttatttttttttttaagaaatgaggtctcattatgttgcgcagactggccttggaatcctaggctcaagcgatcctcccatctcgtcctccgaagtgctgggattacaggcgtgagccactgtgcccatctttcttttcctttctttagccacccagttttaggtacctccagtatcccagtattttagttgtaagtgacagaaaatctgactcaaattggtttatgtataacaaaatgtaagttattggatcacatacttgggaatcttaggataggtggcttcagggaagatatgatcaaggtgttcagcaatctgattctctctccatcatgattcagctttcctctgtattgcttgattctcaggcatgtgcttgactaatgaggcaacaacaacttgcaggtccaatcttatcttcatcaatggtatcttaactacatcagtggtataggactgcttctttccttagagtcccactgtaagttttgggtttcattctcattggcctgtgttgagtgatgtatacatttctaaaccaatcacagttgccacggagatgtaatacaggttgagcatctcttatccaaaatgcttgggaccagaagcatttctgagtgtggattttttttttcttcagattttgaactatttgcattttacttgccagttgagcatcccaaatccaaaaagttaaaatccaaaatgctccaatgagcctttccttggagcatcatgtcagtgctcaaaaggttttgggttttggagcatttcacattttgggttcctggatttggggtgccctcatttcccaggctgggtcacataatcacccttggagctaaggttagagttgagccctactccataaggactgagagtggggagaggtgatttcgcaaaggaaagtcaaagtgctgtcacatgaggggatgggtactggagaggcaaaaacaacagatgttcatactccgcatctctgggttcatttatctgctcttctctttctctgtgaatcatctgatgatttccactcctgcctgcctgagtaggactctgaaactcctgcctccagatctgactccacttctgagttgtagcctcctttcccccaccctctagagttaggcatttccatttggtggtgccatgcagacctgaaactcagtgtgccacaaccctcgccacctcccacctggtttcgctccctaacgtccctgtctttgtcagtggtgccagttgggtttccatctctccctcatccgtcccaacccccacctaatttccagccccattgtgctgcttttgattccttgaatgcacctttgcaatgcttttccttggtttgtaaccctctttagcatattcttggtttggtgaacccctggccatatttagatatcagctcagaattcacttatttgggaacctctaacctggtcacccatctctgccaagcctgagttagatgctctttccctgagttctactaggccttcatctcgtctaccacagcacttctcactcagactccaatgactggctccattgcctgccttccccgtaagggcaggggcacatctgtgtaattcaccattgtatcttcagcagtccagcctgacaattgagtctaggctggtgtccaacaaaccagtctttgttttttttttcttttattttaattttgatagttttgggggagcaagtggtttttttggttacatggataagttctttcatggtgatttctgagattttggtgcacccatcactgtaacagtatatgtggtatccaatatgtagtcttttattcttcaccccctcccaccattccccggagtcctcaaagtccattatatcactcttatgcttttgcatcctcatagcttagcttcatttacaagtgagaatatatggtatttggttttccagtcctgagttacttcccttagaacaatggcctccaacttcatccaaggtgctgcaaaggccattatttcgttccgttttatggctgagtagtattccatcatgtatgtgtaccacattttctttatccactagagataaaccaggttttgaattcaggatccacctctcctgagctgtgagcacatgggcaagtttcctcaccagtccaagcctgttttctcatctctaaaatggagacaatgacggttcctccctcactgagcacttgtgagaagtaagtggtgatcacggttacaaagtgttcagcacagtgcctggaacacggtaagcgttcaatcagtgccaatgatcatttattatactcactatgaacattatttttacctcatgcagtgtctagaacataatcaactctcaacaaatgacagctcttattattagccaagaatggaacctgaaacatagtacgctccatggatcattgaagctttgtttttgaaagtttgaaattaacaaaaagagcctttgatgtttcccttgctgcacattcttcccctccaggtggagtgggcagtttccactgggtgctggaaccaaccctcctgtagttggaggtgatcttctctgatgtcactagggtgccgaggtgatgtgtcaccagcacttgtttgcttgtgtgatgtaatgagggtggacttgcttctcctagggaagagcctcattaaggttagcaaggggcttgttcctgggaagttctaaggaccgcctggggctgccacataaggaactccccttttctcattttgtctccggtaagttgttattgatctgtacatgatgtttctctttcttaccagccgtgggaatgggccatcctctggcatcactgttgccttgaacgttaccatcaccaccgttgccatgaagtcatgacagcagcaccattggctctggtttattgggtgtctaccatggacagtagtagggctagacatttagtatactccagggctactgcggggattaaatgaggtatgaagcatctataaccccacggtccaatagggtagccactagccatgtgtgcctactgagatatacattttaattaaagttaaataaagaaaaaattcaatttatcatgcacagtagccacatttcaagtgctcagtatgtgctcatggctgatgtagctggcagtgaagatggggaacattgtcatcatcacagaaaattcttccacagcgctgatctagatagaacaggattcagtccgctgtggcttgtggatccatggactgaattcatacacacagaattttgtgggaacacagctgtgcctgtttgtttatgccttatctatggctgcctttgcgctacaaggatggaattgagtagttgtgacagagaccatgtggcctgcaaaacctaaaatactcagtctcttatccttgaagaaaaagtttgtcagcctctggtctagaacattgcctggctcttggtaaggttaaatacatgtttggaactttttatttattgaaaataatatacattttgttctccacctaaccttttaaggtaagtattgttatccctgtcctagagatgagaaaactgggactggaattctgtactgtcacttccagggggcaaacacctcatgaggttttttttttttttttggcagtcttgctctgtctcccaggctggactgcagtgtcgcgatctcagctcactgcagcctctgcctcctggggttcaagtgattctcctgcttcagcctccccagtagctgggattataggtacctgccccctctccccgctaattcttgtatttttagtagagatagggtttcatcatgttggccaggctggtcttgaattcctgacctcaagtgatccacccgccttggcctcccaaagtgctgggattacaggtgtgagctaccatgcctggtctcatgagtcttgttcatcacttacctccttttgttcttccagcttcagtttcaggttcagggggtacatgtacaggtttgttacatgggtaaattgcatgtccctggagtttggtgtactaatgatttcatcacccaggtagtgagcatagtacctgatagtagtttttgatcctcaccttccaccctcaaggaggtctcagtgtctgttgttcccttctttgtgtcatgagtgcctgatgtttagctcccacttataagtgagaatatgcagcatttggttttctgttcctgtattaactcacttaggatagtggcctccagctgcgtccatgttgcagcaaagagcatggtttcattcttttttatgcctgcatagtattccatggtgtttatataccacattttctttatcccatgcaccgtggatgggcacctccgttgatttcttgtctttgctattgcatcacttactcttgaatctggagcagtgcctagcacataatagacattcaggacatgtttgttgagcaatgaatggatgagttaggaatcaattacatataaatcaataatcaataatcatcaatgatgaatttctatgaacaaatatgaaaattagatcggccgcattgtagagatgaggagacagccctgtagaaggaaagtgcctcatcaaaatgcaacatcgctgtgaaagtgtagacttggagctccagctgaagtcatctgtgtattttctaagctgtcccctctaccatcctgccttctccgggagctgccaaagtgcagcgctgatgcctcctctctctgtcccacagcctgacttttgttcagctcctgcttctcttcttcaccaactgccagcttcagctgctttgtggcaccctggggcttgaagcttcatttctggtgctgtggcaccacaaagctctgccccagtgtcacttgagtccaagtagatcagccaagtttgaatgatctctctcttggccacttcagtctatgaagctggagttgagaccatctgtgattttacacattcgttacagcaaaaccaagagggccatggggtaagagggccattaagctagaggctgagcaaaactctgctcttgaagcaccttctgagatggcttctcatggaacgtctgcgcaaagtggcttcacatccaattaagtcaaagatgcattaaatgaatccagtttgtaactgcttccaaccatgaagtcacagttccatctcttgccctgggaggggcttctttcaggctctgaggactggagccctggagactttattgccttacggtttcctcctctaccatcagatgtttctttttcatgtgttctggcctggatttgaatagactgcctggatttgaatgctgccttcacctctttctggtgtgtaatcttggacaagttaccttctttctcagtgcctcagtttcctcttcagtacaataaggataataataagacctaccacatagctgtagagaggattaaaggagccaatatgtggaaagtatttacaacagtgtactgcatagtagcttttctataagtgattattattattatcccttcgaatctaaaatccctctagtttgtttcagaggagcaaggattgtgtctcgcctgcctttaaatccctttaagttgggtgtctcaagcccaaccatctgcaggagactagaaggggacttacatgagtgaattgaatcaggtgtggatttctgtgaactagagaatgcaaggctgtctgaaaggggaactattccttattcatgcatcacatatacactggtgtgccaagccctgttctgcatctggggacacagcagagaatgaaccgggcaaaattccctgcccccttggagttgatgttgtagtggactaagctctgatgactctgttgctgcatgagaatgtgggcccactgctgacaaaacttctgatttttctgtaagaaaagccggaaacctggatttgtaaaaaccgtgaactctcctagcttaagaattggcagtggtttccatttttttttttttttaaagcacagtacatgctgtgaacccaagagccagtttgcagcccctgccttaagacactcctctaattgctctgggaggaggcctgtctctgccctgcaaatcagcagctggtcggatttcaaggtcgttggtgtggagggcgcctcctccctctcctgcgtggaggttattgtggctttttctgcccacagagcagatgacgctgccaccaggcagtgagttagaatattccttctcttatccttccttttggatggtggccttggctgggttcccagccccctgacagcagaagacaaaaggatggaagcagcttcctcatagtcacccatgggggcgatagggtggtgatggtgatgtggagaaaatgcattgggtcaggacagccacctttgaagccagaaaattaatgatctctgttgcctgaatcttttcaaagtggagaagtaatttaaaagcttgtgtgggaaggattgagaatgggattgagaaaagaagtttaggttgctatcaggaacaattcctaacagcaggaggtttttggagaggcagtggtgaaattccttggaaatttttgtgtggtgtctttttttcttttttctttctttctttcctcttttttgtttttgtttttctttttttgagatagagtctcattctgtcacataggctggagtgcaatggcacaaccccggcccactgcaacctccacctcccaggttcaagagattctcctgcctcagcctcccgagtagctgggactacaggcacccgccaccatgcccagctaatttttgtatgtttagtagagacagggttttgccttgttggccaggttggccttgaactcctgacctcaagtgaggtccacctgccgtggccttccaaagtgtttggattataggcgtgagccactgcgccgggccttttatggtgtctttgaagtgcttgtttaaatttacatgtggttgcctctcagtggggtgcatgctctctggttttccccaagccccaccactccctgttgtgctttacccacttgcctgacttagttatgcttactggcctggcctttgtgggtctttgagtttgtgccttctgctctgaaggaagcatgcttgagatgatggaatctaggttcaaacctacctgccctatctgccctttactgacttgtgtgactgtggacaagttcctccacccctgaggttgtcaggaccctgcaggaaatagaaccattcaggtggctgcaagaagaaagtttcatgaaaggactatttagggagacttgggcaaggttaagattacaaataaggaatgtggaagcacctagggccttgcaacagcaggaggcggttaccgtctgtaaagaggaagaagcaagcggagggaatagtttggagcctattgagagctggggctaagaaggaaggcatcgccagcaggaaccatggtcctggagggatgaaccgcttcccaaatagcagtaccgaggcagggaggaagagggggaagaaacaccccagcttctcttcacctctcccattgcctgttggcctcacccactggctgaacccagctggaaaccagaaggaccagatgatgaattctgtaagggtcagccttttggggctcagctcacagcagaatcagagagaaaaaaatggatctgagaggtgaaacaaggaacaagcagcacgtaactctcagcttccctaccttgaaagtggaggagaatgagataactgaccttggaaggttattgggtggctcatgtactctcgaagggaagggcctggtcaatattaagtactcataaatgctgagattcagtgtgggtttcaaaccgtttctaggagctaaaggtcctgagaaagggcttcagtttcagtatcaagagacattctcaggtgggcagatctcttgaagccaggagttcgagaccagcctgcccatcatggtgagaccccatctctactaaaaatacaaaaattagctggatgtggtggtgggtgcctgtaatccaagctactcaggaggctgaggcaagtgaattgcttgaacctgggaggcggaggttgcagtgagctgagatcgcgccactgcactccagcctgggcgacagggtgagaccctgtctcaaaaaccaaaaccaaaaagacattctcctccttcccctgcagtggggcccactgggaatggttgcatcttccatggggagtttaaagtgaatgtgtagtggctaagagcaaagaccctagaaccaagtaggtggacactgtggtagtccatcagtgtggtagacactgatctttctgttactatagattaatggccttgtacagtatgcactattttgtgtctgccttctttcacttaaaataatgtttttgagactcacgcatgcatgtgcctgtattggagtctattgagagctggtttccagtcctgattgccactgacagtcaagttacttaacttttcatgccttattttctcatctgtaaaatgaggatgttagtagtttctacctcattgggttctgaggattaaaatgagttaatctacgtaaagagcttaacacagtgtctaacacatagtagacaatcaatagatgttagctattgtaattgccatcatcgtcatcatcatcatcattatcatcatcatcgtcaccatctccatggatcagctcaaatcaaaactgacccattgtcaatagaaaaattctctgtgggatgaagtccatgccaccaggcctctcgggaacttcattgatcataccattatcttctcatcctcccacagatatgatatttcagggagtgattgataggtgtgtgtgtgtgtacgtggggaagggtgggcttgtgcctgactccagggacagagtgctttgttatgcagaatagcttgcctgtcatcccactacaggccccttccttgaaaagttccaggctatttttgagccctcatggctcacatgttcctttctacatcatgtcaatgccagtacagaaaaattgaaaccttttggcagcatctaaagcaaaagagatttcaaagtgcatggaggatgagtgttgctcaaatgacagggtattaaaacgtgacaagaaggctgagttaagagactgcaggcagcttgtgtgtttgtatttggaccttgctggatttcttgggaaatcagtggagttgtccaaggttaatgtcatctccaagaaggcaccaaagggtagtaacactccttcaccctcatttgtacatacactctgcaagagcggaagatgatgcagccagtggagtgggcggttgtcccagagcaccacctgggctctgagctacaggattctgcaggggaaagcacctgaggacagagtgaggtgggttggtgccacctgggagctccaggcttttgtgtgctgatgtgcaggcagatactggagccagaccgaattgtgtgcgaaatgtgggtctaagagtgaaggcaccaaaccctcactttttttactttcattcagccttcccatttttcttcaaagggcagaatatgactttggagtcaggtagacctgaattcaaatccctcttcttcttcagtgagtagctaaatctttccaatgctttatttaaaaggaatcacgatcacactttcagggttgttgagaggtttagagattgtggtgttacagggcccctggggctcaaaaggtgtttgctgaacccctgtcttgtgttaaatagtcacaatagtcccaaggggaggatgaacaggtagcactgccatttcataaacaggtgactgaggtgcagagtggcttatccataatgacacaggaggtgaatgctggagctggattgaaggctgagtcattggactctcctctgagggaggcagtacagagtagtggtcagggcttgaccaacctctagagtccatgggcagattttctgggcctctggcttagttttcctcatgcataaatggaatgtggggattatagtagatgtactttctatggttgtgaaggttacatatacatgagataattctataaattcttagcatgtgcttgagttacagtaaatatgcaatgaagtattcactactgttttagtattatttttattagaagccgtggcagtagttaccatcattgtcaccatctccatcgatcagctctaatcaaaactgacccattgtcaacagaaaaattccctgtggatgaagtacatgttgtaggtgtagcgggcaatcgtgatcgccatcagaaattcatattggggtttggtttacaagtgttggcctctgggagtgtttcctacgtgctccttctctcctcccctttgaggacggatggtgtgatggttcctctccatttggtccctcctctgggaccagcattctcctgccttctttgtcctactctgtgtcccaggaggtagacccctgtggactgtatctcctggactcccttgctggttgacttttgtctgagttaagccaaagggaggtggcagcaagagacgagaaggtgggaggagagagagtttggggtatttccacctgcagctccctctgtccatctctggccccgctctgtgatgctagcccccgcgaggttgcccatctctcagggtttcctctcttacttgcccctgttacgtcatttcatgggactatacctttagctttaggtgcagaacagttttccacagttaaatgtctttaattgaacatctagaatgcaaaacatattataagataatgtgttggattgttttcctttaaaaaatggtacaaccactttgcaaaacaatggcagtttcttattaagttaaacatagagttacagtatgatacagcaattccactcctaggtatttatccaagaggaattaaattgtatgcccacacaaaaaatgaatgaataaattaagacttataaatgaatgttcatagcagctttattcataataaccagatactgttaaaaaaaccccagaatattgatcagtagatgaatggataagcaaactttagaataatcatataatggaatattattcagcagtaaagatgaactaactgctaatacagacacgtgcatgcgcgagtctcaaaaacattattttaagtgaaagaaggcagacacaaaatagtgcatactgtacgaggccattaatctatatagtaacagaaagtggatcagtgtctaccacaggctgggggtgtgtacagggaaactttttaggtggtgcccatgctctgtatctcaattttggtggtacatgcgtataatacatttgtattgtcttgtatcaaagtatgcctcatgaagttcaggtatatgaaaatttgtatttgctttattatatttaaatatcagagaatgcaaaattgtaaaaagaaaaagaaatcctgaaagtccttttaactagagacaaccaccaccatccacattttatctatttcctttcagtttttaattttttcctgtacttaggttttccccttcactgtcttatttaaataaaaaagaaagcaaatggaaagtctcccatacgaaggcctttttgctatgagtttaccttgtctaagggcatctagcatgatggtgagaaggttttgtcttgtataactaaaatgtattgggaggaaatgaaaatgtttagcctggtgaaggggaaacattggggagaaaagtgagggagagtgtggtctacagtcgtgagctttaaatcacaaccaatcagccaattaaatactgagctcctgttatgtgtcagtattaggaagacagtagtgaacaaaacatatggctcctctgatttaatggagttaacagtctgggagggaaagatatttttattatttgcaacaacaatagtaatagctaatatttatgatgagctagtgcctattatggtgttaaggtttagttttttcttttagtgtttttaatgtgttgtcacatttaatcccagcaactccatgagtaggtactcttaattctcatttcatggttgaaaataataaagtggcttggagatgttaagtcaaatggggtcatacagtgagcatgttaaacctagactggcaggtcaggacggaagtgatatttaatcctcagtgaaatgatttttttctttttaatttttatttttattgagacagaatctcactctgttgcccaggctggagtgcagtggcacaatcttggctcactgcaaccttcacctcccgggttcaagcaattctcctgcatcagcctcccaagtagctgggattacaagcacccgccaccacgcccggctaatttttgtatttttagtagagatggggatttcaccatgttagccaggctggtttctaactcctgacctcaggtgattcacctgcctcggcctctcaaagtgctgggattacaggcgtgagccaccgggcccggcctctttcagtgtttttaatgtgttgtcacatttaatcccagcaactctatgagtaggtactctttttattcctactttatggttgaaaataacaaagtgacttggagacattaagtcaaatgggaacatacagtgagcatgttaaacctagattggcacgtcaggacagaagtgatatttaatccccaagaaaataatatattttttttctttttttgagacagggtctcactctgttgcccaggctggagtgcattggcatgatcacggctcactgcagcctcgacctcctgggctcaagtgatcctcccaccccagctacctgggtacaggcatgcaccaccttgccccgctactgttttgtgtttttgcagagatagggttttgctgtgttgcccaggctggtctcaaacacctgggctcaagcaattcacctttcttggcctcccaaagtgctgggattacaggcgtaaggcactctgaccagctggaaatgatatttaatctgatatctgaaggatgataggagttaaacaagaatcaagtgtcagagaccagagatatgaggtctcatatatatatatttgctcagggcagggggctggttttgggtgataattaggggctagactgaacagaattagtgtttggaagtgagtggtggtggtggtgagggaggagagaagggtgagtcccagggtaagggatgcaggcacatcctgagaaatgaggcagaagaatgagaacttggcttggggcatgttctgttcatctgaatggtggtgctgaggagacaggtggacagagaggtgtggggttcagggaggagcacaggactgagagggaccagcaggaatagaattcctgaagtcccttggattgacaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgcgcagttgaagaactctaatgtcagagctgtccttaggaggcagagaacccctcgtcctggaagagtgcagggagctgcttggtgaccatcctttggggatgtcatggaaaagatatttgcatcaatctggggtgagattaggtgtctggattggttcaggttcttttgtcatttgtaagcacacaaaagaactctagttatctaaaggaaaaaaaaaactggaaatattatgggttggcacacgagtggtgccaggcctcagagagtacagggcccagggtggctctggggatctgggtggcaggagcgaatggatgaccttcacagggtgacaccatcgggaggaatcagctccagctgttttctgtccttgtcccaagaatcaaatcccagggagaacagtgtgattccccaatgttgtgaggttcagtcatgtgcaaggggaaagccgggcacctcgattgacagccccaccaggactgcataccgtggagaaaggatggcttcccaaagaaaaacaacattccagctaccagagaaaagggagtggacgctgggcaggcaaagccaacagacactttttgtagtctccatggtcctgtgtatgattcagtgatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaaggtgtaatatcatcccagataagatgctacaatttaaacacgttgagaagaacactgtggataatttccaaggaaaatataaattccaaaagtttgtttgagtagaggtgaaaaactttcctgtgtggttgaagtgtagagagggagagggaggtgaagctggggaaagctcagggatggggcgagactatgctgtcatccctttactttcatgttgaataaaagggaaagttaaacatggaactacgacagggggaaaagagagaataataaaaatattatttggggtaatacggttttctatctggaaaactcaaaggaagcaactaaaactccacaaaagctatttgagtttttttaaaaaatgctttaaaataaatatgctaacaatctattgctttcctattgtttttgtttgtttgtttgttttgtgttttgagatggagtctcgctctgttgcccaggctggagtgcagtggcatgatattggctcacttcaacctccgcctcctgggttcaagcaatctactgcctcagccttccaagtacctgggactactacaggcacctaccaccacgcccagctaattttttttgtatttttaatagagacggggtttcaccatgttggccaggctggtctcgaacttctggcctcaagtgatctgcctgcctcagtctcccaaagtgctaggattacaggcatgaaccactgcgcacagctatttgctttcctatttttaaacaatgaccagttgggaaacaaaatgaagacatgtcaaatttacaatagcataaaaaagaatcccttagatgatgctaaagggaaaatgtgtaggacttatatggagaaaataagagttcaacaaggggacaatcatttcctgatggaaagactcattgttgtcaaggcatcaattatcttgaatttaatttctaaatttaacacaatttcaatcaaagtcccaatcattttttggaggctgagggttgactgaatacaatcccaataaaaattccattggtatttttaaaatcttgataaactgattctaaagtttacttggaagaataaatatgcagtgatagccaagaaaatgttgaaaataaggataatgagggtggacttgccctgccaagatataacatattacagagctactataattaaagcccatattgctatactagaagacagatcagtggcacagaatagaaggcccaaagacagaccccagtatatataattattaaacatataataaagttggcatttgaaatcagtggggaagggatgaattattcaataaaggatgctgggacaattggttacctctttggaaaaaaatggcaaattggattcccatttcacatcagattccaagaaattagacatggatcaaagagtttaaagtggaaatgatgccatataaaagtacaaaaaaactccaaagagtaatatttatatgaccttggagcatgaagaaggctgtttgaggtgtacttggactgtctttctttgtccagttttcccttttagtggtttaaaaggaatacatagtagtttttatatttttatttatttatgtatttatttttgaaacagggtctcattaggtcacccaggctggagtgcagtggtgcagtcatggctcactgcagccccaacttcctgggctcaagcgatcctcccacctcagcctccggagtagctggactgcaggcatgcaccaccatgtctggctaatcttttattttttgtagagatggggtctcactatgttgcccaggttggtcttaaactcctgggctcaagtgatcctcctgccttggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcaggggcctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggaggaaatgaatttatcctgctaccatgaatctcaaagtatgactactgctagtgggacaagagatgcttgtaggtaaaatgtgcaaaaaatttttgttttaatcattataaatgtattttaatgtggattgggaaaaatgtatctagtagtggttttgcatttatgataaggatatagaatttcctacctaagtaaagatttttaggttaaacaaaagataaactgatttgaggacaatattaagtgaatgacagtatgggtgatataaggatatggcaaaagttttggtacaaatgtgtttaaagtttagggtacattgttgattggcctacccagcagccattcacagccttcatccttctggcagaggctacctctcatgatggaagctaaaaatgcctaatacttgcttttcccggctctcttgtagctgctgaatgaggatgtgacccaatcctgctaatgggaactgaggggaagacctgggaaagagtctaggaaagatttttcctttctgataagagagagacatcccttcccttgtcctcttgggcatttttgtacaaggatataatgcttggagttgtggcagcccttttgggtcaatgagggacacattgccgacatcctgagcatggcagagtggaaaacttaaaagaaccgtgggtccatgatgatgctgatgagctgttgataccactcacagtccttttatccccaagctggatagatgggagaagaagctttttttttggccaggcacggtggctcacgcctgtaatcccagcactttgggaggctgaggcgggcagatcacaaggtcaggagatcgaaaccatcctggctaacatggtgaaaccccgtctctactaaaaatacaaaaaattagccaggcatggtggtgggcgcctgtagtcctagctccttgggaggctgaggcaggagaatggcgtgaacctgggaggcagagcttgcagtaagcggagatcgcaccactgcactccagcctgggcgacagagtgagactctgtctcgaaaaaaaagaaaaaaaagaagctttttttttttttttctttttttttttaagcaaagtcttactctttgaagccttctcttttatttttgtttttttctcttttgagacagaatcttgctctgttgcccaggccagagtgtggtggcatgatcatgtctcactcactgcagcttaacctccctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcattcagcataccccaatgcagccatcacccctagttctcttactttgtttctgctttgaatccccttcttgaaatttctcccattggctttgtctccattactggttctgttacccacttagacttgacagctgacagcttgcccaaagtgagtagtgactatcttctgtcattggatttctttagctcctgctggtcttctgcaaatggtcatctgccaatttgctgcaaactggggtgggagtttgtggggagggcatatctgttgccatagcaacacaaagatgctggagcatatgttggatattctttgcttggaaaatgtggtaattgaggttaagaactccaagaaacatggaacaaccaaagtccttggaaatctgtttgcaaagacaaagtttgagactgtttgtcatgttctctcagatcctatgccctagcccttgtagtgcaatttcttctctcctccctagcaaaataggcaggggagtttggggagactgccctactcagtatgcagctctgagtgttcatgcagactgaaacttgatactcaacttgcagccaagaagatggtgtttcccatattctatctatctgctgaatgtttctgttgcctaagacagaaactcagctcaaactgacttatatgaaaaggaaaattttgggtccttgaaatagaaaaggcctaagggttgacttggcttcaagcacagtgaatcaaagttctaaataatgtcctcaagaacctgtttctccccttcttggcttagcctttgtctgtgttgattttattttcaggaaggcttgtctcctatgcgagcatggtggctgcaacacctttaatcttatatcttatcagtgctgcagtgcagtaacaagagctaaagtctcattagaccatgaatcacatattgccagaagaatgggttatgctgattggccaggcctgggtatatgctgctgtggtgtgaatgttttgtttctccaaacttatatcctgaaatcctaacacccaaggtatggtgttagaaggtgggccccttgggaggtgatcagttcatgggggaagagccctcataaatgagatagtgcccctataaaaaagaccccagagatatccgtcaccccttctaccatgtgaggttgcaatgagaagacagttgtgtatgagaaagtgagctctcactggagaccgaatcttccagtgccttgatcttgtactttctagcctccagaactgtgaggaataagtttatcatttaaaaatcactcaggttttggtattttgttacagcagccagaagggactaggacagaaaattttggtactaacagtgtatagaggaacaaaattttaaggatgggttttctgaattggtttcggggatttggtaattggctgccaaatctgattagatttaagaatgctaattaccctatttctagtagtaaagagagcctggatagtccgtggcatgatctgtttatagagatacacaaatcatctgcattggatactcctaatcaaccatttataagaagcaaggagccaagtgattcgatatatgatacccaaacacttttggaaaactaaggcatataatgacttgctcctaatgtctctggacaaagtggagaaagaaaaagatgagctcagggatttgaattcccagctcaaagagtttcataaatgatctaagagcttctaggtgtgccctgaaggagagccttctagcctgtagttgcagggctgaaatttctgaaaattaaatgcacaacctcatcctgcaattggctgaattacaatgcaaattggactccccaccacacagggtgtctgctctaaaagcaagggcaagggcattgatcagaaaagaatgggatcccataaggtgggaagactctgatgaagaccctaatgaagctggggacattgagcccctaaattctgacaagtcttttttttaccagtggaagtggcctccttacctcaagcaaaagtgtcatccccactcagggtggcattggcctttccatcttgtctaagggaactaaccctgcattgccctaagaaacagtaatggctttccctgaggcagttgccatgccaggcaatgctgattcttgtcagcaccgaatcccaccaccccttcaagtcctagcaggctcctaaacgtgagatgcactgtgtgacccacggggaggtatgctataccccaaaagaactatttgagttttctaatttatacaagcagaaccatagggaatatgcatgggaatgatattaagggggtaggataatggtggaagtaacatgaagttgaatcaggctgaatttattgatagaagttcactaagcagagattctgaatgtaatgttccagcttaaggagttaggaagggctctaacagtttagctggttggctgaaacatggattaaaagatggcctatcatgagtgagttggagatgcctgacctcccctggtttaatgtagaggaaaggattcaaaagcttagggagattagaatgccagagtggatttgtcatttaatacccgctcacccatgctgggaaggtcagacatacctttaagaaaggtatgtctctgtcaatactttgagaaatatatttgtgaggggagccccagcgtcctttaagagctctgtgatccctcttctctatagaccaaaccttactatgggaaccacagccacttaattggaaaacttaaatgcaatgggaataattgggtcctggagtatcaggggccatttggtggcactcaactgttaaaggcaaggtaggtgcggttaccttaatggatcgcagagttacaacaacaatcggaatagcctgactcatgcagacctatggcactgcctaatcatggtgttgctagaagtgaaataggtgggaagcctactaaattcttacttgatctgtatagcagaaaaattctaggtgaagtgaacagaagtctaacttgaatcataaaaatagagaatcatagcccctcagtccattcccagacttgagccagtttatagacccagaaccctttgaatgaaagggaggtaaaatttccttgagaaagcgattatactgctaaaagtttatcctgttaatctttctcccagccttgcccaaagggacctactgctttttatcaggataactgtgcactagagaaaaggaaatgatgagaccttttggggactactgaacactagttctgaactgacactgattctaggagacctaaaatgtcacttgtccctccagtcagaataggggcttatggtggtcaggtgatcaatggaattttagctcaggtctgtcttacagtggatccagtgagtccccaaacacatcctgcagttatttccccagttccagaatggataattagaatagacatacttagcagttggcagaatccccatactggttctttgacctgtagagtgaggcccactatgatgggtgaagccaagaggaagccattagaactgccccagcctaggaaaacagccaaccaagagcaatactacatccttagagggacagcagagatcagtgccatcatcaatgacttgaaagatgcagaggtagtgattcccaccatatcccttattcagctctcttatttggcttctgcagaagacagatgaatctagaagaatgtcagtggataatcataagcttaaccaagtgatcactccaagtgtagctgctgtatcaaatgtggtttcattggttgagcaaattaattcatcctctggtagctagtatgtagctattgatttatcaaatgcctttttctccatctctgtccataagacccaccagagcagttttattgcagctggtaaggctagcaatacaccttcactgtcctacttcaggggtatatcaactcttcagtcgtatgtcataatttagtttgcagggatcttgatcattttttccttccacaagctatgacaatggtcctttacattgatgacattatgctgatttgtcctagtgaatgagaagtagcaactactctagacattggtaagacatttgtgtgttagaggatgggaaataaatccaactaaaatttagggaccttcttcctcagtgaaatttctaggggtcagtggtgtgtggcatgttaagataccccttttaacgtgaaggataagttgttgcatctggacccttctacatccgagaaagagacagatggcctactgggcctacttggattttggaggcaacacattcctcatttaagtgtgttatgctggcctacttaccaaggggccccaagagcttctggttttcagtagggcccagaacagtagaaggctctgcaacaggtccagactgctgtgcaagctgctttgccacttgggccatctgacccagcaaatccaatggtggttggttagtggcagagagggatactgtgtggggcctttggcaagcctttataggtgaattgaagcacaagtatttaagattttggaatatagtcctgccataatccacagatagctagtttcctattaagagacagctcttggcctgctaccgggccttcgtggaaactgacgatttgaccatgggccactaaattgccgtatgacccgaattgctcttcattaactgggtcttatctaaaccaccgagccataaagtgggcatgcacagcagcacttcatcatcaaatggaagtggtatgtatgtgatcaagcctgggcaggctctaaaggcacaagtacgatacatgaagaaatggcctggatgcctgtgctccccactcttgctaccctgccttctctctcccaacttgcacctttgggctcatgaggagttagttccctatgatcagttgacaaaggaagagcagactaggacccagtttacagatgtttctgtacggtgtgcagacaccacccagaagtggacagctacagcactgtagtcactttaggacatccctgagggacaatagtgaagggaaatcttctcggtgggcagaactttgagcagtgcacctggttgtgcactttgcttgggaggagaagtggccatacatgtgactatatcctgattcatgggctgtagccaattatttgactggctgggcagggacttggaaggaatatgattgaaaaaattggtgacaaaaaagtgtggggatgaggtgtgtggatagacatctctgagtgggcaataaacatgaaaatatttgtgtcctaggtgagtgcttaccaaagggtgacctcagcagaggaggattttaataattgacttgatagaatgacccgttctttggataccaggcagcctctttccccagacaccctgtcatcacacaatgggctcatgaacaaagtggccgtggtggcagggatggaggttatgcatgggctcagcagcatagacttccactcatcaaggctgacctggctatggccaccgctgagtgctcaatctgccagcagcagagaccaacactgagttcctgatatggcaccatgcctaggggttatcagccagctacctggcggcaggttgattacattggaccccttccattatggaagaggcagcattttatccttatggaaatagacatgctggatacagatttgccttccctgcctgcagtgcttctactgaaactgccattcatggacttagagcatgctttattcactgttatgaaattccacacagcattgtgtctgatcaaagaaatcacttcaaagccaaagaggtgggcagtgaactcacactcatggaattcactggtcttaccatgttccccatcattctgaagcagctggcttgatagaatggtggaatggccttttgaagagtcagttatgttgccagctaggtagcaataccttgcatgcctgggcaagattctccagaaggctatatatgctctgaatcagcatctagtatatggtgctttttctctgatagccagaaatttatggatctgggaatcaaggaagtggaatgggagtggtaccactcattattacccctagtaattttaccaccagcaaaattttgctttcttttcccatgactttatgctctcccagcatggaggtctcagttccagagggaggaatacttccagcaggagacagaacaatgattctattgatagttaacactgccacccagccactttggggttcccatgcctctgagttaacaggccaagaaggaagttatgaagttggctggagtgattgatctggactactaaggggaaattggacactactctacaatggagaaaaggaaaaatgtgtctggatacaggagatccctaaagacatctcttagtattaccattacctgtgattaagatcaatgaaaaactacaacaactcaatacaggcaaaactatgaatggcccagaccctttaagaatgaaggtttgggtcaccctgccaggtaaggaaccaccaccagctgaggtgcccactgaaggtaaagggaatacagaataggtaatagaagaaagtagttacaaataccagctatgaccgtgtgaccagttacagaaacaaggactgtgattggcatgattattggcattattttgttatggatatgtttgtgtgtatatatacatatggtgagcaaatatctttgttttctttgctcttttagttctttatcatgtaacgtaagatgtattgactttatatcagtatttttatgtcttagtatttaagttataggataccaggacaagaggaatcattactcaaggacttcatctccttttctggggaggggattattgcattttcagttgtacaaagtctaattgtatcacatcaggtggaattatgtccttgttattctttatttggaggttctttatttaagaaggtgtgtatggatgccaagttgagaaagggtggacttgtgatggttaattttgcacatgcagttaaccttgactgggctaaggggggtacccagatagctggtaatacatgatttctgggcatgtctgtgagggtgttttcaagaaattatcatttgaatcagtagactgagtagaaaaattgccttcattgacataggcaggcaccatctaatctgttgaggactcagaacaaaaaggcagaggaagggtaaattcactctctctttttgagctggaacattaattttttcccgcctttgggtgttggtgctccaggttctcagtccttcagacgtggaccaggacctactccattggcacctatggttctcaggtctttgggctcagatttcaaacattggactaaactatacccctggctttcttggttctctggcttgcagatggaagactgtaggacttcttggcttccataattatgtacaccaattcacgttattgatttttttttggagaaccctgactaatacattgtgcctacaccgtagatgagggcgtgagtgccccttccatggattgagagtggggaagaggtagtttctctgaggaaagctagagaaacggtattgtgtcctggttaaaatcacggattatggagccagcattcctagcctcagatctgtgtgaccttggacaaataacttaaatccatttatgccttagattcctcagctaaaaaatgagttaaataatagtttctacttgatagcattgttatgagtatcaaatacatagatatctgtaaaagcacttaggacagtgtctggtgcatggcaagagctatatatgtgatgatgatgatgacaatgacaatgaataacagtgcacacatgctgagcagccagcaaggacaggtgtcttgtcagacagaccaggaaagggtgaagaatgagcaggttctctgtctgccacctggcagtccttcctagaagtgtggaggctctgtaagtggcatgagacccctctctgtatgaatgaaggagtgcagccattcattgccttgagcatgaggagagcaggaagtactccctgcagccagcatgcataggatttggcagcctacctgaaatgattctatctctggatacagttccaaaaaggtcagttggcaccaaggatgatgaattggtccagacacctgaactggcttgactcagttcattgacctttttctgctcatggttggaggcatgattaaagacctagccacacctgcttgcccacctggccagactctcctttagctgcccctgatactcatgcaggtatggaggggtgccctctccttctgcatgaccttggaggaactggtgtgcagcaagttcgtgaagcagaaacacacaggcggtgaccttggacaaggctccatccacgataaaggatgtgcttggttgcatcctctaccctctgctgttccaagcccagtctgagccaggcaatattatggatattagtagagctttgtgctgttggcattatcctacagctatgttcacatcatatcacattgaggcaattttatgaaccaggcactgtcccgtgaacctagctactgagccaaccattcaataacaatgagaatagacaacatttatgggcactcgccattggagggccacaaagtgtggcagagttcatggatgatgctcctggtcacccacagtcatccttcttgttcttgatctcaccaggcaggaaatcctcaattcatctgtctcttgtacctcttagagagaccaggtctctggtactgtcataagcattacttatggacattataggttattcagcactcagaatactgaccacatacacagcctcctgtgacatctcagaacaagaaacagaggagttgtctctgagggttgggactagggtgagtcaagtgaggtactttccctgggcacagtttaaggggttcttgtctgtgtctgtggatagctggttggttggctggtgggtggatgatctaagatggcccctttcacatgactgacgacgagcaggttgtcggcctgtgtgatttggctctcgtccatgtggcatcatcctccatccaactggctagctctgacttgttcatatggtggtttccaggctccaagaagagcaagagagcatctcccaacactttttaagcctttgtatcatgtttgctaatgtcctaaaaagctagtctctggccaagtccagattcaagtggtagaaaaatagattccagtgcctcattggagaggaagtatctatggttaatctattgcagatcctgttaacccaagaggccatagcagaacagaacccctggagaccatcacactggactttataaaaatctgcatgttatagtgtggctcagagtcatagatggcctcatcaaaagaatgcacctaatttattccctgcctcaatcgccagtggacttaaccacctctagctataagtggttaatgtggcagtttattgatcacgtcaatggtggttaagagtatggactctgaaatcagacatacctgaatttgagtcttgattctgcccagatactcattaggaaaacttgggcatgtcgttcgacttctctatgccctagtctccttatatgtaaaataggatgttagtaccaaccacataggtttatagtgataattttaaaaatatttaaaatgagaaagagttcacaaacaaaagacaaatgaatttcaaagcccttacatgaaagcgcttggcacagtgcatagcaagcccttggtacatgtagctaaggccatttccattgctccacctaggtccataatcaagaatgtactgacaattctctacattcttccacccagagcatgcccttatgaggtgattacagtttccatttccattacttcacacaaacctcaaattctgtgatgcagtgctaagaaaagaactcaaactttggagccagaaaatgctggtgtcaaattccaaatggtctctgctatgtattgctccaatgaccttgggaaaataactttaagttctgtgaccctcagtttatgtctttaaaatagagaaaataatacctaaataaagcggtttttttttttttggtaactattcaataggagactgcttgaaccatccctagaataatgtctggcacaaagaaggcactcaatacctggttttaaaatcattattaatgtctggaggagcctctcctgctctataagggatacaggttaccctctgacctgccaagaaataatagctaataataatagctaactttattgaacagggtctctgggcaggcagtacaaaaggactctttgtctggtttgtctaaagatacctttttcaacactttatggctttagaaataatttcttatgatttatagtcaagttactgagtaaaacccactgttaggtcctgtgatctcctaattccatcactaaatcaggtcaattagagatggtagacactaatgttgaccttatccttttgatcaagtctcactttgtgataagatagattaaaaatcataaacttgttaaacttgttaaatgttgaagatttgataaaacagaaatgaaagtattaaatgtatgtatacattaaagtatgtaaataagtgagaacatgtttgaaaatctggttgaaatggatgattttctcataaaattgtcaattttgtctcaaaaagaaattgaaaaccagaataggcaaataaccgagaaagaaatgaaaacattattcaaggatcttttcttctcgtaaaaccccagacaaatatgtttcatgggtaaaacttcttaaattttagagcaacgaagaatttctgttcatttaaaattgtacctgattacaaagaagaaataaacctttacaattttttttaaatgaaaatgagagaaatccagctcaaattagcagtaggaaaagagggcccattgactcctgagaaggacattgggagtagagtaagagcttcaggaccaaggacctcaaaggctggaactgaagctccagtacttgcaagatacttttccatttctgctttattggttagttattttgctctgtaacaaaccattccaaaatttagtggcttgaaacatcagttatttgtggtttctcatgattgtgtgggttacttgggtgattcttctgacctgggtttatttgggtaatccctgctgggctctgtcctgggtcttggtcagctagtggctgggccgatgctggattacctagaacagccttgctagcattgactgagggctggcaggctgtcgatctgggcatttcatttttcctccatgcgtcctcttttcctccaccaggctagcttagtttcacggttccaagcacggcaagagagggaaatcccaaagcacaggtgtgtgtgtgtgtatgtgtgtgtgcgtgcgtgtgtgtgtgtgcgtgcgtgcgtgtgtgtgtgtgaaatggagtctctttctgttacccaggctggagtgcagtggtgtgatctcggctcaccgcaaccctcccagatacaagtgattctcctgcctcagcctcctgagtagctcggattataggcacccaccaccacgcctagctaatttttgtattttttgtagagacggggtttcaccatgttggccagctggttttgaactcctgacctcaagcgttctgcctgcctcagcctcccaaagtgctaggattacaggtgtgagccactgcgcctggccagcataggtgttttttaagcctttgtttgtgtcacagtggttatggacaagatcagatttggggtggagaaacaaacttcatctctggatgggaagaatagcaaagtcacatggccaaggagcatgcggggatgggagacattggtggccattgtgcagtctaccacactgacccttatctgctgtgccagatgcctcgtttgcccttccaatccactctgctttctctgagagactaagccataatgactgcttcaactggggctcccttaccctctgacctgacctctggttggactcaaggggaggggctaataggagacttggggaggggagagtgagaccctccccgagtcagtcagtatttattatggagtcatcttcactctaccttttgactataggttgctgctcctctacagatcatcttctctatgtaattctctccttctgggttccaggagctactcccttcctttgtcctctggctcttactagcctccaatcccttatactttcccaacaccatgcccacacctttagaaacagtcctttcattgaacctttcttaaacactcttcactttagtatgccatctgtttcctgcggggcccctgactgatgcatctgctttgtcttgcctcatttgctcctgctgtagatggaacatgtctgcaaacatcgttacagttgaccccatggaaagatggcaaccctagtggaggaattagccttcttcctgcattcgttttttttttttttttgagacaaagtctcgctctgttgcccaggctggagtgcagtggtacgatctcagctcactgcaacctctgcctcctgaattcaagcaattctcctgcctcagcctcccaagtagctgggactacagatgtgcaccaccatactcagctaatttttgtattttcagtagagataaggtttcagcatattggccaggctggtctcgaactcctgatctcaagtgatctccctgtctcagcctctcaaagtgctaggattacaggcgtgagcgactgcacccagccatcttccctgcattcataattgatctcagaaaatgttctgatggagttggttctctatcactgggagaacgaactcttataacctcagacctggatcccatggcatccctttcacccaggagcagtgtatgttataagaagagtgaaggagaaactttgatgcgctgatgaaagtaataactaattattataagcttgcttaaccacaataaccgctattacctagtaaagttggcataaaaagtaaactacaagccagtctcatacatgagtctagatgaacatatcccaaataaaatagtgaatgctattttattgttgtcacggacattatgcattcaaataatgtggaggaaacaatctagagataaaacaacaaagaaaattatgatcaatataacaaaatataggaataaagataaaaatatgccagcaaggaaccgtggaatctggaaagcataaatttagatggtagaagtgatagcagaatgttacccaaccaatgtaaatggattgaaattctctactgaaaggcaaagactatgagattggatgagcaatgtacaactcttggcagtgtataaaagatgcttaaagcacaggttttaaaaataaaagggacaaaagtgtatcatgaaaatacatatataaaaatgaaacatggtcttaataatgatatcaaaagaaataggactcaaaacaaaaagcataaacgggggcagatgtcccagcagatcacttgagctcaggagtttgagaccagcctgggcaacatggcgaaaccaagtctctacaaaaaaaaaaaaaaaaaaaagaaaaaattagccaggcatggtggcatgcacctgtagtcccagctactcaggaggctgatgtgggaggatcacttaagcctgggaggtggaggctgcaatgagctgtgattgcaccactgcactccagcctgggcaacagagtgagattctgtctcaaataaacaaaactaaacaaaaacataaaacagggaaggagaaaacatgaactctaatgcattactggtgagtggcaaattagtatatgttttctaaagagcaaattttccatacatatccagagctttaaacacatttttgacctaagaattactaaatctaatcattttgacctaagaatgacaattctaggaatttttggtaagaaaccatttcaggataaatgcatagatttatctagagtgatattcattgcatcagtatttataatatcaaaaatttgaaaatgacccaagtctcactaccaattagagtttatataagtaaaatatattacagtcatatggtggaatgctggccagtgattcagtgtcacagtgtctggggataaggggaatgttctgtgtcttgactgggatggtgcctatacaggtgtacacatttttcaaaactcatcaaactatatgcttaaactctgtacattactgtatgtaaattatactttaataaaaagtcacagtgattaaaatgccattggcctggaaatgcagtcataatatattgctaaatgaaaaaaaaaaagcagacaacaaaacattaggtcaggtatgatagatttaaaaatataaaaatatatacacatgtaaagccaaaggccacattccctaaataaattttcgtgaatacttaattctgttcactgtcttatgccagacttgttacctgcagagctctgaaggtcactttgggatgttctgtagctggtttctccagttttgtttgtttctggggccactccacctctagtgcagactcaggtttcccacttagttcagtgaggaccaaacttgagtggcggttccggcgtaatcgggagtcacttacagttccttccaaatgtggttactcttgaggtcctccatccgctgggagtcagctcagttcctggactgagcatcttcaggtgcttctaataagattctggcctctgataagtcttgacttcaattcatttttggccccagagaaggggaatcttggctctgccaacaaggccctgtccatttcctgcctcagtgtgagtggcaggaagaccaccttgatcttcagggcaaaggctcgcttcctcctcttggtgtcatccggtctccttggctcagtaaagcaacgtaacagtcaagtgcacttttctcaacgcctggtttcttctgtcttacataaccccaagtggggacacccacagtgaactttcaaaaataatgctccttccagggagcgaagcagcaatgagggttgaacatctctcttgggatgaccatcacctggaccaaaagacccatttacatctctcaaggataagtaatgtcaggggcaatttagtctaaatgatacagtctccacctcccttcctcccttcctcccttcttccctctctcacttatctattatctccctacatctgaaagtgcaccatcctgctgaaatcacatcctgttcacataacactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtacagaatttttgtggtgcagttctaaaggagaagtaggactgaggtccatctgtgcaggctaacgaagaacagcccatactgaccaactggttgctacataataatattagctccccatccgaggatagtaaagctcaattgccaggcatgctgtagagggcatagctgtggtagatgtgggtttctaccatgttggtggttctactagcttttgttgttttgttgcatgcaacagaaaccatctttggttaacataagttggaaaggaattcattggaaaagatgtggcatccttcagagcgttgaaagaaaacttgaacaaccagaccagttctatctgattttggttcttgtgttacattcagcctaaattcaaattccagaaggagagagattatctggccgagctcaagttgcctaacaaactcttgggtcgggcttttaaaatgttctttcaaagactaaacgctgtgggggtaggatggcttttcaaaggagaatcgaagtactgatacggggagcagggggtggggagggggaagaaggcacagatgttgcgccaattggaacaacgtgtttgctacaatttctaaatgctacattgcagattgcagagagattggatgacaggcttcacctgaagagatagagatcaggacctgggaatccatgtgttaaaaagttcttgggtaattctgatggatagctgggtttagaagccagtgtaaggcaatatgtataaaagctctgaaaccagaatgactgagtttgaattccagtttggccactaactagctgataatcttgggctagttacctaacctccctgcttcagtttcctcatctataaaaagaggataaaatggcacccacctcatagggtccacgtgaggattaaatgagttaacctagatggtaagagcttcatgccgtaactggcacataggacatgctagttaatattattgccacaaatgatcctttcaagtcttagattgtgcatttcaaaagtccatccttatttttggaattgcatgcatttatcttgctttctgcaaaatggaaaggcatctcccatgggctggttggagagaggggctgataaaatgatggtaatgtgataaaatgcagttctcttgattgtcaagtgaattctgcatgattcttctgctctcatttgccacgggctgactgcttctgcaatgcagaacccgcttgtaaaggtcagaatgaattgcttccaaacatccctttgtccctcactgtcacgaagacacagagctgcatgctgtggaggaagaagcaaatccatgatgctggaaggccagagaacagaaaccaaccgtgcacagagaggcgagctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatggccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgtacctgcacaaatggtcctgaagcaggcagctttcttccctgagagctgcctttccagatatgcactgccaaaggtctgtgaccctacagccttggcctgatttggtccagatgcgtgtggacatctctcccaaacaggatcaaattggcctcttctaggagtttagaatttggaatcaagggtgctggttttagtctggactggtcacacagtttttgacaactgtttattgtacgggaaaagtgtccagcttgatgaattctcacacagtgaatttttctttgtaagcagagccccagaagcccttctttgctccttctaatctctacacgtccctccccatccatcaaaataaccactaccagaccagcaatcctttggctgcttttccccccacccccagtgatctattttattttattttggaaagaacacgtaacatgaaatctatcctcttaacaaagttttaagtgtaaaatgcatcattgttgatgatggatgcagtacgagacagcagatctctggggcttattcatcatgcttgactgaaacttgatgcccattggtaagtaattccccattttgcccttcttccaggctgtagccaccaccctttcactctgattttctatcaatttgactatttttgttactttacgtaagtggaatcatctagtatttgttttcctgtgactagtgtttttcatttaccataatgtcctcagggttcatctatgttgtctcattgcagaacttccttctttttggggggctgaaaaatattccatcatatgcataaacacattttccttatccatttgttcgtcagtggacacctagattgcttccacgtttagctgttgtgaagagtgctgcaatgaacatggaactgctaacatttcttcaggatgttaatttcaattcttttgggtaaatacccagaggtgagggtgctgaatcatatggtagttctatttttaatgttttgaggaaccttcacacgggctaaggacttgaataggcagttgtccgaggaagacatacaaatgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttaaaaaagacaagtgttagcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccagctactcaggaggctgaggcaggagaatcgcttgaggttgcggtgagccgagatcatgctactgcactccagcctgggtaacagagcaagactccatctcaaacaaaaaccaaaaaacagaattatagagtagaccatctcttgtgtctggctggtttctttcatatgtgtgtgtgtgtggccacatgatattgaaaggacacatagcatcctgttcatcaggatgtccagcttcagagccagcaggggccaggcaggtgggtgaatgagtgacgtgtgtgaccacaggcatgtcccattggcccattgaacaccctatctgaaaggggcagcggcactcagctccgtttcctaattcctgctgtttaaaggatgaaggtctaagttttcccatttttttccagagaaatctgaaatcccctaaatttagattttgacagagaattcaagaattacaactgtggtgtattttaaacacatttttggactggattccttctgtgaacctccggtttacaacttctgcattcgtaggtggggactgtcagtggaaggtctcccccaccccacatcggaggggagaagggaaaatgtaaatttagtcaaatgggctttctttggagagtagagagtgtgcaatagtccaaggcagggagctttaaaagaatgcagaagtcttttttctctcttggtgtctgagctctaaattggctgggacatatccttagttaggagtcagtggctatagcgccccctgctgtcctttagcaccctcttcgtgtccagtgagatctgcaggtgagcctggaagccacttgcttctcctgcaggttttgggaggaagattcatcattttaaatattgctcaagtgcctgctgctgccagtgacttcataggctcctgttagactcaccttcacttatatttggtcaattacctactccctcagtcagaccttgccactcgattttttttttctttttgatacaaggtctcactgtgttgcctacgagtgcaatggtaccatcacggctcactgcagcctctgcttcccaggcttaagtgatcctcctgcctcagtctcccaagtagctggggctacaggcatgtgccgctacgcctggttgattttttaatttttttgtagagatggggtttcatcatgttgcccaggctggtctcaaactcttgggctcaagcaatcctcccaccttggcctcccaaagtgctgggactactcaggcataagccaccatgcccagccaccactctatttttttttaaattggaggtagggtaagaaggactgggccaggtcgtccttcccacaattccagtctcactgtttctatctattgaaaagcatttctggcatttgcttggtacctttccctggtttctgggctgaaatagattttatcccatttttaaacaattccttctgatactttcaggggtagtttgtggatgagagcagagtgaaatgcataggctcaggtttgtggccttgcaagttaataaagagtgtggactttggaactagcctgcctgggctccaatcttggctctggtacctactagctgtgtatcattgttttcattgttttgttttgttttattttgttttgtttgagacaggatctcactctgttgttggggccagagttcagtggtgcaatcatagctcactgcagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcagagtctggatttgagtttggctctagagcctgctcttagccaccatgtcccatcctcactgagaggacccttgttcaactccactaaccctctctggacaagtagcctctggtcctgtctccctgcttcctctctgtctcactggcctaccctttccacacctttctaaaaaccaaatgtgatcatgtcatcctctttgttgaaaacatgtcaatggcttcccattgttcttgggacaaagtaaatactctttgaagtggctgcgaagcagggtggacatacgtcctcctctgccaagcttgcctataaaccaaattggtttgttctgttgtgtcagcgtaccacaaggctggtgcccttgtcatcctcacaagagtccctgttggaagatacaggatatgattgtcctactcatgaggccctgcgtgctctggcgtcagggtccctccagcctttgcttgaccactctgagtaccttcgttcactcctctgttcatcctgccaccaggcatttgcacatacttctcccttggctgagatactcttctctctcttcttccctgtgagttcagtgggtctcaattctagttgcattgtagaatcttctgcagggctttttaactgaatgcagtgtctgcacccattccagaccaactaagtccaaatctctgattgattcagaacctctcagttgcatgcagggttaagggccctggtcaactcacgctggtcctctagactgcagctcaagcatcacttcctcagggaagcccttcctgacctccctgaccaggcccatttccaatattttgtactcagcacaccacatacctcttcttgctgtcacatatcttagggacatctaaatattaggttggtgcaaaagtaattgcggtttttgctattgtaaataatggtgcaatagtaattagttaaaagtaattaaaaataatggcaaaagcacagttacttctgcaccaacctaatatttacttacatggtgacaaagaacccagattctggataaaaatgaatcactagctgtgtgaccttgggcgagttacttaacttctctgtgtctcagttttctcccctataaaataggaatagtcaaaaacctgttttacatggtcgttgaggatcaaattagttcataatatgtaaggcgcttggaacagtgcctggcacatggtgagtgctgtatgtggtagctgttactgcactagtaattattaccccctgctgggatctgtaaatccctgaaggtggggttggcatccgttgtttgatcactccacacctaggatgctgcatgaacataatagctcttcaatacctgtctgttcagcagagtggcgtcctagtgaggttcttggtaaaagatgaaaggtgagatgtggaattgcaaaaaaaaaaaaaaagtatagacatcagagttggcctgcacagaattcaccttcctcagttagggcccttgtctatgcgggcctgctggttcagggtcattgtttctagcggtcatgaggatcagagcctgcctggacttgctgtgtgcagagtccccggtgcagatggccacctggcaggcatttgctccagcagcatcctttgcaggaatgggaggctcctctgtaattcacaaactcaccgtgtccttctatacagaggatctttctgctcttctgaaatgcagacttgggtgtgctgagagcttctgtgacagagggtgctgtcaggaagctgggcatccagggctgcacctggaaaccaagctggcagcggctttgcaagttgaataatcttatgttgtgatcttgcatttacgggaccccccacttagcaaaaaggggtgctcagaccacttcccttagttggcttacggcactgcagggggagaggggtggggaggggaggagatgggtgtggttttgtgggtgatggaggatttatttataatgtgggtgtgatccgttgccatgtgactattccctgaaactactgtacaccctgagcaatgaatgcacaacccggcctgcacaggaagaggtggggctcactctgtgaacagcctccaccagaactcgaaggccccctggggaataccaagcctaacccctttgttttcagaaggaggaactgagaccagaccatggcagtgacttgcccaagatcacagatgtcatttttattctaagctaacatttgtcatatggatactacatgccagtcactgtgccaagctaagcatcatcattgtgatttcattaatctgtacacatctagaaagcaggctcattatattcagcaaacacttgcatagtgtatatatgatgtgccaggcactgtgctgagtcttttacaaatattaatccattaaattctcataatcctatgaggatttagtgtgattattatttccttttatttatttatttaagacagagtcttgctcttgtcacccaggctggagtgcaatggcatgatctcggctcactgcaacctccacctcctgggttcgagcaattctcctgcctcaacttcctcccaagtagctgggactacaggcacccgccaccatgcccagctagctaatttttgtatttttagaagagatggggttttaccatgttggccaggctggtctcgaactcctggcctcaagtgatccgcccgccttggcctcccaaaatgctgggattacaggtgtgaactgccgcgcctggccttatttccattttaaagatgaggaccctgaagctcagagaggttgggtaacctgtccaaagtcacacagctgggaggtcattgagttgggagtcaatctcagacagtctggccttgaagtgtctgctccagcactgtcatttctctccatgtgacagctcttctctccattttacaggtgagaaaatcaaggcttatataactcaagtagcttgctcgaggctgcacgactggaaattaccagagctggtgttgaatttgcacattccagctatagaatctgacccctgatctcatgctaaactccctctcagtggggctagggtcttttggctgaggggtccaagctgggaacaggtcacgggggttgaggcagagcctgaagccagcaggtggaggtggggtggtgtcagccaggtctacctgggttgactctgaacctcatgcagtggagcagttactcccttcccatggggcagagccccagctaggtggccatcgcctggttacaccctctaattccttaagatttcagcttaaacttcattttctcagggaagccctcctgactctatccagccgacactctccttgtaaattctctaagcactgagtgtctcctttgcagctgttggaagtgtacattggtttatgcttctttattgttttccccaactagactgacatagggaaggtactcaacgaatatttggtgactaaatggttaaataagtgaatggcttatagctgtagtagaaggaattggcacaggaaatcaagactgaagtccaagaagtggaaatatatataaggtttattgggaaaagtcacaactcagtaggcacagggatgccctgagcagtgataattaataattaatagttaataataatagcttgtacttattgagtgcctgctctgtgtcaggcagctgttttaaaggttgtgggtaattcattccctagaacctcacaaaacaaatattgttatcccctagggataactaccgctagggttattatcctagctccccctagggttgttgttcctagacagttaaggttaactagggataacatcaagagagctggcccaaggtcaccatttcttcccagcttttaaccaacgttttgagaatacagtattccccatcaaaatcgtggctcaccacggctgtgagtttcacccagcggcctgggtggtcatggtgaaagctagaaatacatctctggaagacattttcaggtatgctacagaggctggcatacccgggctaagagctgctggcctggctaatgaactaagatcactcgttgaaacaacaggtataaatctccaagcagaaaagactcgcttaacatggatggcaaatgttgtctaccaagaagacccaagaaaataatcaaataccctttgccaagaatgtctggttataaaataaagatataaatgacaataacttttctgtattttagcaacaaccagttaaaataaatttgaaaaaatcccagttaaaatagcaataaagaggtaaaatacctaggaataaatacttaggccccaactaagagagtttatgggggaaaaaatcttttctggaaaaacacaagaaggctcaaattacatgtgaattccacccctagctcccccaatctgtttttctcctggcagccgtggttctatatcacatcccacctcaccccttagctcagccacagcacccagctctgcacaattccttattctaaattctgattggcccagttcttccttcataaatttcatatcactgacccaaccttggtctattcagcattggctggaagtatgaggtcagatgctttactgtccactgagctggtgctgtaggttggaatttttctagaagggtcaataagttaagcagccaatgattggcatttccagcacaatctgggagaatacatggataagaataaccaagaaaaatttgaaagtaagcaggaatgctaggggaggggccagtgggtataaaggtgtgtgcctctagataccaagagcttatactatggtatggtgcaacggtggggagagagagacagatcagtggagcataagacaatattaaaaaatgagccgagaatacataagaaattcgtgtatcataaaagaggcatttcaaatcagcagggaaaagatgcatttcatacatttgctgtctaaacattaagagtagaaataaaggtctttcttgagagctcatgctaaaatgaatgccaagggaaatgatgatttcaatgtaaaaaagtgaaaccataaaagactaccagaaaatatcaggaaggactttctaaatacgacagcagagacagaaaccatacaggaaaagggaaaaatttgcactttattaaacacgcaggcacacacacacacacacacagacacgcacatgcgttatacgttgaaaaaagaacatcgacaaaattaaaaggcaaatgagaaactgggaaaacatttactgcatatatcataggtgaagggttaatatccttaaataatacacaggaaaatttgttacaaataatttgaaagaaacaaacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactcctgggctcaagcagtcctcccaccatggcctcccaaagtgctgggaatacaggcgtgagccaccggacctggcagaacatttcttaaatgttcatcttcaccagcaactttatgcagtttccatgcagtatctcactgaactcttactaacctaggaattaagcattattattattccagtttccacacaaggaaacgaaaacttaaaagggttaaataactttccctagagtcagaaagttaataactggaagagccaagagttaagcttagatgtggctactaattcacccctatattgacatggactgcagtgcagatcttaacccaggaaatggtattttaaattctgccaaagtttatacaatagaagcttatccttcaaatggaataattacgtattcgccaaatgggcggggttagaagagggcagggtatatcaggcggttgaagcaaatcgtcacccaacacacaagtgtttacatggtgttattggctctattcattctcctctccaggaacaaaatgaaagatcgtcaccaaattatagtgtccccttttcaaatgtgccatgcgtgtgtaattacagcttctaacattctccacttttcatgctcagacaatctccgtccactcagtctcaattaaggtttccctactttttttgtcttttgcaaatttttggccttttgtttgcagttgtgggcatggcagtactgatgtgttactcacggtggtagtacaagaggtgagatttttgtaatacccagataaaccctaaaatattctactttacatcaaaagtatagaaaagtctgtgctgagaagttttactctctgtctactttattctctcttgcctccatagatgaacacttgtattaggttttttttttctttttttttttttggtgtatcctgccagaggtgtaattaagagtcgactttccccggttactcaggaggctcaggcaggaggatcacttgagcccagaagtttgaggctccagtgaactatgatctcgccactgtgctccagcctgggcaacatagtgagaccttgtctctgaaaataattttaaaaagaaaggatacacacttaacttattgcacctcgctttctcacacacacaaaaggtaccatgtaatatacacacctcagcaccttgatttttttgtttgtttcacttaaaaaatacaaccttggtcgggtgcagtggctcacgcctgtaatcctagcattctgggaggccgaagcaggcggaccacttgagcttgagctcaggcgaccagcctgactaatatggcgaaaccctgtctctgcaaaaaatataaaaagtagctaggcatggtagcgtgcaccagtagtcccagacacttcgggggctgaggcaggaggattgtttgaacctgggaggttgaggctgcagtgagccgagattgcactgctgcactccagcctgggtgacaaagtgaggccttgcctaaaaaaaaaaaagaaaaaaaaatgagatttttttccatattaatgcagagaacttcctcattgtactttatacctgagtagtcttccattatgtggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccaattggcccacccaccaggaatatgtgtctctgtttctccacagcttttcaacagaaactgtcgggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccacaatgacttttgcacctacctaatactgttacaggttgaatgcaggcatgcgaagttatgacagctcatgactgaagctggggaaatgttgccatgatgattttttctcttgggaataataaaatcaagaggttttatgttctgtgtgcaggacactgtgcttgaggttttataaagtggatacggttattggacccattttatggctgaggaaccagagactcagggtggttaagtcacttccctgaggtcacacagctaactctggagcctgcgcttgttaatttccctctgttctgagggtatttccaactgggaccttcaatttaaccttgcctacctaccccatgggaagtagagcctcaggagctttcatagcttgtaaatgtccagggatgacacagtctgaacttgcaatttgcttttcctttctcctctatggatgctgttagcttgtgttttctctctgtgtgcctcatttcagcttccttattcctgcagttttacttcagcccaaccagatttcagcccacctgtgggcaaagctgcacagcccattcagactgagagagacttttctttttctttctttctttctttctttctttctttctttctttctttctttctttctttctttctttctctttctttctttctttccctccctccctcccttctttctttctttctttttttctttctttctttccttctctctctttctttctttccttccttccttccttctttcttttcctccctccctctctccctcccttcccttccttcctctttctttctttctttctttctttctttctttctttctttctttccttccttccttccttcttcctttcttcctttctttttctttcttttctccctctccctcccttccttccttccttccttccttccttccttccttccttccttccttccttccttccttcctccttccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgggagtttaggggatgtgttcacatggggttggattccagcactgttgggaagaaggtagggagtctggcagaggtcccaaatccaaattcctacagggtccaggcaggaaaggggaaagagagaagcaggcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctcccgggttcatgccattatcctgcctcagcctcctgagtagctgggactagaggtgcatgccgccacgcccggctaattctttttgtatttttagtagagacagggtttcaccgtgttagccaggatggtctcgatctcctgacctcgtgatccgcctgcctcggactcccaaagtgctgggattacaggcgtgagccactgtgcctggccaaaatttcacattttaatctgatagttcctgacttaaatatagtaaacttatttggatttctaagaagcaccttgttggccaacggtagcttctttacaggcttgatatagcttctgggttccacactgtggcccctgggcatgaaggagggcccaggccagggatgggacaggctctaggtggcctggaggtgtctagtcagtgtggcctgggtgacgaggatctgatgtaaaatgagactaggggagggattgaggcagagatggaagctgtgtctttttttttgtttttgagtcagagtttctctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagagggagtgatggcttacaggccatgaggattcccagactcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattccgtttggtctgtgggcagtccctgagccaaggcaattatagatatcttgactcacccctggttgtaggtaacatgcctacctggattggctgaagcacaaaggacaaattttagaggacacagggaggcagatggaattggaaggcaggatgccagaaccccagggaccagaaccaggagcttcatccctggggtcatgtagtctttgtctttgtttctccaggttcctcagagcgcaccataaaaatcagcaccaactgtcatttgctacaatgtggatgaacctggaggacattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatatctcaagctaagaaaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaaagtacaagcatggcttttgggaggtgcccatctcagagatggcattgggctcaggcaggcatggaaaggtaccctgaaagatgcaccttgagggtcgtggagggagtcatgaggaccacaggtgtaggagtgtggctttaagctctttcaggtagcaggaaggaggagggaagaatccactgaggatgacctggtttgtctggtctgaaggattggggcagtgggtgggtagagttggtgcctacaagtatgatccctcatgaaagcggagggaggggaatgaggtcagaggagctctccagcagcctctaaataagccgtaagaagtcaatgtttccctgcaacttgccgattggttttcctgtctctcatctggctctaatctgtgctgcacagccccttctaagtcattttcctaaaatagcatgtttatggtgcaggggtttgcagtggccaacagcgatgattgcagccctacagctgtcacaacaacccattgaccactgtgtgcaatgctgtgcttgccacgggcaaaacacttcgtctcttagttcttcggtttcctcatctgtaaaacaggggtagtaagtagtatgtactttatagggctgttatgaggatcgaatgcattaatgcctgatgaatcccttaaaatagtccctggcatgaataaatgttccataaatgttaactctcacttattaagtatttattgagcatcttctgtatgccaagtacagtttatgccctgagagtataatgatgagcaaaatttcctcacattgcatgcagtgaagtgtggaagagatgcaattaagcgtgcatttataagtcagtggtttaagtgccgtgatggagaggatttagaatataagttccatgaaagcagaagctcttttgttcacagctgtatccccaatgcctaggaagaacttgaccctcagtatacatttgctaggtgaatgaacgaatgagtcaagttctatcttagccgcacatgaagatgaggtgtcaatggagtaaagttgggagtgaggagagaagggaggggaacttggtgtgaaccccatctctgcaagggtccagctgggtggccttggtgaagttactctgtagttaggatctgtttcattgttgctaaaatgggaacaaatgataccttctgcatggcatgtcataaggattggagagagtacatgtgagacacccagcgtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcatgacagagcaagaccctgtctcaacaagacaaaaaacaaaacacacacaaacacagaaatgtgtttccttttcccttcccattctttgtgcttcttggtatctcctcttgtttaagagactgttgatatggagaaaggtctggatcatttttggtcagaaatgcttgaatccttgtcttggagatcgctcaagaaaatatttacatgaagaaaagtgcaaaaccaacagaggcaacttattattagttgtgattttgccccagatcttaaagtagagctcacaaggccttgaggaactcctttcttctctactaggcaggactaaggaaattcaaacctgaactcaaacctaactcttggcctctgtaagatcaatatatcagagaaaccagaagggaccacaagagccaagagtagagacagaatgtgtcctaggtcttggagaggagctggctcaggccacttctaccaagggtctcagggcaatactataagacttggacccagtagcgtcctgggagaagtgaaggatgtaagggagaaggagaagagaaagatggcaaggatgccttttaacctccatgcgagctccaccactggggtctggccaatccgtgtcttggaatccatccaattaaatcaactctgcctccttagaggttaagtaggggtgtaagagaacctggagcttctcctacaggccaataccagtcatgaacaggggttccttttttattattattatactttaagttctggggtacacgtgcagaatgtgcagttttgtttcataggtatacacctgccatggtggtttgctggacccatcaacttgtcatctacattaggtatttctcctaatgcctcccctagtcccccaccccccgacaggtccaggtgtattatgttcccctccctgtgtcgatgtgttctcatcgttcaactcccacttatgagtgagaacatgcggtgtttgattttcgaacaggtgttcctttttaggtgggtttgaagcactgaactcccaactttaaggtgaatgtccaagaagcacaatgggaactgttctgtggcacagagcagggggactctgataggaaccttatgtattcacttagtctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcgcttctcaaacttggctgtccagtgctctggacgagtacttcatctgcctgactgcagagggtgggaacgttgtgaaagaaactttgtagctcattaacaagataagaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaactcctgggttcaagctcaagcagtcctcccgccttggcctcctaaagtgttgggattgaaggcatgagctactgtgcccagcaaaattcactttttttcttttttcttttttttgagatggagtcttgctctgtcgcccaggctggagtgcagtggcatgatttcagctcactgcaacctctgcctcttgggttcaagcaattcttctgtctcagcctcccaagtagctgggactacaggtgcatgccactatgcccagctaatttttgtattttaaatagagacagggtttcaccatatcggtcaggctggtcttgaactcctgacctaaggtgatccacccacctcggcttcccgaagtgctgggattacaggcatgagccactgctccaggccacaaattcacttttaaaaatataaagtaaaattcatcacagttaatatatagaccactccaatatccaaaacaaaaaagttgctgcatctgcctctttttagttaattccctatccacctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccgaaaagtaggattcctgggtcctaggagagttccagtttatgttctttcttcactaacacttggtatcgttggttttagttttcaaacattttagcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttttataaggggcatgtccccctttgctcggcacttctccttcctgctgctttgtgaagaaggtgccttgctttcccttcgccttccactacgattttaagtttcttgaggcctcctcgtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatctatgtagtatgtctgtttatttgcttacatgttcattttctgtcactagagtacaattttaaaggaggcatctgtggcagcatcaataaatacatgtgaatggatgaatgaaggaaggaagaaactggtagcatgtaccaaaggctagggtgtcagatcagccctggattggaacctaaggcccatgttattaacttctgccatgtacttttttttcctttttttaagagagagagggtcttgctctcttgcccaggctggagtgcagtgatgcaatcatagctcacacatagccttgaattcttgggctcaagtgatcttcccacttcaacttcccaagtagctgggactacaggcatatgccaccacacctggctaattttttattgttgtagacatggggtctcactatgttgcccaggctggtcttgatctcctggcctcaagtgatcctcccaccttggcctctcaaagtgctggggttataggcgtgagacactgtacctggtctgcaatgtataacagagaaagcaacttttacagaaagagttctcttgaactaaaaccaattctgtgaggaaagaatctcttgaagaagaaagagaaatgcagagccaaaggcttacaaagggcatggtctgtttgggagcgggggtgcgctctgagtgctgagaatgtacatagtatgtgtgcatgtgggtgggtgggaggagggggcttagctggggatcaccttggccaaatagtaatagcaatcatggaaagcttatgctgcttgctatgtgccaggtggttctaagacctctacacaggttcattcatttatgcttcccaacagtcttataaggagagcactagcattatcagcattttacagatagggaaactgaagcacaaaaagatcaaattagctgggcatggtggtgtgcacctggcattccagcaattttggaggctgaggtgggaggatcatttgaggccaggaatttgagactagcctgggcaacatagtgagacccccctctctacaaaaaaaaaaaaaaaattaaaaattagctgggcaggttgggcacagtggctcatgcctgtagtcccagctactcgggaggctgagacagaagaatcacttgaacccaggagacagaggttgcagtgagccaagattgtgccactgcactccagcctgggtgataagagcaaaactctatctcaaaaaaaaaaaaaagatcagctcagcatagttgcatgcacctgtagtcccagctactcaagaagctgaggcaggagaatcacttgagcccaggaagtcaaggtcccagtgagctataattgtgccactgcactccagcctgggtgacagagcaaaaccatgtctcttaaaaaacaaaagaaaacaaaaaaccatcaaacaacttgcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagtcacttccagttctcaccatctttgaaccagtggggagagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgatgaggaactggcaatggtttctaagcagggagatttcacatccagacttgggtttttgatcactgcagaagcatgcttggagaataaaggtggggagaaagaaaagtcaggagccctgtttagatgatgtgtctgttactttgttttcccatctctggagtccctactacaggcaggagcctgtaggttgagttcccaggcaggcccagatggagggtttgcaggcagggtgagtgagcatggggctgcaaagggaacaatcatctgtctttgtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttttctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagttctttgaatctgggctggcctcagctgatgtcacgcatgttcataaagcatgaactcatggttcatggtggattagcagatggaggtgggctgggagctgtctgggccatggtggcctcacccacatgtcctggaggatggctggctgtcatctgggtgatggtgatgaccaggccacgtgtctttcctcctcagtgggctaggctacctagcctccgtgcatgcacggaggtcacagggtcctgagtttcttaggagggcaagtcccattggcagccacacttcaagtctctacttgtgtcttttgctcctgatccactggtcaaagcaagtggcatgtgagatgcacagtcacagtgtgggaaggggcagtccatggctgttgacacccagaggcatgaacaaatcatgggcatttctgcagccatgcaccaccactgttttcagcattgagatgtggggctgatgcattctttgcatggagaagacctgtggccctgcagcacccacaggtttgtgctggaggaggaaagagcatcattctctggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtctgcagcaggctgggtgtcatgaggctagtggtactgctctcccaagggtcctgaggcccagaggacagagggagaaagtcatagggcagagagtgacagagaggactgtgagggtgaataagggtggtagggagcaagacagacagcaagaaacacacatgcatagacagacacagatgcaggggaaagatggacacatgcaaccctaacacagggaggaatgtggggcgtggaagctacagagagactcagctagagagagactcaggcaaaaggagggacaggcagacacacagaccaacagataagccaggtgcagtggttcactcctgtaatcccaacactttgggaggctgaggcgggtggatcacctaaggtcaggagtttgagaccagcttggccaacgtggcaaaacccaatctctactaaaaatacaaaaattagccagtcaaggtggtgggtacttgtaatcccagctacttgggaggctgaggcaggaaaatcacttgaacccaggaagcagaggttgcagtgagctgagatcacactactgcactccagcctgggtgacagagtgagactctcaaagaagaagaagaagaaaagataaaatgattggcatggacacagagagagacgccattacacaggctcatgcagaggtatagagatggaaagaccagagacagagacagaagcacacatggagagccacagagagacacggaggagagaggcagagagacacagttggagaaagggagagacaaagaggccagagacaagtgcagagagtggaacagaccgattcacagacacggccaaggcagtgagccacgtgcagaagtgggacagcagagacaagagacatgcagcaacgtggaaacagagagacagacacagaaacatggcaagagccacagggggacagtgaggttggagccttctgcctgcaggacaccagctcctcttaccacacatggggccctaatatagggacaatgtccctgcctcagagacagtggtgggtgggagctcaggctggtgctcaggtcccagagggctctcccttccctccccacaactcatttctagtttttgtaataggcctgctgcctcctgggacttgggtggtctgagaagggtcccttgcccccagatcccttgaaataggggcccatggggtgacttggcctctccttctggcttctccaactggaactagcgtccccctggagaatcctgggtgcctggcacaccttcctggagtggggcattattgctcaagacctagaagaaatcacccaccacattgaaatagacacagatactctacggaggagtgcgcagagggagtggatatcctataacatgagagatggccgaaggccaaattcagtgtataggcacattttatccaccctgccctggctctaaatctttttccttgtaattaattatggtggacactatggccagcccagaccccctcttcatggtcccaccccatcccctagctgtggttcacagcagtgccccatcctgcataattgcccaagataatgcctcttccagggagaccagatgattgtggtgcccagccctcttgtctcagtttggaacaactctgaagggtcatctcagctctgggctccccctaacatcagctttgattgcatccacgtggcaaacgaacttctccccacaagagcactccccaaaaaccttgtgctcaaaactccccgtctcagactctttccagggagcccaacctattagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcggtaggtggccctggggctccactggctcctgaccttgcttgacctgtgtgattgagaaggggagggtggcggaggggtggggcagtccagtggaggggtggggcagtccagggacggggagggggtgtggcactgcttctgccccatgccctgcccatgacagcccctccctgcagcagggggatctttagaaactgtacaccctcaaagcttcgtccatcagcaccccaggctgacttgggttcagagaggagacgtctgagttccttggacttctaacttcctcaggatcctccacttcccttctctccttctcatttcccactcttttttagtaatcttttgggatgggtagttgcatttcctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgctggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaattttgcaaaaattagtgtttctgaggcctcagactggttcagtagctctgatgcattgagccctgggttgcggaggggctttacgtagattgtgtaaaagctgaaaaatacttatccctgtacaatataattcttttaaacttgagatttcgtgaagcccagtgagattttagaaaatgtgcaatccattgcattatgttttcctccaagtggtcgcctgcctcccagtgtgatgcttgggggccccaggggaaatcccgcagtttcaggttcaagggaagccagttttccccactgattgaggttcccgatgctggtgagacaaatatgagactctgcttccctctggtgtcattctgtgggaaatacactcgttccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctcccgggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactatatagtaggttacttttttgtttagtttagtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtggcttaagacaagacgtttaaaaaaaaaaaaaaagaaacgaaaagaaaaagaaaaaaacaataggccaggcacagtggctcatgcctataatcccagcgctttggaagaccgaggtgggtggatcacttgaactcaggagtcagcctgggcaacatgtcgaaacatcatctctactaaaaatacaaaaaattagccaagtgtggtggtgcacgactgtaatcccagctacttgggaggctgaggcaggaggatcacttgagcctgggaggtggaggttgcagtgagctgagattgcaccactgcactccagcctgggtgacagagcaagactccgtctcataaaacaaaaacaagaaaaacaaacaaacaaaaaaggccaggtgtggtggctcacacctgtaatcccagcactttgggaggctaagacaggaggattgcttgagactaggcgttcaagaccagcctggccaacatagtgagaccctggcatattgtaggatttcatttctttgggatgttcagagcaggcaaatgtataaagaagtttaatagcactttgtgcttttccaaatactttgatatcacaccattcgggaaagggcacgttgttgccatcatggaagggaaaacgaagtctcagcaaggctgaacaccctgaccaatgtcacatgctgagcaggggtgagcacctgggcctctggccccatgtcacaatgccctgcaattgcccatacaccatgctgggcacagcctgtactcagcatgggcttgttgattgatggatgatagaagagagccctgatgctgtggccgagttctctaaaaatagagccaagatggggattttgttccagtgatttattgggctgctcatgggaaaagagaagtgaaggaaccatgcttccttcctcaggcagggaaaaagcttggcgagagtgtggtctccgtggaagtcttcttcagcctggtatctggtggaattttgtaccaaacactgtagcacagtcagtcccatcttgaggcaagggggctgttctgtcgtgttccaggtcagtcagtgctgtgggatgacttgtgtctcccccagatttgtatcttaaagcctcacccccagtgtggtggtatttggagctatgggacctttgggtggtaattagggttagatgaggttgtgagggtggggccctcataatgggatttgtggatttctaagaggaagaagaaagagagatcattctgtctccaccaaaggaaggatacagcaagaaggtggccgtctgcaagccaggaagtgagtccttaccaggaattgaagctgctggtacctcgatcttggacttcccagcccccagaactgtgaagaaataaatgtctttttttctttttttctttttattttgttttagatggagtcttgctctgtcacccaggctggagtgcagtggcatgatctctgctcactgcaacctctgcctctcatgttcaagcgattctccggtctcagcctcccgagtggctaggattacaggcacgtgccaccatgcccagctgattttttttatttttagtagagacggagtttcaccatgttagccaggatggtctcaatctcctgacctcaagtgatccgcccgccttggcctcccaaagtgttgggattacaggcgtgagccactgtgccggcctaaatgtctgttgtttaagccacccagtccatggtattctgttatgacagcctgagctggctgatatagtcagttactgctgtaggctgctggggatggaggtgggaaggtagagtaacttcccaggtgaggaggcttctgtgcagttgaggacagttatctggacataggggtaactgtgagccattaacagccatcatacacagcacccaggggatgggtgcattggccagcatggaggggagctgggcagggtccaacagcatctggcacactcaagtttcccttggtctcctgactgtcttcctggtttcattgctgggactccagccccctcctccttggtcttggcaagacagatcagagaggagcgagcactaaaggttgtgcggggtccttcccagcagtgccaggccagaagtggccttgtggtgtttgtggaatggccccacctcatccagacccaagaagcatggtcagtattaggattttccactgaccatcagcccaggacactgccgtttgccctgagtgtcatatgttctttggaaatctcagcatctctagaggtcaaaggttttctaacttgcctggctactgaaattgagctcatatatctgttcttagtgttttggcaggtcaagatgagaataaatctgatcagttctcctccttttaaaaacccatcaatggtttcccattgtctttataacagactaaatctaacatggcgatctcattctttattcactgtctcctccccctttcttttaatccttggtcctctgcagactgccacacaccataagacatctgtgcgttctgtttagaatgtttgccattgccatcttctctttttctagcaattaactcttcctctcgatctcggttcatttttaccatctaataagcttcctccaacttccccctttcgtagacactcatggtaacctgagcttggccttgtgaaaggggtgattttatgttggatttgattaatgtctgcatctcatcacaaggcattagctccatgagggcgggactgtgtcttgccactctactcccagcacctagcaaggtgggcatcactaaatatttatgggctcaatggctgtatgtatgaatgagaaacccctggaggatcctgatagatagatataaggctttcactgatggtccccagatcagtgcctcctaaagtcaggaaatgaaggtcaacggattgtccaatttataccattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttatacagaaactttttagactgaaacatctccctgacagccttaggtactcccaatattgtgatatttaaatccttcttaagatctgacatccacacatcaaaagaaaaagagtaccaaagaggctgagtgtggtggctcacgtcggtaatcccagcattttgggaggctgaggcggctgtatcacctacagtcaggagttcaagaccaacgtgacaaaaccctgtctctactaaaaatacaaaaattagccaggtgtggtggtggatgcctgtaatcccagctactcaggaggctgagacaggagaatcgcttggacccaggaggcagaggttgcagtgagctgagattgcatcacagcactccagcctgggtaacagagtgagactccatcttggaaaaaaaaaaaaaaaagaattgggaagaaaaagggcaatgtaaacaagaaaaaaaaatccagatagcttaatatttatttttgtttaacttttatttgaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtagggtttcttttttttttttaacttttgaggtgaaatgtacatacaatgatacatacaaaattttttttttttttgagacagtctcactttgtcacccaagctggagtgtagtggcgtaatcacggcttactgcagcctcgacctcccaggctcaattgattctcccacctcagcctacaaagtagctgggactacaggcatgagccaccacactcagctaatttttgtagttttgtagagatggggttttgccatgttgcctaggctggtcttgaactccatggttcaagcaatcctcccactttggcctcccaaagcgctgggattatagatgtgagccactgtgcccggtgatgtcttaagtgtacaatggctgagttttgacaaatgcatatgactgtcattctaacccttatcaaattaattctcttttttgatgtcacagctgctgttgaggatccaagggaaggtatgaaccagagaaatgcctttatgtccccacacactgcactcatactcatgagctctggctattgggatgtctattatacctaaaatcccttagatgacatgaaacttaatagttgttcaattttttttgtttgttttttgaggagttataatgcagtaaagtagaaactttgaaaattggaaattcttgtttacaattttttgttatgtattcattgaagagcaaaatgcctttaaaaactcaatacacctgctttattttgctttttttttagtattgttgtaatgaagaagttcagttaaatcatatctgtctatggaacatctatcatctttctcagtgtattactgatagttgtctgcacaccccatgaggccaggggaagggtctcttgcccatccttccttcaaagcctatcagcttgttaggttgaggtgagtgtctcaggcactgaagttttgggatactggacctaaggagatgtagggaagctgacgtcttgctattcagtgttccttctcttcttccctggtcatttaagtctcatgagaattatcaaggccaggccagcgtctgaggccttcaggatgtgctgggcgcggtcattgctcccaaatgtctagggaattgcattgaagtgggcactgctgggacctgcagggctgtgacttgtgactgcctttggggacagtggtccagcaatgtctattaaaatatgtatacatatgaacattttgactctcacgttttcctttagggaatctattctcttaaaatgaaacaccagcgtgcaaagaaataaaatctagaacaagcatgtttattgatgttttctttgagatgcaaagaaaacatcagcctaatgaaggggtacccattttatgtgatactaggtagttgttgaaagcattgaattaggccaggcgcggtggctcacacctgtaatcccagcactttgggaggctgaggagggtggatcacttgaggccaggagttccaaaccagtctggccaacatggtgaaaccccgtctctactaaaaaaaatccaaaaaattagctgggtatggtggtgcatgcctgtaatcccacctgctctggagggtgagacacgagaatcacttgaaccctgcaggtggagtttgcagtgaacagagatcaggtcattcatgcactacagcctgggtgatagagtaagactctgtctcaaaaaaaagaaaagaaaagactgaattaaaatgagaaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttattggaacacagccacatccattcatttatatattatctatggctgctcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgtgtgaagaaaggtgtggaaggataccaaccaggttgtaaacactgggatcgcagcaggattgggagtgaagaggctgtggcggtgagggggattgtgttgtgtctctgtagttttcattacgtttcacaggttgattgcaatacatatcatttccgcaatttttgaaaaataaaaacagaaaaatctccaaataggaaaaatgaacagaaataaattgtctcaacaacaatagcagaaaaaaaaaatgaatggataatgccccaaatgatggggtgttggttgcttgaggagggttgttgggtggttctcagcttgagcagagctgggcccaggccctgtctgggtatttttgagtttttattgtcactagcttccatcttgtgtagcatctgccttgtgagctgggcctgttctccgagtttcatggtgtttgatgttttttgccttctttcagcaaggtcgctggcatcatccttgctgagtcgcatatgttctgggaaccacctcctcttctctgtgcctctcgcctggcaggtctacgctaaactgccccctgccctcccaggcccaccccacctccaagtctgagttctttgacttaaacttcaatcctgtttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtcctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctcccatgtgctgggcactgcttacaggcaaggcccctgtgctcatggcctctgccttctttctaatgatgggagatgaagaggaagcaaacaaaacactttgagaaaacaaggaacactatcaaggaaataaaataaagcggcatgatgtgatagagggtggccagtgggctgagtgtgattagcagggataatggcatttagttgagacctcagggaccagcaggagggagccagcttgctgaaaattccagggaagagtataccaggcagagggagcggcagaggcagaggccagagggaagagtgaagcagcaggcttgtgagtgacaggaactgacagccagtgggtgtgactggagcctcgggatggggaggggtgggtgacgctggaggaaaggcagggacagccagttaggctttgtgagccccatggtgggcttggtttctttctaagtgcatggaaatttagatcccaggagtatctgaaggacatcatgcaaggtcagtgtgtttaggccccaaaaccacccagtgggggcagtcattttgtttttctcattttacaaaggagaaaacagagccttgaaaaatctgagcctggtgtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtctgcagtcccaactgctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcgagaccctgtctctccttctaaaaaaaaaaaaaagaatttgagcacccgcctctagtccctaaggcagtgcatggaggaggctggatttgtaccctgggtccatctgtctggcaggttctaacacattaagtcagatgttggaaagatacagtttaagactatgagacattggaacataagaaacacccaccataccagtggggagaggaaggagatgcttcagcactggtagttctcatagtcttatctttcagtggctttagggcacaggttgggactagtttagccttaaggtcttggagaagacctgcttttcatttgcctgttgccccagcactgtggggtcagaatctttcttgtgatcagagtttagagaagggagggagcagtgggctggaggcattccaggtagccctggagaaggcaggagaggcataagttagaagggtgagggaagggaggagggccagtggctgacgcttactgagcccttgctgtgaacccagcacagtgctagccatcgtggggcacaaaagcctgtgcaagatgcagtcgcagctcctgagcagcctcgctgtctggttgggttccatctgctttaccactaccaacaaaaccaagggacggacacctcttactgatagtaaccaccaggcactgggcgaagcacgttgctcagccatgtcgtataatcctatcaacaacctgtagtcccagctacttgggtgggagagagttactgagggcatctccattttacagatggggaaactgagacacagagaaagaggttaaataacttgcccaagccacacaactaggaagatgtggagctgggacttgaatctaactatgccattccagataattaggctcttggacaccgtcttatcctggcactaagtacatcagtggagtgatgatgatacatgatattagtagcagccacttttacttctttcttttcttttctttcttttttttttttttataacagagtctcactctgtcgccaggctggagtgcagtggcacaatctcagctcactgcaacctccgcctccctggttccagcgattctcctgcctcagccttccaagtagctgggactacaggcatgcgccaccatgcccagctaatttttttgtatttttagtagagacagggtttcaccatgttggtcaggctgcctgacctcaaatgatctgcccacctcggccccccaaagtgctgggattacaggtgtgagtcaccgtgcccagccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctcctttgggagtatgagagtcagtgtttgctggactgtgaggctgaagatgataacatttcttcaaattggcctgttttttttttttttttttttttttttttttgcagaaagacagatttcactggccaagatctgcccaagaggctgaataaattcctaggttgtgagaagcaggtggatggagaagactttctctccaaacctccctgtgttaggaccagggaatgggttatgtgaatctggcaaccctgtcccaccctggacctgcaccctttaccactaccctggcacatccgggacctgcaccctttaccactaccctggcacatccgggacctgcacccttaaccactaccctggcacatccgggacctgcaccttaaccactaccctggcacacccgggacctgcacccttaaccactaccctggcacatccaggacctgcaaccttaaccactaacctggcacatccaggacctgcaccgttaaccactaacctggcacaaccaggacatgtgcccttaactattaccctggcacaaccgggacatgcacccttaaccactaccctggcacatctgggacatgcacgcttaaccactactctagcatcatccgggacctgcacccttaactactaccctggtctgcctccttgagtggcccagggaacatctagaagctgagagaaagagagggataaaaccaagttcacagcagtatcctaagaaagtgttctcacttaaaaatgcaaagatgctcacagagtgttcaggttacactggaaaactccagaaacaaagtggtttgtgtacatgggaggaagcagaatcaacttcccaccttagcattgtgggtgcttagcccacgcctgtgtatcgctcagggaatcagagtcactataagcatcatggaataagggatttactgtacacgttagaccttatacaagcttggagatgctggagacgggaagatctggaggggtgaattgagaatcagaggaagagcagtggtgcaggtggacaagtaggagttggtaggggatccaagaagccaagcacgttgagctgctgacatagatattgatgaatttcatgaagcttttacaggcactggtttcacccttgggtaactcagtacaggtatgttgacagccttccactaattcaaagatggttcataggtgtcccagaatcttttaattcccaagtgaggcagccccaactccttcagccatttactttctaatccttaatccacagcccacaacctcaaacacatgatagggccgagtatgccatcattgatgtcaacccggaactcttcctagacaacactccagttggagtagcttccttataaagcagggtgcccagagtgaaagagaatccacctgtgttgccgaggagcgaaggattgtcactttccttattctagatcagctgttttcaaacctttcggcttccagcccatctaggttttatgtaacacacacacacacacacacacacactgcacaaacaagcacaaactcacaaacacacacacattgcacaaacaagcacacactcacaaccaaaaccaaactgccattaatgcttacctctacttatgctcaccacacactctgatacattctcctctcttttgtggccctcttttctgttcatttccattctatttcctttaagaaaccctttaaggaaaatgctcttactctgcaaattgatttcactaacaattggcaaatgtgtcatgacccgccgcttgaaaaacactgtcctagacaacaaaattctctttctgcatcctgagatgatactactcttttggggggtctgggggtaccaccagccacattgcactgttgacttatcttgggtttatgatcagttaaagctctcttgtctatcacatcgggtgctgctagcctgcaggccccacatccttgtgcaagattttttttttttttgagactccaggatgaaacctgatgcatttcatcttgtagggtttggccttttgctccacggccaggctgagagcttttgggtcttcctgttcttgtgccgagtgtcttccggacatcaccttcctcacaccattctctgtgctacttgttctgccctccttacttttgaaaagatagtttattactcatagatgaggagcaggcgtgccactccatgaaaggccacacagggaagcagcagggtctgccaggaggcagaggaagcggaaagaaaacgtggcaggagcatttgctgctgtttctgtgagaaggagcaggtagggcgggaaaccagccttagggctggctggtttgaatgatctcagcagactctgggtgtagaggctgtctctctagttgcctggtacctgatacctggtgcttttacctggggtaattagcacaggctggcccagagtgtaagagccccatgaaggagttggttggaggtttgggctttggattggttggtttgcatatgaaaggtgcgcttgcaggtgagttctttactgtctctaggaatgggctagccctgggacagacagtttctccagggtcagcaaggctccgagacaccaaagcatcagaaatacagaaaatagagccaggtgcagtggctcatgcctgtaatcccagagactcaggaggctgaggtgaagaatcacttgaggcaaggagtttgagaccagtctgggcaacatagtgagacccctgtccctaaaaaaaattaaaaataaaattacccaggcatggtagtgcagcatgcctgtaatctcagctactcaggagactgaggaaggaggatcactgaatccaggagttcaaggaaagaggccgggcacagtggctcacgcctgtaatcccagcactttgggaggctgaggcaggtggcgagtgaatcaccaggtcaggaaagggagaccatcctggccaacatggtgaaaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaaaagacataaaattaatagaccttagactattttatttaattattttatcaaaataggataggcatagttaaaaatgccaatgtgcattggagagctgaggatgaaaagcaatgtcctgtacttgagcttgcatcagaatcatctagagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaaaaaggggtggatttttcatgagttttctgggaaaggggtggcagattcccagaactgaggattcctcctctttttagaccatgtagggtaacttcctgacgttgccatgacgattgtaaactgtcatggcgctgctgggagtgtctcttagcatgctaatgcattacaattactgtataatgagcagcaaagacgaccagacgtcacttttgttgccatcttggttttggaggattttgacctacttctttaacacaacctgttttatcagcaaggtctttgtgacctgtaccttgtgctgacgtcctgtctcattcagtgacttagaatcccttaacctcctgagaatgcagcccagtaggtctcagccttattttacccagcccctattcaagatggagtcactctggttcaaacatctctgacactctgagaaccactgcattggaagacactattttcaactctttaaactctttcttccagcacttgagctctaaattttaatcatgtgctctgtctctctgtcatttcactatttcatggctctgacttcctgagaaggttttaattctctgatgtgatccctctagttctcttcccctcacatccagcacggggttactgccatttgtagttcactcactcaaaaaaaagtgattattaagcatcttctgcatgtcaggcattgacttagtcactggagatttgtcagagaacaagccaaagtcctgccctcatggagcttatattttagtgcagggcttgacaaactttttctgtgaagggccagatgggctttggagctatctggtcactgtcacaactacttaactctgccattgtaacacggaagtggccacagtgtgccaatgaatgggcacgggtgtgtgccaataaaactttatttacaaaaacaggcaggaggctggatttggcccttgggctgtagtttgtagacctctgttgtagtgtgggagaagacaaagtaggtaaataagtaaaatacgaacagtaagctaaggggaaaaagaaaaaacggaaaaagaggatgggaaggaggcaggaggggactggacctgcacatttagatatggtggcaagcaggcagtcactgagatggggacattgagtaaagactttcaaaggagatgaaggagggagccatgcatctccctggcagaagagcattccaggcacagtaacagctggtgcaaaggccctgtggcatgagcatgttcggtgtgcttgaagaaacagcaaggaggctcgtgtgtctaagtggggcaagtcaagggaagggagcaggagaggaaagcggaggaaacagagaggcagctgctgagggctatgtgattcttgggagggaatttgtcttttctcttagtccaatgggaatccattattgtgactctagtagttgtaatagttcctttaagttttatttatttattttagatacaggttctcactgtatcactcaggctggagtacagaggcacaatcactgctcactgcagcctcaaactcctggcctcaagcaatcctcctgcctcagcctcctgagtagctgggactgcaggcacacaccaccatgcccagccaaatttttaaaaattttataatagagatgggatctggctatgttgcccaggctagtttcaaactcctggcctcaagtgaccctcttgcctcagcctcccaaagtgctgggattacaggtgtgagccactgaacctggctatttaagttatgtatttgcaactccatttcttgctttcccaatggtaggcaatatctcttaactttgtcttttgtagagcatttttatatgcatgatatcatttactccctatgagatgtgactattgtccctattctgtagaggaggcaactgaagctcggaaaggttaaatgacttggccagattcatatagctgataagtgctggtgctggaatttaaacccaggtttgtcttaatatggagatcttagcacctattttatatgaagagacaatcctttagggatactggggaaacctgtggcttttggacaataaattaaaaaccctttcccaagaaggggagctgtgtgtgtatcaatcaaacaaaatgagaactattctgagagggaggaaaaggttcttttctgtgggaacgctgaccaagccgttgacagctcatttatgtgatgctggtgcagtttgacattcatagtacaagacttgcatgcaattagcacgaatcgttctaacagtctcttgaaaacatttggaattttccctctgtctggccttgtgcatgatgtaaacatggctttatttagttggtcatccatcccagaatagtgtggtctgcatctgtctgcatcactgtggtctgattgaggtcttgttttcctggagggcagagactgttgtgtaggcttgctttgtggatcctcctcccccaggatcattcgccacaaacccgatggcagcctctctctttagctcatgacaatttctccaagtgtaagctgggggtcccgttcagtatgcaatgcaaatgagatgcaaatgaggggccctcttgggcacaggccaggaggccagagctctggggacttctgtacccctcctctgagttgcctaatgaagctgaccgttcctttcacaatcatcttctccacccaccaaaggcctcttaatgagggcagaagctgactgctctgaaaccccttcagacacctggtgattggaagctggagagacagtgagctttagatgggctgtcagccgctgctgagtcctcatcagctgcctgctgggttctgagaagcactagggaaggaagggagatggccctggaactgactgctattgtctgttcctcctcccctgacgagctgcatgcggcagccacggatggctgggtttgggctttcacgtcggcttctctggcccttgctggatgcctgcttcagctcagagaatgtggcttcacagggacttggaataagagctgagagcctgttccccccatcgaggatcaatgctcctttgatttcatttcttctttccagacgaatccactgtcttagcccgttgttggagaaatcccgacctaagcaggctttcaaattggggaaagaaaagtgaaccaatctgaaatcatggaatggttggtggagaaggacaagtaggcatatccataaagagccagcagtcccaaaggatgttccagtgcatctttctgcttatttcttctagttttgtaggggtgtgtggtgtgcaatgctgtttgcttgacagaatcctttcagtctctctctctctcgaaatataaatttcctgcactacaacagcctactaagtgccagacacagtgctgggctctttacctgcatcaacccattttgtctccattgacaaaaggggaaactgaggctcagagaggttaattgacttgctcaaggtcaactgggcttctgtgtggcagaactggagtttggtcccaggtctgtttgcatctaacacccagccccttaaccactttgccgaattgagaatttggaaattaaaatggtgatttcaactcagggatgggtgtgctttctttcagccttgcagtaagtgcacatcttctttctcttttcctctttgaagctgccagcctctcccttggggttctccttggctctggccatgatttccccagcttcctcattcatacctcctggcatcagactgacctgggctaatcaccatctctgcctgtcactagttcaagaggcagcttatggggacttgtgggtcatacaggttcccctagaaagatgatgggcagactgacattgggattgaaatgtcttgtctccagcgttcttgaataggggcaacaatgcccactgggtctccaggcatggggtctaaaagtgaatgcaaaatacctgtgatacagtgtggatgttttatccccaccaagtctcatgttgaaatgtgatcctcggtgttggaggtgaggcctcgtgggaggtgcttgggccatttttgggtcatggggcagacacctcatgcctggcttggtgcactccatgtcacctaaacgagttctcgctccatgttcactagagatctggttgtttaaaagagtctggcacctcccctctctcattcttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagctttacagaagggaaaaatgcagctcagagaggtgaattcacttgcccaaagtcccatcgctagggagcgatgggatttgaattaaaaatgcagatgtgattgattctaaacgcaggctgttaatgcatagctttcctggggaacaaaaagagctttcctttcatacctcattcattcattcattcacttattctttaatctcttctgtatgggaggtcatttgctagatactggatggctgtaggaatgaatatgattctttacacgctgagtatttcatagccctactaagagagaagaagagagagctcactataaaaggggggattggtgaagagataatggagtaggaagcacatgctgtgggaggtgccaggggatgagaggttaattccaacccatggggttgtgataggcttcacagaggcaaaggcagtggacttagttctggatggggcagagatctaacgcttattgatggcttgccccttgctaggactcagctcggtgggcgctttgtctattttctactttgaaagatgaatagaaactttgacggtcttttgccctctgaaatccactcttcacacccagccacaggaatctttctaaaatgtaaatcaggccatgtcacccccctgcttaaatgattccaagccttctcagagcttccaactgaaacctaaactcctcactcctgctctaagagcctgcagattctgcttccttcagcctctttccaaccttgtttgttcttttcccatgatagccacatctctgagccaacaaatatttttccttccttcttgcacttgctcttccctcagcttgggttgcttttccttgggctctatgtgttgccaactttccagtagccttcagtcatcactaaatgtcaccttctcagaaagcccgcctctgagtcttatctgaagaaacccctcccagtcactccctatcccattactctgtttgcatttgtttatttatttgcttcttgcctgtttctctccactggatggagagcaagaaccttccttattttttatgccactttgtgctagtgcagtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctgtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaagcatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagttaccatgggtgacaattaaaaagaaggattaaagatgtaagggactagagctgtagagacccatccaggagctattgatccctgtaggatggaggagatgaaacatacatgaattaaggaagtggaaggataagaataaattgatgtagaggatcagggagaggatggaggagtcaggactaacagagatttctgactcaggaagacatgtggatagtgagcgtgatagccaattagggttagaagtcacagaagcttaccagaagggaaaggtaatcatcttgctttagtatatgttgagatgtttttgggttgcatgggtgactgtgtccagtaggcagatgaatctgtatatccagagatccgattggaaaaacagagccaacagtatggatgcaggggtcaccggccctaacagtggaagctgaattctttgagtgggtcaggaattagtgcagcactgtaagagcaggaaggttcaggctctgggaaatggagccacttcagtcatcagtggagcaagaggagccagtgaaggagaatttaaaaataatgcttttaagtccaggtgcagtggctcatgtctgtaatcccagcactttgggagtctgaggcagaaggatcgcttgagcccaggagttcaagaccatcctggatgataaagggagactccatttctacaaaaaaaaattttttttttttaatgtagccagtgtggtggtgcatgcctgtggtccaagccactggggaggctaaggtggaaggagcccttgagcccagaagtttgaggctgcagtaagctatgatcacagcactgcactccagcctgagtgacagagtgacaccctatctcgaataataattattattagtagtaataattatagtgcttttagagaatgaaggggaaccagccgagtaaatggtcatagaagccaagggaagagagaattcaagaaagtggatatggccaacaccttagatgctgccaactggtaatgataaacacgaggctaagaattgaacagagtcactggatttggtcatttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggaagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaacttcctcccttatgcatgtatcacatctacaatgtttccttgtgtagtggatactgtggtgtgccaccaggatccctctctcagcacagaggcactcctgccccaagccacgcagagtattggctctgaccactcacggcttcagtatttccgtaggatttgccctgagggagctgcagtgcccaaggttatgccctcttccaggggcagctcacagtctatgattggttgctggtggggaatgggcttataaatgctcttccccagcctcagtagggaacaagtctaaggggccatcccagctacagagctccctcatggatcaggtgacacctctgttgcagctacattgcagttcagtttctcgatttcatcctgcttcccccattccttgcaggagttcctcccaaggttattccctgagaagccgcctgcatacaatatccagatcagtcttttttcagggaacccgacttaagatgccttgtttaatgtttgtatcttttctctaaaatataagctttttgtagggactgactattctgtcttgttcattttgtgtcaccatgtctaggtacataataggtgcttgttaataatttttaatctttttttttttgagacagggtcttgctctgttgctcaggctggagtgcagtggcatgatcttggctcactgcaacctccgcctcccgaattcaagcaattcttatgcctcagcctcccaagtagctgggattacaggtgtgcatcaccacacccagctaatttttgtatttttagtagagacggggttttgccatgttggccaggctgatctcaaactcctgagctcaagtgatctgcccactttggccccgcaaagtgctgggattacaggcatgagccaccacatgcggccattaattgaataagtgaatgaacaggtttcctaaacacacacacaggagtgccctgatatatacagtttttcagagttgtgattagagaataggttatctggaagtgccttcctgtgggagtgtgagcttgcataggctcccccagcatggagccatcactagcaatggctgtgtcttccacgagctatttccagggttccatcagcaaacagtggtcacgatttataaaacgttcacacaagaacatttgggctgcattctacatcattttagtacagagaggttgttccttggggcctttaattttctagctttcattattgagagagtaaaatgtatcacttgcattccaaaattgatttttatttcccaaaagaagcccataaaaataaataacttcccgggagggaaaacagaaaagcactctatacactgggcaatttgttaaaaaagaaaagaaaaggaaaggaagcctggagcgacaaagcaatctaaacatttagattgtatctcttgtattcccccactccccctgcaccttaaataaataaaaaaaaaaaaaaaaaaaaaaacttgaggcctgctggactttgaaaatgcccatgttgttgagaaaactctgttgggcagcttcatgggacagcatcctttggagcactgcctcatggttcacacccctggtatcccaacccactgctatgttgttattagcaagatacgtttccagtatctcattactaattgtatcagtaagcatttgctgtgtaacaaattgctgcaagggtagtgggcttaaaacaacattctttctctcaattttgtgggtcttctgggaggttcttgtgatctgggccagcttgtctggggctggagggtctgtgaggccctcactctcacatctggtggttggctcagtgtcagctggagggacagggatgccttggccattgcctgccaccacccagcaggctagcctttgcctgctcactggcatctcaagagcagtaagtgagggcatttcaatccaagccccaattcccaagcacttttgaggattctgtttgcatcgcattggctaatgtcccagtcacatgaccaaacccagatgcagggaatggagaaacgaattgttgttctttccttgacattttactttctcaagtataaaggggggtttgtaggcaaggaagatgccaagtagtcccattttatagctaataaactgagaaccagagaggttgagcaactggtctgaagtcacgcagcaagcccagaacacactgggtaaccaatccactgggggtgagttcaccctgtgcagccacatttgatctccccttgcttcattccctccagcactctggcagccaggaggacagctccctgtggggactgtgacattactggcccctcactcagctcttcttgtgccaattagaatgcatacttatttttttttgcaggttgtcctttgcttgcatccctcacctcccccatccactctgtgatcttctctgtggctcaagagcctgactccttcagagtgcatgacatgggctcttttcctttttagtttctgattgagttcaagcagtaagaggcattgattggcaagagattgtaggatggtaggaatgagaagatgcggcatttctgtcccaattcctctgctcttggctgtgtgtccagcagtatcagaaggccccttctctgtgtctccagatttcactgggctctggtaacactacttccttctttggcctcttcaggcctaggggtagcaatgacatctcaatgctgctactctctggatgtctcaccatgcgttgttgatccctttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattacaggcgtgtgccaccatgtctgcctaatttttgtatttttaggagagacagagtttcatcatgttggccaggctggcctcgaactcctgacctcatgtgatccgcccgccttggcctctcagagtgctgggattacaggcgtgagtcaccatgcctggccactgatgtactttcactgggttccattttttttataaggggagaaagaatggagtttgcagcatgcgcttagggaacccagtatcatgatgatagaggagtgagtagcctgcatgaatgctgctgtggcaggaagaatgtttgagaacttgagcactagagtgtgagatttctggttgtcttggctccattcagggaattcttaggactctgggaaggacataccaggatatttatggcatcactgtttgtggtggcaaaaagctaatagcctcctgaatgcccgtttttgaaggctgaacatgttgtagtctgtccatgctgtggtataacttgcagttgaaaaagaatgagtttcaaactgactgacatattgttgggtgggaaaagcattttgcagagcagcgtgtatagtgtgattccgtttttgtacagtaaccctcccagtccatttgtttctaggtgattgtctcagccaggagaaaggtaggaaagagtaaacaccaggttgccgtccttcttacctggcagttggggaggaggagaaagatagaatgggaaagcaagtaggtaaagggagcttgaaaaaaaaatcatagcaaatgggaacatacacatagatttaatttggtgtcccttttctaactttttgagatagatatagcattgatttttcagcctatcttctttcctaatatgtacattaaggctacacattttcctttaagcacagctttagttgactctcacaagttttgaatatttttgaattttcatgatgatttttcctatgatttattcaaaagtgtatgtttaattttcaagcatttgtaaatattctagttatctttttgttattgatagtttgtttccaccacagtctgaaaacatacataatttcattcatttgacatttgggtaaatattccatgtgcacttacaaagaatatgtatcctgtgtttgttggatgccatattgtgtgtgtgtaaattagtttcgttagttgtgttgttcatattttctatatcttgtttgatttttattttgcttgcttgttctgttactgaaagaattggatttaagtctcctattatgattctgggtttttttcctttcagttttatcaatttttggtttgtatattttgaagcaatgttattattataaaatataattgatatctcctcggtgaattgatccttttatcattctgaaaggtatctgtttatctcaaataatgcttcttgccttaaagcctactttgcctcttgtaaatataccagttttcttttggttgatgttttatgatgtgtgtgtttatatgtatatacatatatacatatatatagaccgaatatatgtattatatatgttttatataatgttttatggtgtgtgtgtatatatatatataaaaagactgaaagggaaaagggggaaatatatctatatataaaataatataaatatatatatatttttcccccttttccctttcagtctttctgtagccttacatttagagtgtgtcttttataagcacaatttttaatacagtctgacaatagttgattttaattggagcatttagaccatttacattttatataattgctgatatatttgagtctatatctaccacttcctatgatttttcgtttgtcccatgtgttttacattcctttttctctttattattgccttttggggatcacttaagtatattttattatttcatattcctttctattaactaattagtcatgtattgtttttattatttttatattgattctagagattgcaatatgcatctttggattttagaatttaatatattagtacttttattacgttccaaatgatcctaggttctttaacattttagtcctgtttaccccatcctaccatacacattgtaattttacatgtgatttaaactacattatgataatgcttcatataatcagcatttacttggatttaataatatatttaccctttctgttagttttcattctttcttacattttcacatttccatctgggatcattttctttctctctaaagaacgtcttttattatttagtttaggcctgctgcaaatacatcttaagatacttgtatttcaagctgggcacagtggcacatgcctgtagtcccagctattcaggagtctgagacaggaggattgcttgagctcaagacttcaagtccagtctgggcaacatcgtgagatcccatctctggggaaaaaaaatctttatttcacattcacccttggatagaatttgaaactggctgttattttctttcggcactttaaatataccatcccgttgttcttcttccatcatttttgttgattttgtcagtcttattgtggctcttttgaagtcctattgttgcctttatgcaatctgtatgattttagattttctctctctctttgattttcagcaatgtgactgtgatgttcctgtgtgtgtgtgtgtgtgtgtgtgtgtgtgtgtgtgtttgtatgtgtttatcttggttggtgtttctttacttcttgcctctttaacttgatgtttttcattagtattttcttgtccattgtctgccctatccttttctctccttttcatgcttgactttgattatatgtatgttagaccttggtactgtgtcctctgtctctgacactctcttctgtactctctgtctcttttaatctttatgccatagtctgatttttcttaataatctgtttttcagctcactgatttgccttctaactgcttccaatctgctgctaagccatgcattgagttattaattttaagtattgcattttaaataaactttttattttagaatagttttagatgtacagaaaagttgcagaggatagacttcccgtatacctttcactcagttttccattattaacacgttacatgaccatgacacatccgtcaaaatgaagatgttaacactaattagtactgtattgttaactaaactccaaactttatttggattttccttttttttttcacgatattcttagtgtattccaggatctcatgtaggataccaaattacattaagttgtcatgtttcctaagtgtcctctggtttatgacaatttctcaatcgtttcttatttttcatgaccttgacagttttgagaagtactggtcaagtatctggtagaatgtccatccacttgggaattattgtatgtttaattctaaagctttcatttgctttatttagttattttgagacaagggtcttgctctgtcacccaagctggagtgcagtggcacaatcatcactcattgcagccttgaactcctggcctcaagcaatcttcccacctcagcctcctgagaagctgggaccacaggtgcatgccactgagcttggctaatttttaaaaatttttgtagagatgaggtctcgctgtgttgccccaggctggtcttgaactcctggcctcaagtgatcacccctcctcagcctcctaaagtgttgggattacaggtgtgagccactgtacccagtcagtttcttttttgtaaccaatagttctctggtgaaactttccacattgtcatcctttctcccttcttttaaacatcttaataagttattttaaagttcatgtttgataattccagtgtctgaatcacccatggatctgccctcttgtctgtttttttaaaattttttagacgggatcttattctgtcacctaggctggagtgcagtggtgcaatcatagctcgctgcagcctctacctcctgggctcaagcaatcctcccacctcagactcctgagtagctgggactatagatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaaaaaccacacacagaatattggacttatcttaattctaattccttcaaaattccagtttcttgaaaaatattttttatctggcttttatagttgctctcagtgggagagctactttatcattgccccaagtggtatgatattaaataaaaatataaaatacaaaatagatttagagtggtataattatgtaaaaattgaatgttaacatggaaaaagaccagaaggtgaatatacaaatgaaagcatttatttaattttgggataagatctaaggtaatatttgtttggttcagaaaattatttttaaagaagggtgttgtgagcatcagtgatagagtgaggaatcctcatttctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatccttatcattagccccattttttaaacaaggagactgagttaccgagaagttaggtaactttcaggtcacaaagctgctctatggcagagctgatctgccaggatctctgggtttaagctcctcaccatcacacttgactaatttggtatagaaagtggctttagatcagataagggtacatgaaatgcaggaggtgccgtgttagaggacagtttggtccagtccccatgtcctggggcaaatgaagcagatggcctcagaacagcctgtttttaaatcatgtaagactgacttctttcagctgctggattcctgcctcccagagtgagacgttgaagtttggcccggaagaggctgagcactggggacgagcagtgctgtgctgtgtatagagtgcttaaaacagtgcctgggtctgagcgtggtggctcatgcctgtaatcccacctctttgggaggccatggtgggaagattgcttgagcccaggagtttgatttcagcctgcaacatagtgagaccccatttctacaaaaaattttaagaagtagtcaggcatggtcgtacacctgtagtcccagctacttgggaggctgaggtgggaggatcacttgaaccccaaaggttgaggctgcagtgagtcgtgattgcactactgtactccagcctgagtaacaaagcaagactttgtatcaaaacaaaacaaacaaaacaaaacagtgcctggcatatagtatgtgctcaataaaagttgtcattgttattgtcatgacatcatcagagcctagaacaaatcacaaaacctgtatattctctctgggctggaggtcttaagattcttctccattcccaacgggtactcccgagatgacgtgattcatggccattccttccttccttcagtgtgtggctcacactgtgctgggctatggcgtcaccactgtcaatacgacaaataaatggataattacagcaaagtgttaggactgctgtgccagacacgagtgcaaggtgtcctgggcaaccagggaagggacgttaacttacactgggattggggccctgtgatggtaagcttttcatcttgcaggaaaccaggggatttttttttttttttttttgagacaaggtcttgctctgtcgtccaggctggagtgcagtggcacgatcttggctcactgcaacctctgcctcctgggttcaagcgattcttgtgcctcagtctcccaagtagctgggattacaggcatgtgccatcactcttggctaatctttgtattttcagtagcgacggatttttgccatcttggccaggctggtctcaaactcctgacctcaagtgattcgcctgcctcagcctcccaaaatgctggaattacaggcatgagccgttgcgcccggccttgaaaccagggaatttaatgacatttaaaaatcatttattaagtatatatgaaatatatagaaaatagtatcccaggcacctaatagaacagaataataataatgactaggagttgttgagtgtaaaataggttgcagtcattacaacgcatataatagcatgaagtatatagctcctcagccctctcagccatcttatgagggaacactgttgctattctcatattacagatgaggaaactgaggctcagagaggttaagtaatcctccaagcctccgcagccaggaagtggtatcactttgaactcaaactcaggtctgtttgatcctgaggccaagcccttggccagaaaaattaggaagtcatagtcccttcccttaaggagctctatttaatatagcagaacaagtaaagcaagtacatatctctctaaagtatactgtgtcactgaagataagaaaggaagaaatcctgtgatgggtcagatgaagtcaggaaaggcttctgggaagaggtggccttatagatctaactagaaggatgaatgagctttgggccaaaggcaagggagggaaccatctggacaaagggtagttagtacacactgtgacctgaagagggagctcaaagcccccctccactccagggctgatgtgaggatgtgagttaaggacttggatgctgctcttggggctttcagagataggggaggagcttaatgacctcgtcttcatgatataccctaagcattctctcttggctttccatttgagacttactctgccttcagacctctcagaactctgcatatctggtatggtaagaggagcctgagctacctcttctctgcattgccttgaaaacaaaacatggccgggcacgatggctgacgtctgtaatcctagcactttgagaggccaaggcgggtggatcgcttgagctcaggagtttgagactagcctgggtaacatggtgagaccctgtctaaaaaaaaaaaaaaaaaaaaaaaaaagacaaacaggactggggaaaaggaataagaggagcccgtccaaccttccaatttccaccaattttaatgtggatccagaattgagaatgctagtctagctcaactcaacagggccagtggttctacttgtgattgggggtaaaggtcctagggtagtaaagagagtgagtacctgcctggcttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgtcggcatcactgggccctgctccaggatctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgattaagcagtgactacccatccctgccttctcccagcccctggcaaccatcaatctgcttttgtttttaatttttttgagacagggtgtttctctgtcacccaggctggagtgcagtggtacgatcatagctcactgcagcctggaactcctgagctcaagcaatcctcccacatcagcctcctaagtagctgggactgtaggcatgcaccaccatgctcagataattattatttttattttttataaagatgggggtctccaactcctggcctcaagtgatcctcccacctcagcttcccaaagagttgggattacaggtgtaagccaccacaaccagccaatctgctttctttaactctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcactgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacggtggtacaatgttggctcattgcagcctcagactcctgggctcaagtgatcctcccgcctcagccccttgagttactgggactacaggcgcatgccaccatgtctggctaatcgtgaaaattgtttttgtagagacaaagtcttgctatgttgcccaggctaatctcaaattcctggcctcaagtgatcctccctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccgggcgtggtggctcacgcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttccgaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaataaaacattttggcttactaaaaaagaacaaaaagaacatgtatttaaaatcagtaggcaacagtgagtcagtgaggatgttctgagagtaggaatgacatgataagatctgcgttctgggaagattaatttgtctgaagcttatagggtgacctgaaaggagacgaggaggggagggaaatctgtaaggaggctgatgcaacggtctaagctgctttgtgcaatatggcagccactagccacgtggggctgtttaaatttaaattaacgagcttggcctggtggctcacacctgtaatcccaaaactttgggaggccaaggtggaaggattgcttgaggccaggagtttgagaccaatctgagcaacatagcaaaaacttgcctctacaaaaaataaagttagccaaatgtggtgggatatgcctatagtcccagctactcgggaggctgaggcagaaggctcacatgagcccaagaggttgagactacagtgagtcatgattgcaccacgcactctagcctgggtgacagaacaagaccctatctcaaaaaaaaaaaaaaaaaatttaattaaagaaaattaaataaaatgcaaaactcaatttttccaacacaatagccacatttcaggtattcagtggcctcatgtggctagtggttactatactggacatcaaacacttccattattttagaaagttctattggacagtgtaactgtaataggttcactgcccaatgcatgcagcaagtcaatacactaagccactgagttgcagcagagaaacaggtttaattgtagggaagagacaggaggaaacctcaaatccatctcccagaggagtctggggctaggatttttaagggttttgcagtgggctgaagtgtggagattgttgattggtggaaaagagcaggatggagtcatgggacagggagataaagaagctgtgttctcttgctgattcagttcctctgtttggggtctttaaactggttggcatcagctattctgctggaattcaggatctgtttaagcaactcttaaacaaaagcctatgattctaatgtcagaaatcctatctgtaggaacaacgaggttgcaaatggtcagtatccagtgttacctgacttttagttgcaaggaagtgggtcaaagttagcctgattaatgctgaattgtaactatatttctgtccagaattcttcctaccctggtgaggctggcttcaacaacactggtcaaaagcagtggttttcatacatgagtgtcacatcagagtcatctggaaagtgtgttaaaatacaggttgctgggttccatcctcaattcagcaggtctgagcagggcctgagatcatgcatttctttttttttgtttgttattatactttaagttctagggtacgtgtgcacaatgtgcaggtttgttacctatgtatacatgtgccatgttggtgtgctgcacccactaactcgtcatttacattaggtgggaggaataacattaggagatcatgcatttctaatgagttcccaggtgatgctgacgctgctagtctgggccacaccctttgagaaccactctctgaaacaggacttctcagtcatggtgtgagggaaaggggagttgtttggagcatgtgaaaagccttatttatatgccccagttaagcccaattgggatttggactcagcctctttccaggattggcagttgttggcagatgtacaggagtgcttttggcttttctggttaaaagaggtgaaaggtggggctaattcagagtatggagatcagaggggtgaatcatggagcaaaaagggggccttatctgcttcttcatccattctctctgtcatcctggagctcagcttttggggcctgatagggagaaagacgagacagaagctttcagaactgagaagtcagaattcactggctttgttcctcactaataccttgacaactttctccctaaggcagtggatgactcacgtctagctgcatggtctggggggaggagcctcagggtacaagtgacagaattcaatgaagtgcaaagtgggagaaacaggcacttcaaacctcaacgtattaccttgctacaagtgtgcctttaactcactgtttgagtcacagaaggaaacagcatagggcttgctctcagggagccggagtatagcatctgctgatggccagggtcactggaatatttgcctctgtctgggcagagtttagaataacaggcagaggcatagggtgggggctgtgccggaactctgtctatctcatctgtgtacccttttatagatggtcatcggatttgtatttgcatctcagtgtagtcagacattcttccagaacactccagcagtgcttctgtgcctgctggaaaatagctgcagctctctcctgaggcagctcttcccacagtcccagctgctcccctgggatcctccttggacctccccatagcctggcaagtaaacttagcacctgggcatatcagggggcctctaggaccctgttccagtactgagcacagcatcagtactggttagcttgtgcttgggctgtgccatttggaagtattttgaagatgcacatgcacgtgtgtgtgtgtctgtgtgtctacggtggtgaagaatggagggatgtgggatggggcagattcagtagatgccttgagatatggatagtttggtaaaattatgataataagaaaatggaaaggatgccagtttccttccagctagttaagacccattactttactcattgacccacctaacccatccatccatccacccatgcattcatctctccatccatccatccatccatccatccatccatccaatccatacattcatccatctaatccatccatccatccacacatgcattcatctctccatccatccatccatccatccatccatccagttcatacattcatccatacattcattcatctgtctaacccatccatccatccactcagccaactcatccatccatgtaatcatatatccgtttaggataaatgtatccagcactctcttttagtgcttctgtgtgactgaggatgtttgacaatgaaaggaggaagcattcatctgctgggaccccttctaacagatgttttcttctcccttcatccctgaacaacagtaggagaaacaggaaacttgtcttcaaatggtagcccttttccctgactgtctgaggatcatggtctgagaatgtgcctctcagtttttaaaaatccttgaattccatgattcagtgatgtagttaatgtagacagggctcttctatcaaagcagggagcctattgaagatatgagaaaatatgcactgtttctctagagaagggaagtaaacccgccttcctcagagctgggaaggcttttgtcccaagcttctgaaaattaaacccatcacttaacgttctcactgagcagattgcggggcttctggccctatgctgcttgggttgtgcagagctgccgacagacagttttgattgaatgtccaaattaagctgccaagcagcgactctgcagctccagggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaagtaaagctaacttattggatgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaacccagatcttccctgtcgagggaaatggtctctagacttgtggggttgtggttgtgtggagtcagagtaagtgtggagcaacgctgggaactgtaggaccctgaatgaccagggaaaccgctgtagaaaatagttgacactaaactgggtttagggggtcataaaacctccaagatttcaaagcttctgggtcccaggaggactcagttactgagcacaaaagttgcatggttttggtgtcaggcctctgagcccaagctaagccatcatatcccctgtgacctgcacgtatacatccagatggcctgaagcaacggaagatccacaaaagaagtgaaaatagccttaactaatgacgttccaccattgtgatttgttcctgccccaccctaactgatacgatatattctcccccgcccttaagaaggtactttgtacacctatcccaaacctataagaactaatgataatcccatcatcctttgctgactctcttttcggactcagcctgcctgcacccaggtgaaataaacagccttgctgctcccacaaagcctgtttggtggtctcttcacacggacacacgtgacatttggcagtgttgcaaaaccctcagaagtccgagtatcagctggactgaaccttggggcacccgcgttgtgtctagttccagtttgttaagaattaggtgcacaagaccagccccccttttacacaatgatttctttctctcagatttagagtaacatttttttttctaactaaaaatgtaattaatgctcaactgagaccatatattgaatgtctccttcttccaaattcccactgaagtgacaaagagattaaaaatggaaaaaaattgatcagggtgacaaaccagaaaaatggtatcaatcagatgccagaatctttggggaatttttctaagatacaattcagacaatccaagctgattttgtgttctcttttccaacatctaagcctcttatacaatacttttaaaaaatgtaattgcgttgattggtactttcagaacaatgttaaattatgatagtgatggtgggcattcttaatttgattgtggccttaatagatatgcctctagagttttacccgtaagcataatgaaggctgttggtatatttattacgtcaagaaaagcattcatttatttctatttttccaagtgttaaaaggacgaatggttattgaattttgtcagtcgcctttttcgtcattttttaagataattatatagtttttctcctttgacctagttttatagtgaatcatattattaatagattttctaaaattatgaaagatttttgtttgaagagtgtgcgatcggtttctagcttttgaaagatcactttggtgggggagtgaaggaagggctcaatagaagaccacaggcaggaaaccaatgaggaggatcttaatttcacccagagaggaaaagtgagtggccagggagcaatcatatgagcagctgctgtttatgaatcactcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcgggggagcaggaggataatgagcgttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatactttgtggaatccagattaaaaagtgcttaaaaggaaatttatattggtaaattctaccaacacttaaagatgaaataatactgattctcctaaaaagtagatgagaagggaacatttttcaacctattttatgaggctagcattaccctcataccaaaaccagacaaaaatagtacaagaaaactacaagcaaatatctcaaatattttcttccagttcgtcatttgtgttttgcagaacaaatgtttttaaactttaataaagtacaatttatcatttttttcttttataggtcatgtttttagtgtcatgtgtaagaactctttgtaaacataaatataaaaatcttcatagaaatattagcaaattaaattcagcaatatataaatgaaaaatacactccgtccaaatgagttttatcctgagaatgcaagctggcttaataataaaaaaaaaaatcaaccaatgtaatttaccatattaataatctaaagaaagaaaaaaaattaacatatcaattgatgcagaaaaaattggacaaaactcaatattcatttatgatgaaagttctcagcacactagaaatagaagggaactttcttgatccaataagaagtatctaccaaaaacctgtaacatacttaatgatgaaaaactgcatgctttctcattaagctatgaaacaaaactaaaatgttcatcctccccagtcctattcaacatcatgtcataaccagcacagtaagataaaaaaaatttttaaaggcatgtggggctcggctcggtggctcatgcctgtaatcccagcactttgggagcctgaggtgggtggatcatctgaggtcaggagttcgagaccaacctggccaacatggtgaaacccccacatctactaaaaatacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgagtttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatcaaagaatacctaaataaatgaagagataacccatgttcatggattgaaagactcagcagagtgaagatagcaagtcttacgattgatttgtaggcttaatgaaattcaagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggacggtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaaagtggtaaattgtactttattaaagtttaaaaacttttattttgcaagaaacaaactataaactggaagaaaatatttgcaaatcacatatctgacaaaggacttgtatccaactcattgtatcagaactctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatgttatgatactaaaaagtaatttaaaacagtagactaaatcaaagtgtgtagaagcagtagatagaggagtgcctactgcagaaaatgtaataagtaatatggaaacaagcttaaggagtgctccaatggggatggcaggggaaagggacaaataaataaatataaccactaaataaatgacagatgtagagaacaaatagcatttatccatgggtaaatgagtatcagatactcctagagaaaagaccagagcaaatggaaaagcatctatactgtattcaaagtagagttcaagacaaatatataatatactatataaaatgtgtcttttatttatggtaagtaaagtctggggacaaaaagtaatcatgaacctagggccaaaatgcataaagcaaaaacttgaaatgaaaggagtaatttacagaaataccataatagaagggctttaaaaacacactttgtcagtcttggacagataaaagcggttaagaaaatggatatagataatttaaataatataattagagtgaatataaaatacctctctatcttgaatcctgaacccttcaataaaagaattacattttttccctagtattcacaaaattagtgatatattaacttgttaaggaaacctcattaaattccctccaaaatgcccccagaaattgctcagcccacattttccgataaaaataaaacagaactagaaattaatgacaaaaacatataataccaaagatcaatggatgagtgagatggaggtaggaatcagatgggagcctcaagaattgaaatcttgaaattgcttctgtaaggaatgggaaattaactagggacacccaataggtttgacaagcagtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaaaaaagccaggtaaagggagtagagacataaaaggataaactaccactggagagtttagaggctatgccatatcaggtgaaactccaaatgcctggactggagtggagaggaggtcataagaagaatggatgatacgtttgacttcacgtcgtctattattctcagacctcctccaagattcatttgtatgaaaatcacattggagggatactcttttagccctggaatttatcttgattgttacataatttggtctaaattctctgaaaggagaaaggaaatcaacatttgttgagcctctgccatgtgccttacattccactttgacactgttatcctctatcattagggtagtcatataatttattgttaaaatttggactctcttaagagtgagaggacaacagttctaaattgaggttgctctgggaaaactgggatggatggtcacccccactattatccaagagcccatttgagttgtctgtgtaggtttatgagaatttgggggtggggagacaaaggctcagagaagccatttgagtgagatcacccagttagtgagagtcatggcagaggtagaattgacaaccgtgtctgcctgactctgaggtctagccattgctaacttagttcctgattcaccacgctagctctccaccattgtttcactagctgtggcttgacaggctctcttcttgacagacaccatgacagtcccagctggaagtctgtctcaacacagataattagatgtgtgataactgtaccactgccagcaatgatgggaagccagctgttctaggagcctttgggaccacgatgtgctcgggaggactttgatgctggatgtgggctgcccaaagaccccacgtttgctggttttgtaatcagagcctatcaggtgaagattatacagcatggccagttacagaggctgggaaggggattctgagggatttcagggctcataaaagccacagcatcagagaaccttggggtcagaaacccccagggttagaagaagtaataagtaaacaggaatcgatgggacacaaatctagattgtagagcaaagggctaaagaagcttccaacttgggaaggtatggcagggcaggggggttcaagcaaaggaccaggtaaactgtcagccaccaacagataactgaaacaggagaggggcagggcaggacagtgaaaataggttgatggatctgaaatgattgacctgtttagtctctccctccaaccctggttagggcatgtgctgaggatgtccagctgacctcaatgagcttatcctgggtctgtgtgttattcaccacggagctcattttctgggttctatgatgcaaaccaaaagtttttaagtatcaccctgcggatccaattaccctataaactctttggaggaataggatggggtctctgaaagccagggcaatagattcttggaaactgtaaaagcacaactgaatttgtaaattgttttaataacacaattaatacaagaatacattctctttgtcagaaatttaaaatgtgatggataaagctaaaatctttattcacaaccctcaaatcaggttcctctacctgttcctcagaggtggacattattttaaatcaattttgggtatatcttttcagactcttttctatatatttacattcatatatgaccttgtagaaaatgcattttactgtacctttcttttaaatatttggagggcctttaaaatttttttattctgacataatctcaaaatgacagaaaattgcaataacagtaaaagaaatttctgtatacactttacctgatgtactaattgtttatattttgctccatttggtttagcattttctctactaatgtatttttatatgtgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacagttcagctccagatttcactaattgaaccactaatgccttcacgcttctttcttaaacaaagaggcattatattgccctcatcttcttttttcaacgtgcttcatcttgcttttttcaacacgtttctgcatatagataacccaatgttatcggcatgggcaaagtgcgtcacagtatgaatgcgccatatattatttactgtttcccccattggtgggcactcaggttatttcctacttttataattgcacacatcctcaggctgaatattagtgggtattactttggattaatgttcttttatttttccttaataaatccttcactggaatgaattactgttttgaggacacacagtgaggacaaagcaagactcacaatattgaggaaagttccttcaaaaggagttaaataagagatgctcctgattcacataatgtgggatcgggatatgaaagcagcacaattattctgagttttctgacagataattgtatcttcttagaaagaaaaaacaattaaggaacttcttggtgaagaacaattcttggaaaaatagttaacatgcatgctatctttttatggattcagtgctgtcttagagaacttggaccagaatgcagaggcctcgcttgctccaaagacccttagacagaaacaggcagacctcaccctgcacccagagccccatgcccacggcaagcagtgttctctggaccaggacacgcttctcctgtactctttgcaaacttccaccagtggggacgtttgctatttctgctctgtgtgaagcatttggtaccatctgggctggctgagtttcaacaaagatagtaaagaaacatttatcaagaaaaatcaaagtcggtctcgccaagtgtggtctagagagatttgcttccgcgatacatatgcggctctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagattcccaagaaaaggtcattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaaaattgctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataagactggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgtgtcactccaagatcccagcctagaaactggtacatgttattttccttggaaggctcaagaaatgaaagtaacagttggatattatattctatggggaaaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgagtaaacatcgaatgcattgttaagaagaaaaccacaaatggttccatttgatgtcagtacgtgtggaaatggttaactcttcataataaaaatagacaaacaggcaaggcatggtggctcacacttgtaatcctagcactttgggagaccaaggctagaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgaggttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatgttgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagtaaaataaaaagaaagaggggcaagggagttgagggtctttccaaaggagtagctaaaatgcaccataaaattgaatctggatatgaatggagtaaaagcaagagggaatagggagatcaagagaatgtgttgggttcgagggactgattggtggagaatggactgacgaataggggaagatttattgcagtagaataatagaactaatgaattggaaaaatagaaattggtgtaagatagtagggtacttgaaactgagattgagaaagtggtataatttctgggataataggctccagagcgtgaccatggtaggagataactatgattgggggtgagcaaaggttgcaggaaatgagggggtgctttctctcctactttccaatattctttcttctaatctgtttttcttgttatcttgagtttacaaaatttctggttttatttatgctgtggatatttttccagccttttccctatgggctgtctgggtgcaggttatgggtgatacatggataataggtgcatcttggtttagagggtaactctttatttcttactgcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcgatttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcatgccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaacgtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcagcagtattcacaacagccaaaaagtggaaacaacccaactatgcatcaactgctgaatggataaacaaaatgtgggatatctatacaatggaatattattcagtcatgcaaaaaaatgaagtgctgatacatgctataatgtggtgaactttgaaaacgttatgctaaatgaaagaagccagcctttcctgtgggctttgtggaaaataagcttagaaaacttacagttaatcttggtatgggaagagcagtgtaaaagtcagaaatccatttttaaccaacacagaccagagttgacatcttatcagcccatctcattttgtgcactgcttcagctatggatgttaataaaattaaatttctcactaaacaagtgtgatgccaaagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtggaaatgactgcagtgagcatgggtggtggaggttgggttatgtgccacctgaaatcagggagttcctcctcccttagctcctgtttccttccttccctacctccctccttttctgtcttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtgacagcctctctagagttgggtttatggatgatgcttggcctgcagccttctgggacatctccaccagcctcccttgagggtcttccctggccagggctccaagaatctgggagtctctttcttgtacatctaggcatcaggagttggttataacagccaattcactgagcatatatgatgtgtgacaaacactgggttaagcgatccgacttcatcggctcattttattcccaatgtagcaatagggcttatagaggttaaagagtatgcccaaagtcccatagcaaatatggggtggagtgggattcagcttctggcagtctgactttagcggtcatacttttttagccaccagctagaagcacagttccttgtcctgtctcctcttccctctctcagggcaaagctgggccccttctcagcctcagtcaaggacatgtctcagaacagacaatttccccaggatttttctccatgcatttcctcagcctcattctcaacccacctgtgtgcagatatacacatgtacacacccaattatgcaattgatatctgtatttcttataggcaataggaattcctgaatatcctgaaccctattaagacataagataacaaaagtagttagaactgttcttgtcatagccagtctaagacctctgcctgtttaagccacaggctgtcaaacagaaaaagctctcactccctggagagctagcctgggatggaaactgaatatgtttctttcagcagcttgtaatctttaaaactttctacctccaggtcttgtcctcttgtacatttattctgcttgagaaattactacaacctccactgatgtcttttctttttctctatgcagtcagctgaaagaatcggacaaagacagaagactgtcagtagagatttgggattgggatttgaccagcaggaatgacttcatgggatctttgtcctttgggatttctgaacttcagaaagccagtgttgatggctggtaagtaagattttgccttgaaagctaccatacagcttgctccatcaaacgcggggtcaagtatgttttcctttttctccaaaaattgaaatactaaaacagagtcccaaagtgaagtctggttgattggatctgccttgcagatatgttttgtttggtccttgtactaaaaacaaaaaagaaagaggccaggcctcgtgtctgacacctgtcatcccagcactctgggaggccgaggcaggtagatcacttgagctcaggagtttaagaccagtctgggcaacatggtgaaaccccatctctatcaaaaacatgaaaaattagctgggcatggtggtgtgtgcctgtagttccagctactcaggaggctgagatgggaggatcacttgaaccctggaggcagaggttgcagtgagcaaggtggtcagagattgagccactgcactccagcctgggtgacagagtgataaaaaagaaagagagagagagagaaggaatgaaggaagggagggaggaaggaaggaaggaaggaaggaaggaaggaaggaaggaaggaaaggaagaaaaagggaaagggaaaggaagaagaaagaaagaagaaagaaagacggaaagcaggaaggaaggaagggaggaagggaaggagggacagaaggagggagggagggaattagttctagtattttaaaaatctggggctagaaggcaacaattgagaacagttgaatagttaatgccccctttagacaggacatggattttctatttgtcaccgtcctcaccactccctattttattacatctgggccaatttactaaactacatgatgagactgtaactgcccagtggcttctttgtgcctgctgcccagacagagccgatttatcaagatgggagaattgcaatagggaaagagttttacacacatagagccagctaaatgggagaacagagtttttttatgactcaaatcagcctccctgaaaatttggaagctagggcttttcaaagatagtttggcaaggagtagggtggctagggaatgggtgctgctgactggttggggatgcagtaataggggtgtgaaaaatggtcctcgtgcactgagtccacttctgggtggggccacaggactagttggcaggtccaggtggggcagtctggttgtcaggaaggcaaaagcctgaaaagacatctcaaaaggccaatctcaagttctacagtagtgatgttatctgtaggagtaacttaggaagttggaagtgttgtgagctctgggataaaggctgataataatccatgtctacatcttagcagaattcaggctcctttcattctcctaacttggcaatatttcattagttttacaaaggcagtttagttttgggaaagggctgtcataatttaaaatatacaacaaatttctttcaaagttaggttggcggtctggtcggggtggagccattggttacgagaaatgcaaaaaaacctgaagagacatctcaaaaggccagtctacaatagtgatcttatctgcgggggtcattgggaaagttgcaaatcttgtgacctctggaataatggctggtaatcctttatgtctacaccttagcagaattcaggctcctctcatcctcctaacctcatggtccctcattagctttatgaaggtagtttagttttgggcaagggctattatcatttaaaatgtacactaggccgggcgcagtggctcacccctgtattcccagcactttgggaggccgaggtgggtggatcacgagatcgggagatcgagaccatcctggccaacatggtgaaaccctgtctgtactaaaaatacaaaaattagttgggtgtgctggcatgtgaggatcacttgaaccagggaggcggaggttgcagtgagccgagatcatgccactgcactccagcctgggtgacagagcaagactccatctcaaaataaaatgaaataaaataaaataaacactaaatttgtcacaaagttaacttggcccgagcccaggaaagcgtaagggcagtttggaggttaaaggcaagctgggggttggttagatcaaatctctttcactgacgtcatcattttctccctgttacaatttctgcaaagacagttccatgactggctccatggacactagagtggcttgtacacttcacctgaaagatatgagcaacccactgtcagatggtgtctgagaagctaccgcttccttgggagtccttagcaagtctggccacagatcatagatgtactggggtgttgttttcatagtcagctgctgtgtctcctttgtcctgaagattttattttgctcccttcctatggcaaaaaaaaaaaaaaatatatatatatatatatatatatatatatatatatatatcctccaatgttaccaacagagaggctgggtaagcccccttggcaactgtttcacagttaactgagtcaaggagtcagaagaaatagcttaacctggcactataactttgggagaagtggcaattgggctgctattacttctttaagataaattgtctcatatctgaattgtctcattcaggaccttttcagcttcaagtgaaagaaaataaaaatcaaactggtttagcgagaaagagatgtgtcctttggaccacacacacatctttcctttccattgttcaccttatgacttccttgtcttggctccatgtttcatcttaggccttttttttttttttttttttttgagacggagtcttgctctgtcacccaggctggagtgcagtggtgtgatctcggctcactgcaacctctgcctcctgggttcaagcaattctcctgcctcagcctcccgagtagctgggactacaggtgcccgccaccacgcccagctaattttttgtaattttagtagagatggggtttcaccatgttagccaggatgatctcgatctcctgaccttgtgatctgcctgccttggcctcccaaagtgctgggattgcaggtgtgagcctccgtgcccagcctatcttaggcttttcttgaaacatatattgagtgtccactaggtgctggtcactagaaacacatggaggtataagacagacatgacttcatggagcttagcttatggcagagggtgggttggggagataaacattgaacaaggaattacgcaaatgacaaatcaatgacaacatgatggaagatgtgaagaagacaggagctgagagttttgaacccaaaagtatctgagacagatttcaatcagtttagaaagtttattttgccaaggttaaggatgtgccagtgacacagactcaggagatcctgatgacatgggcccaaggtggatggggtacaacttgcttttatacattttagggagacgtaagacatcaatcaatacatgtgagatttacattggctcaatctggaaaggcaggacaactaaaagtgggacggggaggtgcttccgggtcataggtagattttacaattttctgattggcaattggttgaatgagctgttatcaatagaaaggaatgtctgggttacataaggagttgtggagaccaaagttttatcatgaagatgaagcctccaggtagcaggcttcagagagactagatggtaattgtttcttatcagacttaaggtctgtgttgatgttaatgctggttggcttttcctgaattccaaaaggaaggggatataatgagacatcgtgtctgactctcccttctcatcatggcctgaaacagtttttcaggttaactttggaatgcccttggctgagagaaggggtccatttacatggctagggggcttagaattttattttggtttacagaatgtaccccaaaagagttgtgttaaagcacaattcacaaatggttaaaaacatagttctcataagatagataatgggcattaatgggcattggccaaagatttccttagctcactaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcacctgaggtcaggagtttgagacgagcctggccaacatagtgaaaccatgtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatattactgtgaggaaagaaatagctaattagaaaatgctctagcatgacattaaaagttcacacggtcatctttttggttttctttttcccccaagctttggatatttttccctaacatgcaaatgacttgactttgcagggtgtacatcagttactcacagtggatgtttcattctcattttaaatcaaacttaaagaggttaaagagaaagaatgcatgatcctcagggggtatcagtgtgacaggaggaaacataataataataattataataacaatagctactactcattgactcttaatagatgccaggctctgggttgagcttttccagatgtcgtggagtcacaattttacacagcactgatcaggtgtgcagaaaaaataaagcttatttcttttctataatggacttagactttctcatgcacttttgtgagctcctggtgaccgaggagaagggactctatatgctgcatgtggtactttctgagcttcactgtttcacttttctgactggtcactgttaacagcaaaacccagctctgtaaaatattttaaagaagtttattctgagtcaatataagtgactgtggcctggggaaacacaaacccaagaagctttgaataagtggtcctgaggtggttagattacagtttggttttacatgttctggggaggcagaagttacaggcaaagacataaatcaatacatggagattatacattggtttgggcccaaaaggcaggatagctttaaatggggcttatgggttataggagattctttaatttgcagttggttagagtaagactttgctaaaacttggagttaacagaaagaaatattttatgttggctgggcgtggtggctcatgcctgcaatcccagcactttgggagaccgaggcaggtggatcatttgaagtcaggagttcgagaccagcctggcccacatggtgaaaccccgtctctactaaaaatgcaaaaaaattagcaagttgtggtggcacatgcctgtaatctcagctactctggaggctgaccaggagaattgcttgacgcaggaggcggaggttgcagtgagctgagatcccgccactacacccagcctgggtgacagagtgagactccatctcaaaaaaaaaaaaaaaaaaagagtgtttaagttgaggatgctgtgcagcaagatggcttgcttatggtgcaacttcacctttgcctggcctggcgttagtcctgtttataatctgatattttattgccacaaagagtctgttttgtcagtcttatgatctctactttaacattcatgtcagtccattgttgtatataaactcccaaagaaaggaggcataacaagacgtgtccaatctcctttctctcatggctgataattctgtttttaaggtttttcttagatcctcttggccgaggagggggtctgttctgtcagtggggggccttaagattttatttttagcctacgttcctaaaccagcgcccactgaagtgggactggtcccacctagctttggggcatcattctggctttgtgctgaagatcctggcctgttgcttctccttgtgagttccctccatgcagcaccctctctgtcccactcataggccactgctgggcctggttcagggaggccaggaacctgcctgagtcctccccctgaggagtcttttctgctccttctgctgctgctggaatgatgttgcctggtgcatggataggtctctggccagcgttccagccgaggaggagggaaacccacctctccccaccacctgtcctttctccttcccaaggttctccaagccccaaagggaggggcttctcctacaatcacccaatgagttcatctagagctgattcactgagacggcaatattttagcagagaaagagtttaataaacacagtgccagccaagctgaaggatgggagtttattactcaaatcagcctcctccaaaattcaaagactagggtttttcaaggacagtttagtggtaagtgggggctagggaatggggaatgctgattggtgggttgagagtgaaatcatagggggtcaaagctgtcttctcatgttgagtcagttcctgggtgaggatcacaagaccaggtaagccagtttcgttgtatggattcccagtctgggttgcaccagctggtccatcagaatgcagggtctggaaaatatttcaaacaccaattttaggtctataatagtgattttatctataggagcaattggggagatcctgaatcttgtgacctctggctacatgtctctggagccagaattctaactttgtggctaatatgttagttttacaaaggcagttttagtccccaagcaaggagatggttagttttgggaaggagctgttatcgtctttgttttaaagttaaacgaatggccaggtgtggtggctcatatctgtaatccccgcactttgggagtgccaaggtgggaggattgcttcagttcgggagttagagaccagcttgggcaacaatgagatcctgtctcaacaaaaaatttagccaggcatggcggcatgcacctgtgctcccagctactcaggagcctgaggtgggaggatcacttgggcccaggaggttgaggctgcaatgagctgtgattgtgtcatcgcactccagcctaggcaatggagaaagaccctgtctcaaagtaaataaagaaacaaatacaaataaaaaatgaagttgaactgaaactaacttcttcccatagttagcttggcctaggcccaggaatggacaaggatagcttggagattagaagcagatggagttagttaggtccgatttcttacactgtcatagcttttctatgtcatatttctcttactgtcataatttttgcaaaagtggtttaactcccacacatgccatatccttcttcctgggctagtgcctgccttgtctactcccctaaggctgagagcagggaagaaaaaaacggcttaagaatagggatagtgtatcaggagtaagcccaaaatattactgcatttacacttagatgatcatttaattctccagttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttcggctttcctgactggatggatgctttgtgacctcaggtgagccacttcacctctctgtactacagctttcacagcagatatgccacccatcagattgattacaacaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccctgggattctttgaacattatgtgatcttgagcaagtctcacaccctttctgaaactcagattcaccatttagaaggggatgggctccatcagctcttctgttgtgctgtaattgaagaccgtgtggcagaaacagcagatgcagctgtggaagctatcagatgtggtgcaccagccccaggccccctgtctgcctcttggccaactgccctgtatctgttgacaaatccgcctctttgtttctaattttgtttatttatactgtctcctttctttccccttcattttccagaggttcatctgttttatttacttatttattttcttcaaggaattaactctgggatttgtgtatcaattttgtttgttttctccttttctgtaggtttattttgtgtttggctttgactttcagttgaacattttactaatttattttttcttctttcgcctgactctgctctttaaaaataatgaatagcttttttgtttgtttgttttgagacggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaataaatgtttcctctgagttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaagattatattagctattcgtagagtatacttttttgtggagaaagaataaaccttttttcaacttttattttagattcacgggatacatgtacaaatttgttacctgggtatattgcatgatgctgaggtttggggtatgaatgattccgtcacccaggtactgagcatagtacccaacagttagtttttcaatccttgtcttcccctcccctctcccctctacagttcctagtgtctgttgttgtcatctttatgtccatgagtgtagggtatacatttattcattccaatgtattataaggtccagatcttttttttctgaggcggtgtttcactcttgttgcccaggctggagtgcaacgccgcgatcttggctcaccatagcctccgccttccgggttcaagctattctcctgcctcagcctcctgaatagctgggattacaggcatgtgccaccacgctcagctaattttgtatttttagtagagatggggtttctccatgttggtcaggctggtcatgaactcccgacctcaggtgatccgcccgcctcggcctcccaaagtgctgggattacagatgtgagacaccacgcccagctaaggtccagatcttttataccttcatattgtccttttgtttgcttgagctaaatgtgtagtgtttattaagtttcttcaggcaaaatgattcacaaacattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtaataaaacatggcatgtttgaggctgataagtgtcatagagaaaagtaaacaagaaatggggacaaggaatcttggggagtggagacattcagattttatagggaactcaggaaagaactcactgaaaaggtaacatagagcaaagatctaaagcaggtgaggagggagctgtgtggatatctagggagaggttgtcttaggcagcgaggacggcaagctcaaaggccctggggcaggagtgcacccggcaagttggaagagcagtaaggagactcctgtagctggagctggatccatgaggggagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtctaatctttctaagtcctttggtcttgtgtaacaagcggcacgttgttggatttttttttttttatttttgagacagagtctcactctatcgcccaggctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggatacatgaacagaaagtgcaggtttgttacataggtatacatatgccaggtggtttgctgcacctatcaacctgtcatctagatttcaagccccgcatgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagctttatccatgtccctgcaaaggacatgaactcatccttttttatggctgcatagtattccatggtgtatatatgccacattttctttatccagtctatcattgatgggcatttgggttggttccaagtctttgctattgtagctagtgctgcaataaacatacatgtgcatgtgtctttatagtaggatgatttataattctgaatctgaagatcttttttccacaggaaaatgttttaatgtttatagctataattgccatgtttcttatggtgtttctaaagttttctttttctttcctatttcattctttttttttcatctccttctaaacagataactattatcttaaatcagtgttatattacttttttttaaaaaaactttctgttattattaataatcacattttggtcttattacaaaaaaaaagcaaaaaacaaaaaacaaaaaaaactaatgctttggaatcagacttcccgggttagaatttctactgtaccacttcctagctgtgtacccttggcaagttacttcgcctctctgtgctgtgtttcctcatttggagataatagtcgtaattatgtcacaggattgttgcagtatcaaattagttaatataagtgaggtgcccaatgtctgctaaatagcactcagtaagtgttagtcattattgttaattgaataattattagaaaaatataagaaattggagaatttcagagaccccagattcccagtgcccataaccactattgaccctatagagagagagagtgaagcaaaaaatgaaatcttactgtgcatactatttggtaccttgcatttttcacctaaaaataatccgcaataaacataattgtggcaaaacttttgtgcccagctttaataatttcctaataaatttctaagcctggaattgatgactttaagcatatacacattattaaagggtttgccaaaatgtcctacaattttaaaaatcaatttacagtcttatcaatcttgtatgaaacttttcagtttattaacattaacatccagtgctataaatttcaaagatatgatacaaagattatacacatattgtattagaaattatgttgaacattttcatttgcatattgccatttgtttatatttatatatgactatgtccttttgcctttttcttattgacttgtaagaactttttatatgagaagaatattaatatgtctttcctgacatatgtatgttgcaacgttcctcctcctccttttcatgttgtaaattaattttggtaatatgcatttttcttatggtatataaagcattcggttcaactccaatctaatatgatagatatcaagccacttgccagaaacatttctcaagtttttcttttcattgactaattgttatctgaattatccatgctgtgttcactgtctcaaatgaattttttaattcagtgattatatttttcttccgaaagtagtctttcccactctcgtatttgttcccttttcacagatgcaccaacctcttgaatctcactgcaaatatgaattaggtagtttctagaatgttctctcttttggcagcagttgtatttcatgggagttactttgattctgcattgtttctttctatttaaatgactaaatttttcacacatcctattgtgcttatttgcctatccttatagaagggtgagcacagacatttctgtgtccttgttctaacatttcatatctggataaagggagacaggagtcttttgtattttttggaattctgttttgtcagatcaggagtcctgttcctgacatttgggcggggctacagtggagacaggtccataacaggcacccctcaagccagatggagagcccatcttcctcacgttggttctgtgcatctcaaagtcagaaggggtcctgctcctctctgagggggcacacgtgtcctatttggaggcagtagtggcagcgtccttcactcactctgtggcgtactggccaccgtgaacacacgctgtggcaccatgcccctgcccgctgcgccaggcactgacatgtctcctcttgcatatgaatgggaatcggcaaccctcacccggtcattgatggtctcagccggggtcattattgggctctgttggggcaccttttatggatgacagctggtcaattcccctttatctgtattttcccaagtgtgagaccccaaatactctagatggttcacagtcagggcataaataatattgaattgtgccccaagaaagcaattattttgtcagtgttctttcagttcttcaaattatggcaaagagaaaatctcagaggtctctgatatatcgttaacactctaacacttgctcttcgctgatctcccattaaaaaggggcaggggcaggctttcgattgagagcctttagtaagcaacaccatctacttgcacgtgcataaccttgatttccttgatttccatttgtttatttttttttctttttttttttattggaacattaattaggttttattttcactttttgtttccacagtaacatgtatgggattaggttacagtgtttatttgtccccaatcttttatttatttattttttttattatttttttttaattgattgactttttattttttattttatttttttttaaatttatttatttatttatttattttttattgataattcttgggtgtttctcacagagggggatttggcagggtcataggacaatagtggagggaaggtcagcagctaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggcggccgggcagaggcgcccctcacttcccggatgggggggctggccgggcgggggactgacccccccacctccctcccggacggggcggctggccgggcggggggctgacccccccacctctctcccagatggggcggctggccgggcagaggggctcctcacttcccagtaggggcggccgggcagaggcgcccctcacctcccggacggggcggctggccgggcggggggctgacccccccacctccctccccgacggggcggctggccgggcagaggggctcctcgcttcccagtaggggcggccgggcagaggcgcccctcacctcccggacggggcggctggccgggcggggggctgacccccccacctccctcccggatggggtggctgccgggcggagacgctcctcacttcccagacggggcggctgctaggcggaggggctcctcacttctcagacggggcggccgggcagagatgctcctcacctcccagacggggttgcggccgggcagaggtgctcctcacatcccagacggggcggcggggcagaggcgctccccacatctcagacgatgggcggccgggcagagacgctcctcacttcctagatgtgatggccgcccggcagaggtgctcctcacttcctaggtgggatggcggccgggcggagacgctcctcactttccagactgggcagccaggcagaggggctcctcacatcccagatgatgggtggccaggcagagatgctcctcacttcccagacggggtggcggccgggcagaggctgcaatctcggcactttgggaggccaaggcaggcggctgggaggtggaggttgtagcgagccgagatcacgctactgcactccagcctgggcaccattgagcactgagtgaacgagactccatctgcaatcccggcacctcaggaggccgaggctggtggatcacgtgcggttaggggctggagaccggcctggccaacacagcgaaaccccgtctccaccaaaaccagtcaggcgtggcggcacgagtctgcaatcgcaggcactcggcaggctgagtcaggagagtcaggcagggaggttgcagtgagccgagatggcagcagtacagtccagcttcggctcagcatgagagggagaccgtggaaagagagggagagggagaccgtggggagagggagagggagagggagagggagaggagggagaggagggagaggagggagagggagagggagagggagagggagagagcgtccccaatcttttaagtctattttttttttcttgagacggtgtctcgctctgttgcccaggctggagtgcagtggagcaatctcggttcactgcaacctctgcctcccgggttcaagcgattctcctgtctcagcctcccgaatagctgggactacgggcgcgtgccaccatgcccacctaatttttttgtggttttagtacagatggggtttcaccatgttggccaggttgtctcgatctcctgacctggtgatctgcccaccttggtctaccaaagtactgggattacaggcataagccaccatgcccaaccttttttttttttttttttttttgagagacagggtcttgctttgtcacccaggctggagtgcagtggtgcaataatagctcactgcagccttgaccttctggactcaagcgattctcctacctcagccgctcaagtagctgggactactggcatgcgccaccatacctagctaaatttttttaatttttttgtagagacagggtctcgctatgttgcccaggctgatcttggactcctggcctcaggtgatcctccttcctcagcctctctaagtgctaggatgacagacatgagccaccacgacgacctgtttatctttttgtttgttttgttttgtttgtttttaacaattattttctatttgtaacaagtgatattgaatttccttccaaggaagaaataaaaagtgtcctttaaaattaaatttattattaaaaaagtaaaacagatatttcaacgctgatatacaaatctagcaaaatccacaaaggtagcatctgaatggataaagttaaagtttacccaaaatagctctgttttctttctattactttaatttgtaggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaactttggttaggaatgatctttgagagcgaggagttttggggtcttttttctttcccactgattcaaatgcttttagaatgtcccttttctttcctcacactcatctcatcctcttactagatgaaaaaatctttgtggtcaagaaacaaactgaagcccccatgtttattattatattagtagtagctgggcatggtgggatgtgcctataatctcagctacttgggatgctgaggcaggaggattgcttgagcccaggagttcaagactggcctgagcaacatagcaagaccctatctctgccagaaaagaaaaaaaagaaaaaaaaaacagccaggtgtggtgggatgtgcttttagtctcagctagttgaaagctgaggccggaggattgtttgagcccaggaggtcaaagctgcagtgagctatgattgtgctgctgcactccagccttggtgacagaacaaggccctgtctctaaaataataataatgacattagtcacagtaataataatcatgatgatgccactaattgaatacttgctgaatgccaagtgctgtgcttatcattttacatgcgtcattacatttcaatttcacaagaattctatgaaaaaggaatttgtattccaatttatagatgagaaaaacagaggcccagagaggctaaccagcctgtctaaggttatgagatgagatttgcacccagacatggtttgactccagggcttgtgcgcttaaccactaagggatgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgagaagatcacttgaggtcaggaattcaagactagtctgagaaacatagccaactcccatctctacaaaaaaatttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaagaaaactgtgtaagtgtgtatagagagagagtgagaactttgcctcctatgtacatgtgatatacattttttttctgctgtccatggaagagttacaaaaatacatagtgtacctggtagtgtaccatgcacactacccccacccaacatactgaaaaacaaaccaaaacaaaccaaaaaaccctcaacgtatattttttcaagtagagctttatataggcctccttttcatatgctgatcaataaaataataccgagtcgagtcatgaaatgtgtcccacccccttgtctcccttcaggtttaagttactgagccaggaggaaggcgagtacttcaatgtgcctgtgccaccagaaggaagtgaggccaatgaagaactgcggcagaaatttgaggtgaggtttcttttctttttctcttctttcttttttctctttcttttttccttctttcctcctgctccctcctctttctttctctttctctcttattcttttttctctccttccttacttccttcttcctctctcttttctttccttctttctcctttctttctttcttgcttacttgcttgctttctcgctttcttcctttctctcttgctttctcttgcttgctttctcgctttcttcctttctgtcttgctttctttcttgcttgctttctttaccccccttttctttgttttttccttccttccttcctgccttccttcctctctctttctctttccctctcattctttcttttctttctctctctgtccttcctttgtttctttctctctccttccttcttcctttcttccttccttcctttcctcccttccttctttccctccttcctccctccctcccccctttcctttctttcttcctccttcctctctcttttcattctttctcccctttctctctctcttcctctctcttgtctctctcttctttcttcatctcctttctttcatcagtgggaaccagttaggtttgctgctgtgctgattttcctgtttatggcatggtttctactaagacttttcatgactctgagcctttgcaaggttgttttatctcctagaaaactctgattaatccttcaagaccccaattaaatgcccttgccttatgaagttattcctgcttccctgtctgcattcaggcttagacatttcttcaaaagtgctcattcactgcccaccattttgatggtgacttggactggaatggtagtcatggtgaatgaaagaagtagacagagggccgggtgcggtggctcacacctgtaattccagcactttgggaagctgaagcaggcagatcacttgaagtcaggagttggacaccagcctggccaatatggttaaacccagtctctactaaaaatacaaaaaaattagctaggcatggtggtgcacgcctgtaataccagctactcggaaggctgaggcacaagaatttctctgggtggcagaggctgcagtgagccaagattgtgccactgcatgatcagtaatgctctgttgcccaggctgcagtgcaatggtgcgatctcggctcactgcagcctgggcaacagagcgagacttcatctcaaaaaaaaaaaaaataagtagacagagaagtgatatattttggaggctgagtcaactaggcttgctgatggatggaatctggattggctctattgacagaatgatgctatatagttaacgaatggaattgattgtgctaatgacttcatgaaataccctgggggtagatcttcccagagaatagttttatcaaatggaaagcccttggctgtgaccttgagttacattgctggctctgctcctacctgaaataaatccctttccttctacggggacaaataaacaccattttcagctacctaagagcagcaggtgtataggacacatccttgctttacaaagaaaatgtttgggggaagataggtttgaatacttacattatatgtgcattgagtgattttagtagtttcctgaggaaaagcacattattttgttcccacaaactcaatacactgagtctggtgggagatgatcaattctagataaaccatgatggcctactaactccccaaaaatgtatataatagcatagctaaaatgaaattaatttttattattgttattcatcaaataatgacacacacaaataaaaaaaaaacgtgtaaagaccatgtaaagtcctgggaaagagaggtcaggtaccttgagaacatgtacaagagaaatgtcacgtagtttgagagaatggggaggtgtcaggaaggaaacagcaatggaagtttaccatgtaaaaagaggggaaaatgtattctgttctgcaaacagcatgtgcaaaggccctgtggttgggggttatatagcagcaatgtgagactgaaagaagaccagcctgggtagagcagagaaagccaaagagagtccaaggaaaggctgaggaagtaggcatgagtcacagtacgtagggctgtgctggccttgacaaggattttagcatttatcccaagagtatttatcccaaggactttagcatttatcccaagagtatttatcccaaggattttagcatttatcccaagagcatttatccaagagcatttatcccaaaagtatttatcccaatgattttagcatttatccaaagagtatttatcccaaggattttagcatttatcccaagaatatttatcccaaggattttagcatttatcccaagagcatttacccaagagcacttatcccaagcgtatttatcccaaggacttgagcatttatccaaagagtatctatcccaaggattttagcatttatcccaagagcatttatccaagagcatttatcccaaaagtatttatcccgatgattttagcatttatccgaagagtatttatcccaaggatagcatttatcccaagagcatttacccaagagcatttttcccaagactatttatcccaaagattttagcatttatcccaagagcatttacccaagagcatttatcccaaggattttgttttgttttgttttgtttttttgagacagagtctttctctgtcacccaggctggagtgcactggtgagatctcggctcactgcaagctccacctcctgggttcacgccattctcctgcctcagcctcccgagtagctgggactacaggtgcccaccaccacgcctgcctaattttttgtatttttagtagagatggggtttcaccatgttagccaggatggtctcgatctcctgacctcgtgatccgtctgcctcggcctcccaagtgctgggattacaggcgtgatatcccaaggattttagcatttatcccaagagcccagttaccacacgtggtatatttcagtacgtcagagttggttgcctctgtttggttacggggctttgagttctagggctctaaattgcagacatgaaaaggcagccattagtgagtgtattcctgtttctgagggcacatcgtacacagcaagataaaggacaagtttgtttgttgaaagaaacaaactatcaagtttgttctcccctcaacttgatagaaatagcgcttaggggccaggcacggtggctcatgcctataatcccagcactttgggaggctgaggcaggaggattgcttgagcccaggagttcgagaccagcctcagcaacatagcgaccctacctctattattaaaaaatatatatttaaaaaaaaataaaaaaagaaatagcacttacgtattcccaaattccttgtcttgagcctatgcccacccgacatgctggaagatagtgatagttctgacccagtggggtcctcccttcctgggaacaagtggaacagacacattggccttgagcttatcagtcattctccagtgaccttgataacagaggcttgttcccaaagtcttggactcaagcccaagtgaactgaaaaaagaaccttccctccaagtagaactaaaaactggatactgtttgataaaaattaagacaggaaggcagtctttccagagaacactttctgtctctttcccccaacttgctgatgaagtggtatcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgaattataatcgctgcatactgtacttgttgatttaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgaccgtgggctttggaaaagaagactccattttggatggcgcacagtgggatttctcagagtcttaaaatttatttgtataacaaagtgcttactgtgtgccatttatgattctaagtgctttgcaaatattaactcaggtaatttaatccttacaacaacctagaatggtaggtactattatcacgctattttacttttacaaatgaagaaactgaagcccacagaggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtcggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttgagagccagactgcctagatttgaatcccagttctgccacctccttgctgagtggctgtaagcaagttgctttgtctctctgagcttctgattccctacctgtaaaatggggaattatagcacttcttacctcatgaggttatgtgaggattgaatgaggtaatgcgtttagcagagtgtctcacatgtcatacatatccagatgttagatgctagcatcatggtggttgttataattattgtctcccccttcgggataaataaagctcagaacatcctctttctgggctttggaagggctgcttggaggttagggaaaatctacagggactcctagcctacagaggtccctgccccactgctgggtagctgggagtgcctgtagtagttccttgtaggggtggagtggcagaggaatctgcagttttagccaggacaggcattcatcatcgggagtggagcccagagtctggctgccagggcttctccactgtcccctcgtgctgtctggaaggtggcttggctctttgctcagaaatgctatttgctttctctcttagcattgagttctagggctctaaatcgcagacatgaaaaggcaaccattagtgtattcctgtttctgaaagcacatcccacacagcaagataaaggacgagtttaatttgtgcctcaattttaaaatgttcgctctttgatgcagtgtgtgctaggcattgtccccttggaacaatgggatatttcaaaggacaaaggacagggctcctgtcctctgaaggctcactgagtaggggccacaaacccaggtgttttcaggagccaggcaaacaacaagaaggcgaaagagcttggcatcacccagtgttagcagatccccttcttcaaaagaagctggggatctgggttttcatatctccaaattttcaacagttggcaactaattaaatattaaaatgacaacaaactctgtgcagaccagaccaacagggttatcagacttctttttttttttttccagggttattagacttctgatctagattctagaagttaaattaacatgcccatgagaaaagttataaaagcaagctgggagggagggaggaaagaggggtgccagccccagattcagaggagagaagggagtttctagtgctgagggatgaggctgttagctgctccttgaaggacaaggaaaaaatcaacccctcttcccacccccccaaaaaagtccttatctgtccactacgcaaagtcaaatgaagaaatcaggaagtttgaggtccgtgctcacgtttcatggggagtgtgtgctgggacccgcaggtggatgggaaagttcccaggatgggaaatgggaactggggcaggcaggacttggatcttcacagtctggagaatggagactgtgaatcagatgggtcctgagccaggattcaaagaaggcaggacacatggtgctaaggtgatggggcagcagggaggggagtagggaaagtgtttgggtcaggccagcttgggggtgatgatttaggagggtgtgaggacatagcccgagaaaggtgagacggcttctgtcctaccctggctcttttgtttgcagtttccattgcaaataagatgaccttgtagttttaactaccccctcgttgcctctacaccccaaatctctgtctccagtccagatatctttgctcaagccccaaacccatgtatacaactgcttactgggtatttacacttgggttaaacctcaacatatcttactgcaaagtaaactgaccaagtatattcacagcagcgttgttagtaggccgaaaggggaaacaactcaaatgcctgtacacaggagacgggataaacatcaacaatgagtgccattcagcaatacaaagagacaaattaccgatttatgcaaaaacatggatgcatttcaagaacattttgatgagtgaaagaagccaggcacaagagtacacactctacaatgctgttcagatgaaattcaagaacagacaaaactgacctatgggatagaaactggaacagagattgccttagtggcgggggttgcggggggcgtcgactgggaacttttggagggtgatggaaatgttccgcgtcttgtttggggtttgggttacatgggtgtgcacatttgtcaaaatctacagaactgtgcacgtgagattggtgcactttgcggtgcccacctcaagtttcaaaacatgaataaagagaaaatggcggatgctttgttagccatggttcctatatggtaacagtggaatatgcaccccatgagggagaaataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagaggctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctctccttgataatgcagtgacttcctagtgatcactcagcccacgtgctggggggtctcctctccactcagagtgacctgttaaatatgtatggtcataccatagccctgcttcaaacctttcaaaggctgtctgtcatgctcatagtcagcctgaatttcttaaggtcctttcaacactttgtctgcctcctgtgccatatctgccttgcatttcatgatccagccagacgatgtttcattccttgaatgtgtcttcccctctgttccataaatgctgttcctgctgccaataccagtttatctacttcagcaaccccaacataccttttggacacagtatggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaagcctcccaagtagctgggactacaggcccactgccaccatgtccagctaattaaactttttttttgagatagggtctggctgtgttgcccaggctggtcttgaactcctggcctcaagcagtcctgcctcagccttccaaagctttgtgattacaggcatcagccaccacatccagcctcaataaatgttttttgaatgaatgaatgaatcttccctgatattcaaaactttggaaagatttattttgcctctttatcttcaaagcaaccaaataatgcaacaataataatagctaccattcactgagcatgtgttgtgtgccaggaatgatactaaggactctgtgatacatcatttcatgtcatcatctccatgtcttgaaaaggtgatgaatgtttaggaagcttcaatcaccaaatgcaaattaagtgccttctctgtgccatactcctctaggtaccagggaaacagtggaaagcaaaacagacaaaatccttgccattggggagcttacattctggtataaggagaaagatgataaattgggaaacaagtaaatatatggtttgtaagatggtgacaagtgttttagagaaaatcaagtaagtaaggcggatggagattgctgagagcaattttatgtagggtgttcagggaagagccctcttatcagaggtgagagagttctggggaaagagtgctctgagcagagggaacagcaggtgcaaaggccctggggtaagagcatgtttggtgcattcagagagcagcaaggaggccagtgcggaagtagaaaggaggctgaaatcagaggggctcagtcatctgtggcctttggcttttactttgagaataatgggatggtatatatattgggcagaggaatgttatgacttaactgatgtattctgggccacacagctgattcatgtcagaggattctaccacgaggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctggaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagttgcaaaggatgtccgacaggtttcaggcttgtggagtgatgcatggctatgcttttcatggggacagggtgccggagctgcaggaactacagcttcccattgtgtgcctgtgccttcctacaagatcgtcctcaaaccctgagcatgttttctgtgtgcttcctttttgcagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtatggtatgatttggtggctccacctgctttggaaggaacatctaacaacacaggcacatttgctgttcctatgggacggacgtcctagtgggagagagagtaagaagtaaatagagccacactacactttgtaatgaataccatgaaggaaatgaatggagtgctgtgtcacaaacaaaaaggcgaccctttcagtctgaggaggtgacacatatactgagacctggatgatgagaaagaactagctatgctttcaaagagctaggaaagaatgttctcagaagagagcaagtgcaaaagttccaaggtggggacaggctgggtgcatcctaggaaccatcagaaggtgttggggcaaaatgtcactagcagaaggaggtataggacgtgatgttgcagagataagcagggcccaaggatgcaaaccttataagctacaatgaggagtttgggtttcactcacagtgcagcggggagccattgaacctttttaagcagattagtgacacgatcggatttgccttttggaaaagatcactctgacagccaagaatggaaacggttcctttcaaacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccactgttcctggccaccgccccccacagccatgtacaatgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttctacttcgtagccgtaataattttttaaagcttacattaggtcaaggggctcccctgcttaagaccctccaatgactttccatccaattagaagcaattctatgttacatccttagcttgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaattcacatctcaacttagacgccacttcttctgaaaaatcttccccaactacccactgaaaagttgccgctcattcactgtccattatgtttaactctctcatggcacccatcactgagcaatgcttttcttgtgtccttgttgattttttctctcttccctttctaaggtctaagctccacaagagtagggatcttctccgtcgtggtcgccactgtgatttcagagcctagggatggaattcattcagtgcccagattgaatgcgtggattctctctgtctgtgggtggcaagggcatccactgagatggactaagggatctgaaatgatggctcaaagtctgaagagcttcagcatgggatgggaatagagagtaagggcagccagtaagatggcccatccagtccctaaggttgggaataggcagttggcagtggtccacaacgttgtatggtttttaccagcagctctgagtatccctggggtggagatggagaaggagatggtggatttgaactaagcgtgggattagtagaatcagtgaactagaagattatggaagaaagagagttaaggattctgggaagagagatgtccactgcagatccacagagcctgtaccaagtgctcaagaaaagcatgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagatagagtctcactctcttgtccaggctggaatgtagtggtgcattacggttcactgcagcctcgacatgctggactcaagcagtccagctcctacccaagttcacatctttctctgacccccaaataactgcatgcaccaccatgcctggctaatttttgtttttgtttttttgaatcagaatcttactctgttgcccaggctggagtgcaatggcgccatctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtacttataagctcaagcaatcatcctgccgtggcctcagaaagtgctaggattacaggtgtgagccaccgcacctgtcctaaattatatatatatatgctttcttttttccttttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggattacaggtgtgagccaccacgcccggccatgatattcttaataagcaatgcattcacatgattcatcattaagattatattaaaaggataaacactgagaagtcctgctcctacccaagttcacgtctttctctgaccacttactgctactgctttccctatgtgaacacttttattcagttaatttgcgtctttccagtccccctgagctaatttaacattttttattcttgtccttattaactcaaaagttcatgtactacgcctgtttttgatcacttaacaaaacagacgagaggatgtttgatggaggattggaagttctggagagtcccatggaaaggattggggttggggggtagtgggtggagtcgtaggagaatgaatcactggggagcaatgagagaatagatcatatgtctccatggaaactgttataataattgagaactctgttccagactggagatatagcatcagataaatcatagatgaaaacaacagtaagtcatgaaagcaaagtagaataacaaacacctctatgatcctttaaaacagagtaatcctttgcaactctagtgttgccaactagggttgtaaattaatgcaggttttatatttgaattccaactttgaacattttgcagtctggttaggtatatagatcaatctccataaacagaagaacacagctgcagtgatttgctcttccccttcgaaagatgaaagtgatggggctttggggtaatctgtttccacctcccttaacccaggaaaacaaaacaaaacaaaacaaaacatgtttttaaaccctaatggccaggtgcggtggtttgcgcctgtaatcccagcactttgggaggccaaggtgggcagatcacaaagtcaggagttcgaggccagcctggccaatatggtgaaaccctgtctctactaaaaatacaaaaattagccgggcatggtggcaggcgcctgtattcccagctactcaggaggctgaggcaggagaatcgcttgaaccgaggaggcggaggttgcagtgagccgagatcgtgccactgcactccagcctgggtgacagagcaagacactgtctcaaacaacaacaacaacaacagccccactaataatttgtggggcaactagggaatggcacaagccttttggtaagccctgtaaaaatgaaacaaggcaggaagcaatggtgaaggacattgaatttcaaatgtgtaagcccgtttcaaaatctttcaaaagaagaaaactgtggagagtttgtttttttaaacaggcagaagtgtttacctggaagggctatcttaccaaagcagggcctgttggcatggctggcttactcggaggtagatgccttctaggacttttaatacagagcattcaaacgtgtcattcacgtttaaaaattattttatttctcaacttttattttagatacagagggtacatgcgcaggtttgtcacatgggtatattgtacccaggtagtgagcatagtacccaataggtggtttttcatttagtgcttaatggtgcttagaattttatccttaactgtctgtttttataatgccttgaaactttgagttttgccaacgtctttcaagaattgaactttgaatgattgctggagtcaaaattatgctgcatatatataaattgggcagatttgtaccgtccggattgatgatacaagcttaccttataaagtaaatacagcaaatacttgatcaagtatatacacagcacaaggataactctttatattataaacgtgattcctctaaccctaatgtgctgccataataaacatgcattaaatatttaatgaatgctaatactgtgtgtcttctgagatttcatatgtgctcatggtaatgatttgtatgatccacgtctttaaaaaatagtatgcaggaaagtttgaatggaggctttcttgttctcttatacccctgactcttgcctatggatggaactgagctaatgtacgtgagttgagatgggatcagggggttagaaaggagctgggggaggcagctggtgtgctatagtggacatagatctataaccataaagaagctgaaagaagcttcagcacagaagatctatgtaaaaatggtatttactggaaaacagaaatagcccaaatggtatattcataataaatacaaaaaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcgtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgcatttcaaagcaagttgcagacatccatacactttacatttgcagataactgcaaatgcactttacattcagcatgtataccatttaaccagaattcaatatttgcaatgattattttaaaggtaaaattacacacactgaaatgcagctatcttaagtatatcattctatgagttttgaaaaacgcatagtttttaaaatgcagtggaggtatacacattcatttaaaaaatcacacaggcatgaaagcaactgtgatgtttagtatgttccatgggcacctgcgggagtgggatttgccctggttgaagccagagaagtcttctgtgagaaagtggctcgagctatagctaaaggacgagttaagttaactatgcaaagaggggaaatagtaaatgaaaatctcagaatgtctctttgttcctggcccccacccccaaaataggcttggttaatctgtgtggctgacagggcacctaaacttttattagggtagattcatctgctgtaacaaatagacccccaaatatatactggctcagacacaatagaagtttaaaattttcattaaacttctaagtttaagacgtttaagacaggcgcgcctggccacacccactctctccatatggtgattggggacaaggtgtctttcgtcctgtatggctccattaatccctagagctttgtttttctctgcagtcagagggtggaggaggcacaagctgcttcttaaaagtctcagcttgggaagtggcaccaatcatttctgcctactctctattagagaaaatatagccacgtggccacacttcagtgcaaaggaggccgggagaacaatttgggtggatgacacgtcgtctcagccacattccctacttttcagtcctggctgcaatttttcacggtgacacacaaaagaccttctgacttttccctttagagctcttgatgtatcacactccacacacaaaaaacttcaagtgcctcttttctgtgacatttctttgtgttcaaatcatggagcacgccaggtgttagtggtgactttcttgaagctagcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctggtggtggccccttccactagggtacccctagaaacttggcatttgtgtgacactctccaagatgctggcatcaacttttgtagctcaaaattcagaccgtacaacagagttgactatagtcttggccaagttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtaccagttatacatttattttaatgtgtttggtttgatataccagttatatatttattttaatgtgttttaggaaaatatattaaaagaagagtaattttgttcttgtactagtacctgaaccacatttggtgaaaaactgtcataaaatcttacacttacacaatgtaagattgaggtgatttggcagctcgattaccatggtatttctaagaatgtaaagtcttttgttacaattcgtgtgcgtacctggaagttacaaaaagtctctgttcatccccctcctccatatcctttccttcaaataaggaatatgcgcaacactgcctgtatccttaaaaatctttcgtgtgatcttgacctccctctaccctcctttactcactaaatatatccagacagcaaagctactctttggagattttctaccttcatttcctccccacccactccttccttatccttttgtattatgtctcctccccttagcaactttcagaaacatctgtctcccaggttatcagcagtcttgtaactcatatctctccagatctgagcatgaggcatcctggcttgctcaggggagtagggcaggcatgaggggaagggaactggaaataagattggaatccatacattattctgggcagaagtcatcacctttacagtaacttcccactgaaaggcataactaaggattcattcattcaagaagtatttattgagcatctactatatgccaggtacccttgtaggtacagaggcaatgtctatgaacaaaacaaacaaatatatctgcctgccctcatgaaacttatattctagtggtagtgatggtgacgacgaagatgatgataacacctaacattttttgggtccttactatgtgccaggctctgttataagtgcttagtatgtattcattagctcacacttactctatgatgcagctactgttgtccccattttacagatgaggagagtgagatgcagaaagttggaataacttgctgaagtcacacagctagtaaatggcattaaacagatcagctttgatttagatgtgtatgatttggggctttttttttttttttttttttcttctagagacagggtctcactctgtcacccaggctggagggcagtggtgcaatcatagctcactgcagccacgaactccttggctcaagtgatctgcctgcctcagcctcccaaagtgctggcattacaggcatgagccactgtgaccagctgattttgggatcttgattgcttgaaacttaacatgtaatttcctagttttaacagcgattccgtggaatgtcacaaacatattctaggaggttagtcatttttccctcttattttctcatctttccctctaagtgctaagcagagtttatggccaggtgcagtggctcacacctttaatctcagtgctttgggaggccaaggcaggaggatcacttgaacccaggagatggagcaacaaagggagaccccatctctataaaagcaaaaaacaaaaaaaaattgcatgccttattttcagtgtaagttgctgccattagacaaaccacatactcctagtgatggagggctctgggttttctgttcatcctcatcactctgtgcttattggctacctgtccatgtgtaaataacacatgtgccctgtgctcattggaaccgtgagtcatccgcagggattcctaagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcacccactccaattccactcacaccctgcccattatcgccaacgtttctgagctcatgctcattgacaaggaccatgccatggatttgcatgcattatatcatattaattcacaccataatcctgcaaggtagtcactgataatcactctattatatcatatagaaattgtaaggcagagaggttaagtgacttctccaagaaggaggcgggaccttgaaagctggttttgtgatttcagttgcctcttgccatctcttctccactttggggtccacacatcttcccaaacccctagtttaaattttttttttttttttgacaagagtctcactctgtcacccaggctggagtgcagtgacgtgaccatggttcgctgcagcttcaacctcccaggctcaagcaatcctcccatctcagtctcccaagtagctgggactacaggcacatgccaccacacccagctaatttttttattgtttttgtagagacagggtcccactttgttgcccaggctggtctcgaactcctgggctcagggaatcctcctgccttgacctctcaaagtgctaggattataggagtgaaccaccatgcccagtccaaaccactactctttcctcttccttttttcctttctttcttccttccttccctttctctctttttgacttttttgaaacagcagttacaaaacgattacaagagctacctaatgaggccaggtgtggtggctcatggctataatcccagagcctctagaggccaagcctggaggattgcttgagctcaggagttcaagaccagcccagcctgagcaacatagcaagacctgatctctaaaaatgtgtttaaaaattagccagacacagctggatgcagtgggtcatacctgtaattgcagcactttgggaggctgaggcaggcagatcacgaggtcaggagtttgagaccagcctggccaacatagtgaaaccccatctctactaaaaatacaaataaaaattagccgggcgtggtggcgcatgcctgtaatcccagctactcaagaggctgaggcaggagaatcacctgaacctgggagtcagaggttgcagtgagtcgagatcatgtcactgcactccagcctgggcgacagagcgagactccgtctcaaaggaaaaaaaaaaaagccagacacactggcacacagttgtagtcctagctactctggaggctggggcaggaagagaggttgagcccaggagttcgaggctgaagtggctatgattacaccattgcactccagcctggacagcagagggacaccctgtctcttatatatttagaaagctgcataatgacatttgtgggtttctccttcttccatgaaaaaaaaagcaaaaaatggtatctcatgactgcattggtatgaagacaaatatattaatattacatattaaaacatgtacttccacctaggttcacttttttccttgtgatttaaaaaaaaaaattaaagtgccttatgaaccttgaaaacagcatgggccctgagcactgtgcctggtgggttttgatggagaagtcagccctatgttccagctccagcatctcaatagcacctccctctgcagcctccaaacttttcttcccaaaggccagggtgcttaactaccatgctctgtgagcatgagagagcattccagagttccaggccccagacctcagtgtcccttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaacgcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccaccacacctggcctcacagcatcatctgctggagccaagcccggcaccagattttaacaggaagaaattgcctgaggagattaaaaggcagcttagttcatgccaggaacaaaggccttctctaaagtctgagcttctgttgtgggagtctctactaattttaatctcattagtggtatgtattcacacacagacatatacatacatacattagatgtggttatataatcctacagacaaaagcacttccctgtacttcagcctgctttgctatcttcctgcaccatatggtgagttcctttatcatatggttcacagatagctcaaagtgtttgctacctgtttccttaatcctcttccagagaacctttttgacatttgctgtctgatcttggattcctgccttctctttggttctatcgcaattatgtcacttccctgcccccaccaagccttcaacctttccttctttcatatgcaattctgattgcagcgtgtttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttctcaagaaaataaattatatcaaggaaaatgaaatgtcaggaatttaagttttacaaccttccatctgctgcaagtagattgtcaagccagagtgagtaaagcgggtatttgctgagaagacatggcttgtttctgtgtatctcaagacacccagaggcaagaagtgccacctgaatgagagagcttccagcagtctgataaccatggctccatctggggggttgtaggggggcccccagcctgtcatccctgcttctcgatgacatctctctgcagatacgcatcagcaccacctctctcagccttgttgatgcttctcaagtctccatgtctaattctcacatgtagaatatcctaggaatctaaaatcccgggaaagaaaaactgatgggccagtgtggaccagggatccctaggatccaattcactgtgaccggggaagcggttacttttccaaccatccatcaggaaagatgacaagaaaagcaaataggatgtgggcagttttcctatgagaaagaagaaaacgacgggcctgtctggcacacaggccaaagtgggagtttcctttaaatgtgtattattttttattttaatttttttattttgtttatttatttatttttgagatggagtctcactctgtcgcccaggctggattgcagtagcatgatctcggctcactgcaacctccacctcctgggttcaagcgattctccttcctcagcttcccgagtagctgggattatatgcgcatgccaccatgcccggctaattttttttttttttttgtatttttagtagagacggggtttcaccatgttggccaggctagtcttgaactcctgacctcaaatgatccatctgccttggcctcccaaagtgctgggattacaggtgtgagccactgtgcctggccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgtgcctggctcatttttgttttttttctagagatgggatctcattatgtagaccaggctggtcttaaacttctggccaccagcgatcctcctgcctcagcctcccaaagcagtgggattacaagtgtgagtcacgtcgctgggccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaaatgaatccctggttactaacagcataacccataatcttttctataatacaacaaacataatggcagaaatttgtggattgtaatcatccaacacccatgataaatattttggatgtacaaatgtggatggtacctatgattattcatgccgtagttgtttcaaacccccaccccaccccacagtttcaccttatgtactgacctcattgaacaccactgcggagattgataacatttttggagcactgggaactcatctgagtgttttataggcattgctcatttaatcttcaccatgggtcttgtgaagtgggtgctgttattatctgcatttttaaatctgtagataaagagacagagtctctattttgcagatgagggaatagaggctcagagaggtgagaagcttgcagtcctgaagcggtggaggcaggttcaaaccagggagcctggctgcagaatgtgttgccactcagctccatagtccccttgcatccagtgccccctactcctgctgtgctgaaacccgttctctattagcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatatatgtcaccaatgtttattttatttatgtatttttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagcgattcttctgcctcagcctcctgagtagctgagattacaggcatgcaccactatgcccggctaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttactggaattgatcaatatcaattctattggtaaaaatcaattctactggtatcaacaattagacgacacagcccagagtgtgaaaatagtagttctctcgcatttcttgttacaacccaattagacatttcttattagacccaaccacacatcctcatttaaataccagggccaggtatttcaggtttcaatctccttgttccactcctcccctttctagcagtcactgtgagtcatcccttctaggggtgtagtgacatttgcttaacaatagcaagtccacagaaaccagagatgactgggctaaatgcaccttcattctaaacttcgtttcacactttcatggctttctcagctagtgggcaaaaatgctacttgattaaattacaggtgtggcatggcctcattttaaaaggttgaaatcttaatgcaacctgtcaatctgacctctgaaatgaaaaattagcttatctatcacacagatccatgcttttatcatctataaagagatttttaaatacagaaaaccttacgtaataaatcaagaaatagccaagttgtatcatccgagttgatctatacgccggatatcactgctcttcttttcatctggccaacgtgaagactgtattcgaaaagtgctgcagtcctacctacatccacactattaattcccaagcatcttctccccattatatcactttccagtttttcctgaggtacgtcttcacttggcagagtctacccagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacgcttaagaatacactttggaaaatcagaattagggccttcaagataaactagaatgtgataggacatcttcatttctggtcaaagttggaagtttaggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcacgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccaggttcaagtgattctcctgcctcagcctcccaagtagctgggattgcaagcatgcaccaccatgcctggctaatttttgtattttttagtagagacggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctggcccaggcagaaggagggctttggcaaatccgcatgctagaaaagatgagtttggaagggcctggaaaccagggtacatagttccttttcccttgagattttagaagttgacagacggtttgctggttttgtagggaaatcctatctgccacagagcatgtggattacccagggaggatcctggaggtcacgtgcccagtaccacctctaagcacagacagtatgaccttgcctttcactctgggctttgtgtaaggatctcccaggacatagatttcatagcgacattggtcgattgctctgattcactttctgcctttctctttcttgcatatggagaatgtgggaaagaatcccctatacacacccacaggagttagaacatccttcttatcctccataatcgtgccttcaaattaataattatggcttgctgtgtgttgggccctgagcttaacctgcattatgtcacttgatctcacaacaaccttctgagggagaaactgtcattattccccttttatggattggggaactgagactcagagaggttgagtaactcagccaagaacacacagcaaaccatatgatagagtcaggatttgagctcatgattccaaagtctgaacttgaaccttctatgactataattctaattagatataagcttccagatcatcagactctgtcgatgccataatctctttcttacatggcagagatggtcaggatacctgccacgtggtaaagacgtggatgcagaagttaacctccatttgattagcttcggtgcaccaagctgcacccaggtttctctcgaaatcctgctcctgagtgggtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagagtgtggcccaagcatcggcttctaaaacctccacagggagttctaatatgcagcagggagaagcagcagctcagtgcagcaggcaaggctcgtccacggaagggctgggggaaggaaggagatcatatttgccttaaaacttggagttgagctcatctgacctaccctctgcaggtcttcagggggactgggaagaatccatgcaggagatagccccagagatcaaggggatcctcaaagagatgggatcttaagatagagggagggtacactccttgcaacagatcagcaccctgaccctgtacccagcctcgtccacaaacctgctccctagtgctgggcatgggatacagagctaggggtcgtgtggtcccccggaggcctacagtatatacacatgagctgtaacttgcttgtctgtccctccccaagttgacctcagtttatcacaccttactgatgctcttctgccaatttagtgtttgaggaccctgtgagccctaaaggtctctttctcttattttattattttattttattatttcatttatttattttgagatggagtctcactctgtcatccagtctggtgtgcagtggcatgatctcggctcactgcaacctccacctccttggttcaagcgagtctcctgcctcagcctcccaagtagctgggattacagatgtgcaccaccacacctggctaatttttgtacttttagtagagacggggtttcaccatgttggccaggctgttcttgaactcctaacctcagatgatccacctgccgtggcctccaaggtgctgggactacaggcatgagtcaccgtgcccggccgagataggatcttaagacagagggagggtatagtccttgcaacagatgagtaccctgatcctatacccagtgtcatccacaagcctgctccctagcagggatgggagagggagctagggagggaggggcatgggagagggaactagggatcgtgtgatcccctggaggcctacagtatatacacatgagctgtaacttgcttgtctgtccctccccaagttgacctcagctcaccacaccttactgtgttgaggtataatttacagaagactcacttgtttgtttcatgtaatcttgaatgatgctcttctcccaatttagtgtgtggggacctaagagccctaaaggtctctttgtctattttagatgcaccatctgaattcaagttagaatcttttcccaatcactgtttgttagtcaagcttgcagactgtgacagtgctagatgttttggtctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggatggagccttatgtaaattaaacaatgctgacacccaaggaactgaagatctttagtgaccttgatctgggagatttttaaagcaacttctcctactcatgaaatcctttcattcattgattcaacggatatgtattgagtgtcaactgtgtgctagatgttggggacatgacagtgggcagctcaaagaaaatgcctgccctcatggagcttccactcttgtgagggataaaaataaacagatagatattaatataatgcccgtgtggtaagtgctgtcaagaaaaacaaaggaggggaaggggatggaaagtgacaatggggcctatgagtttagagaaggtggtagggagggtgttggtgacagggtcacattggagtgacctgaacaagatgagggagcaaactgttgagtgtccctaggggaagagtcatgcaggcaggaagagcaaaaggcagtgattctgagaggtgagattgagtcccaagtacagtaggaggacagaggaaagccttaggaaggtggagtgacatgaacaaacttaagtttctaaagcatcgttcaggtgtatagagaatagaatggaccaggtgcagtggttcatgcctgtaatccagcactttgggaggccaaggtaggaggatctcctgaggccaggagttccagacaagctggggcaacagagtgagacctaatgtctaccaaaaaagagagaaaaagagaatagaatgtttatgagagcgagaagaggggaagcagaaaacagggtaggagacaactgcaggaaaccaggctaaggatcaaggtggctcagatcagcaaagaggttgaacttagtatatattttgaatgtagagctgacaaatcttgtgattgtactggatgagagatacaggagagaggaactgagggtgactggatttggctttggacttgtggcaagtgtatgttgaagttgagcagttgggaagcaagatcttgggtccctggctgtctctgcccttgcacactagtgtggccatttgcactgctccctcaggacaaagctcccgggccagttgaaaaccggaggttggtgctttgtacaaagctcaccatcagccccctttgttgtttggtgaaaagatgatgttgacgatcaccactgtaatgggtagaattgtgtcctcgtaaacaatgtatgttcaatttctaatgaaggttgcctcacttggacatagggtctttgcagttataagcaagttaagatgtggtcactctggattagggtgggcctgaatccaatggctggtgtcctcataagaagagggatatttggataccgacagaacacacagggaagaataccaggggaagacagaggcagagattggagtgatgcgcttaaaagccagggagtgccaacggtagctggcagccagcaggacctaggagggaggtgtggatggaacagatcctccctcagaatcttcagaaggaaccaaccctgccagcaccttgatttgggacttccagcctccagaactctgaaataataaattccttttgtgtgaagtcactcaggttttggctcttccttttggtcatgctaggaaactagtagaaccaccaggtattaaatatttataatttgccatgcacagtgctaagttaaggtgtgcactaagatactttatcccataaaactctctcagcagcaccaaaagcaaagtattgttggcatctccattttataagatgaggagaagattgaggttcagaaaacagtgaatttctcaaggtcgtacagcttgtatgtggcaaaacttggacacgtaccaggttttctaactctaaaagtccatgccctaaccattatgcaacgctgggccacagtcaggggccgagattccaggcacgctttgccattgggattcgccagtaaagttcatcaccacaaactttccagccaggaatccctgggctactttcctctgttttatttgctgtcatcagagttctgctatttatcacatctctcccagaagattcttgggggaacagatgtggcttggaatttgataagaacgtcacttcaacacatcctttcagtctgtttggaatcctcaccctggagagagagggacagctgaacaaacagcccacgccctctatgttggtattaaagtttctggaagctccagaaactgcttgagacaattaataagagatcatttccatttaaaggaacatttttgaacgtgggcatcaccagccagggcaatggctacttttctgctcttttcctctcccatggcaaaacttcacagcatatggccgggcgcggtggctcatgcctgtaatcccagcactttgggaggctgaggcgggcggatcacgaggtcaggagattgagaccatcctggctaacacgatgaaaccccgtctctactaaaaatacaaaaaattagccgggcatcgtggcgggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggcacatcaccagtgcctagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgtttaagggcatggatttaagggacaggtgactaggtgtcacttcctagtggaatacggacgagtcacctagctttgttaagccctcccttcttcatctgtaaaatagggatagcagcagtttccaccttacgtatttactgtgggaattaaataagataatgcatattggaagtaatcagtgggcatgtacatggttattgttataaagtccaaactgtcccaacgttgccctttttttccttggcacaaacactaggcctttgagtatcacaaattctttgtccagccaccctacttggtggctggatctctgtgattctattagagacaattgtctgctacatctcagagagatgggagtcagcatctgcaatttgatttctgaagcttaagtgctcatatccttataggaatcataggccaaggtttgtagatccagatcgtttaatcctaaggaagcactgttcttttccctttggctgaaatatgcctcctgtgtccccgccttgctagtcctattgatacttcaggtgtcagcttaaccatcacttcccgaagagcatcttttgctgacccactcagcgatgttaagtcttccatttaaacactccaagagcaatgtgtacttctgtttcaggggtctcattatgattgatgttaggtagttatttgtacaggagtgtaagcttcatgagggcaggaaccttgtcgttctgcattcctggtgcctatctcagtgtctgacacatcctagaccctaaattaatgttaactgaaagaattgtctagtcttctaggtgctggataaaactaggaaagttgatgcatttggaaggcccaatgaattccatctctgttgcctctctcagttgaagctttaaacaatattgttattattgattgaaaagagcatgcataaccaaacccaaggtggcagggaccactgctgaccaagctgggttgcaaattaaactgcagccatttttgatcatgtggttactcttcttttccctgatccttcttgaaacacttattctaaaacgagggtcagcagactattggaacccaggctactgcttatttttgtaaataaagttttattagaccatagccacactcattcacttgatccagaccgccctgcaaagcctataatatttcctgcttggccctttatagagaaagagggacttgataaatctgttctagttatctattgctatgtagcaagtcattccaaaacatagaagcttaaaacaacagccatcctatattatctgtcatggtttctgtgggtcaggagattgggaatgatcactggttggttgtggcttgaggtttttcctgcactggctggagcacctggggctgcctggtcatcaagcttatcaggtagtaccagggtttcttcatggggtcttgttccctggtctagcattgtgtcttggggtagaaaggaaagaaactgacagaagctacagcctcagaagtcttgcagggtctcttcaccacattctgttcattaaggcagccgcagtgcctgcccaggttcagagactctggctctgattggaggagtatcaaatatttgtagacatgttttaaaacctctataaagtatcacttccttcgtgctatggggacagctctcaaaatgtaactccaagagaggacagagagatttatatcgaaaatgaaagcttgattagaatattaagaagaaaaggaaagttttctctcatcctattaatgactgctgagaaagtgttaggaaaatcaggatggaaggattctgtcagctttacctactgacatctcctagccaccttattaaatgaatcaattttgataatatctggtgattataatcaacataggaagaatatgtttattaaaatgcagactcccaggtcacagcccagagctcctgaaggagagggagtgcttggaatctatatggtaagcaaagaccctcaagtgattctgacataggcaagaggcactgtcctttataaagactggaatttgccttgttttaggtcacatactgacatgatgctacttggcttcatgtattttaattattagtaagaatttgagctacctatgtaataattttgttttagggatctctaagatacataatccattcaaagtaatataaataaaaataactttattggaggaacataaaggtttcaaacagaaaatggctaagcctcatgagagattggaaactgaaagcaaggcctctgcttgttctcttaccttctttgtttttttccccctgcctcaaacatctattttattcctctttgcctgcacagtggtagaaaaggaccacgctaggctgagtgtggtggcttacgcctgtaatcccagcactttgggagacctagatgggcggatcactgaaggtctggagtttgagaacagctggggcaacatggtgaaaccccatttctactaaaaatacaaaaattaaccaggtgtggtggtggacgcctgtaatcccagctacttgggaggttgaggcaagagaattgcttgaactcgggaggaggtgaacgaagatcatgccactgcaccccagcctgggcaacagggtgagaatctgtctcaaaaacgaaaaacagaaaacaaaacaaaacaaaacaaaaaaggaccactctaggaagatctgtgtattctctgttgagggacccaggactgactcctcagagtaccctaattcaaattcttgggagggggaatccgattggcttggctcaggttgaggaacttacctctgatccaatcagctgtgaccagctgtatccactgcccaatcagaaggttcttctaataacacagagttggaagaagtgaaaggcatgctagggttttcatttccaaattaaactgcagtcattttttatcatgtggttactcttattttccctgatcttcttgaaacacttgttgcaaaacaagggtcagcaaactattggagcccaggctattgcttattgttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgcccgttctgttttccgttaatcagtatagggcatgttgttgagggcagggcaagacactgggaatcttcacacacccctgtttattgatttttaaaactatctgtacaaatgcaatagtatctcctacgatgcggagcacatagcattgctgatttgcaagaagatttcaactgctacttgagattgttttaggtgccgtgtagttgcactatgaaataaaattaaatcacgttatgataaggttatttctgtgtctccttttactctttctaattacttgaacaagcaaatctcatttgatgacaatatgctctctaacaactttctaatacaattttttcctttaacaaggagaagatgcagagcctgactcagaaccttcagcagccagcagtatatagctagaatttactggcaccgctttgcttttatttatttttatgcttatcttccatttatgacttgtgatactggcttgccattaatagtggtgatataaagtttccttttcaaatttagttaagttgaaatgtgactagatttttaaaatgctaagcaaataacagtttaggtggcaggaagaaatgtgaaaaaacggatatgaatgattgaagtgcggaaatgcctgagctacagtaactgacatagttacaaagcagccctggtgcccagaggaggtagtggccgatttggtctgaatggaacctccagattagaggaggagataacagcccagtggaatctcagattttcaaagcagtgcaagagcatggaaggacgtcatagacagtgggagtcgaatgttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtaattgacacagatgtaggatgtccacccctgtccctggtgaagggggaaattcccagccattctgccctgtctctcttccatgtggaaggctaagatgtcctatcatgactgcatctgcactgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccgatcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgagaactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcactgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgattggttcccttaccctcctgagccttaatttcctgcaatatgggattcacaatggcacctacttcctatgatgttatgcaatacaaatgagtaacaataagtgaaaacctggaattgtttggtcagtagaaaagtgctcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctgtctggcataatcacaaccaaagaatgttcaaagaatattcccccggttgggagagtgggagagggggtgacacgcagaaaataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcattcaacaaacatttattgaacatgtactatgagccaggagctattgcaggctcttgggttacaccagtaaaccaaaacagcaaagatacttgccctcatggggcttaccttctagctgggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaattagccggacatggtggcacttacctgtagccctagctacttgggaggctgaggcaggaggatcactgagcccaggatttcgagtccgcagtgagctatgatcatgttactaccctctaggctgcagtgagtcatgatcatgctattgcaatctaggctgggtggcagagcaagaccctgtgtctgaaaatataaaagtgtgaagtcaatagaaaacattacctgttgtttcagagtcaacagaaggcacctatacaaagctaagtgtggctacaaatgaacaccagctgctcataactggcccccagactccttccaactgccctgacatgcttgctctctttcccaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaaggagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctgagaacacagccctcgaggactctcagggaaggtacacagtgtcctgggaaggagctagtgagttcagagccatggctgccaaggtgagaagggagcacttgtccatttgtccattttctgctcttgactgtgatttcaaccctatctgcaagagcaagagtccctgctttaagtaacctcttacctttccctgttcaaattagaccttggtttccatacccagggatggagaggccagagcccaaatgcaaaggggtacaaagttaattgatgccttttaggattctcagggccaatgacctggtgacttaagatgttttggggacttttcaagattaattttgactctatccagttctcaacttactgagtagagtgactgattttagagcccaacccatatatgagatgggacactacagtactttgcatctaatttgatgtctttagtgatttccctctcactttaattcttttcttttatctgttctattatctgctgaagatatcctgggctgtgtgacctgtagcattttcacagtctggatttcactgactgtacggtcttggggcacctcaacatgtttcctctgtcttctgtatttcgtgcaattggcagctggttctggaggcttggtcagactcagctaggatctctttggcaagaccatagatggtgacctgttctttcatctgaagtcgtataatggcttgttgtctctcatagtgaagttggcagcgactgatggttggtgcctagatctgttaactcattagggattgtaaaatggtgatatcctaattctatcatttatttttcatttactagtgagaatgcctttataaagaagggcctcccttcacctattacttagttccctagtggtatagttcctgtgagaaaggcaggataaatgcttgattctttctctttatttaatagttctcaagataataaattggttcactgttgtgctccaagggtggctaaagttggcttttttttttctaaatgggtctggctctgtctccccagctagagtgcagtggcatgatcatggctgactgcagcctcgatctcccatgctcaagtgatcttcccacctcaacctccctagtagctaggactacaggcacacaccaccacgcccagctaatttttgaacttttagtagagaccgggtttcaccatgttgtccaggctggtcttgaactcctggactcaagtgattcacctgcttcggcctcccaaggtgctgggattacaggcatgagtcaccatgcccggccaaagttggcttttaaaataaactgttttgagtggaagaagagacaatagaaagaaaaatattaagtgaatgataatttacatcatgcaatggagacttggcaaagaccaggaaaggggtacacctaaccttactagtccaaatctctagtcttaccatggggatttaaggcctaaaggtgttcaagtggtgatagagacaaggctgggatttaaacctctaggctcccctactcccttaccttctcccttttccattggttatccccagatggattcattgacatcatcaggcaaaggacagtctccgtccagtaaatcaactaagtaagaaagggaccttgtgcccagcatagaggctgagcagcagcagttttccattttagttggatatgttgagagtgggagaaatgaatcatgggtgactaatgttcattgtagtgtctttgtggtttattattttaaaaatgattaaatagagtagatttgagattattcttttaatattgaaccaacctactcacctatatttcaatatgctttctggaattagagagtaggggctgggtgtacatggaaattttgcagaagtctgggtcccctccagggattgtcatgtgccagggaagagagactgagaaccaggagagcctagaacacaagagcccagtgggtttgggtcttgcatggtgacatgatttggctgtgtccccacccaaatctcatcttgaattgtagttcccataatccccatatgtcgtgggagggaccaagtgggaggtaattgaatcatgggggcggttacctccatgctagttatgatagtgagtgaattctcacaagatctgatggtttaagagggacttttaccccacttcgctctgcacttctccttgctgctgccacgtgaagaaagacacgtgtgcttccctttctgccatgattgtaagtttcctgaggcctctctagccatgctgaactccgagtcaattaaacccctttcctttataaattatcccatctcaggtatgtctaatggactaatgagaatggactaatacacatgggaatgaaggcctcccatgttggagaccaatgcaagtaattgaatcgtgggggcagtcacctccatgctagtcatgagagtgagtgaattctcacgagatctgatggttttatgagggacttttaccccatttcgctctgcacttctccttgctggtgccatgtgaaggacacgtttgcttccccttctgccgtgattctaagtttcctgaggcctctctagccgtgctgaactccaagtcaattaaacccctttcctttataaattaccgagtctcaggtatgtctaatggactaatgagaatggactaatacacatgggaatgaaggccttcccatgtggagaccaatgcagaatctccccaaccgacaagtccaaggatggaacagattgctttctcagttgttgagggtctgatgaagtctttaacctatctctagggattgtatcgattgaaagaaaaaagtgcttggagagacgcactcactgcaagcaagagaccctgagatgccaagtgcagttggctgaaggaagagcagatccccttccatctcacctgcactctgcgcatatgctcattgagtgaaatgctccaatttaaattattttttctcacttctttgtgggctaagcacatatattttaatgttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtataagtatatgtatatgtatatgtatatgtatatgtatatgtatatgtatatgtatatgtgtgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatgttacctaggctggtctcaatcttctaggctcaagcaatcctcttacctcggcctcccaaagtgctgggattacaagtatgagccaccacacccagcctgaagtcttttgagtgtggatcacccaaagaccactccacctgacacccctgggttagaatccctcctgcaggcctgtctccaggctccaccaggagcctgtgctctaatctagccatggtcacctctcacctgttcagtgaagccacactacctccacctcttagcttccctatctctgcataaaacttgatgttccatctgagcctctaccatgcatgggtcttcaacaacgttgcttcattccagcctcacaaaaatcttgcagtgaaagggattatctactctcccattttgcaggtgaaaggattgagaatcagggctgcatggtagttcttcctcgacacagcactgggtcattggctcattgagctcagagcccaagcttttgttagtacatcatgttgagttgccaccaaaatggccttgacaatgatgatacaaacaagaacaaaaagcagcagctaacagtaataggttgggcactctactcagcactctagctgtattatctcattttatcctcctgatacctctattggaaaggtactattactaactttaatttacagacaagaatgctgacattcagagaagttaagtaactggtgcactgtcacacagctgctaagtagtggagctaagatttgctctgcaagactctagaaccccaaacccggaagcctttgctaacctacctgtgccttaacttcacattcctggttttggcttatagaatattttcactttacagccaggcacagtggctcacacctgtaacaccagcactttgggaggtgtaggcaagtggattgcttgaatccaggaggtcaagaccatcctgggcaacatggcaagatcccatctctacaaaaaattagctaggagtgatgcacgcacccgtagtcccacctacccaggaggctgtggtgggagggtcaactgagcctgggaggtcaaggctgcagtgagccatgattgcatcactgcactccagcctgagctacagactgatactttgtctcaaaaaataaaataaaataaaataaaatataaaatattttcactcttacgatcacatctaatcttcacaaaagcactataagtattatggtccacatttctattcaatggaaactgacccccagaaagatgaaatggctcaagttccacaatcagtaagtggcagttccagggcttgagctcaggttttctaatagccctttgggtgtttttttttttttttttttttaatactatggaagttactccgcttatcctacagggatattgcaaggattagataagattttatccatgggaatgattattaaaatttagggagcactgcatatacatgaggcaagccattgttatcatgactaaaatgagcaggaaggtgacacctctttctggggatgtccttgaaaatggtcatctggctcctgctcattttctagcattgcatggcctggatctgcagagcagggcttcagaggaggcagtggagctggaataggccatatccctaaaagggcattactgcctgtatacagagggtattactgcctgtatgctgcctgtatacagagggtactaatgcttattgattatttcaacaaagacttattcattgaaataattgtatcaggccccattgcatcaccatgatgaggtacaaaacagataaagtccctgtttctttggaatttacattctcttgggggagactgataataaactataataatgacacaaagtaaagaggatggagatggatggattggggcagagagatgctatttttgataggatcatcaaggaaggtctctctgataaggatgacatctgagcagagaccagggcaagcaagggagcggggcatgtggctatctgggggcagagtgttccaggcagcaggaagagtgagtgtgaatgcccgcggcatgagcatgctccgcgtgtttgaggaacagcgaggaggccggtgtcgccccggtggattgtcattttgtattttgtgacccagaattctttttgaatcagctacctttaaaaaaaaaagagacaaatccaatataacatgctgtaaatttgatgtttttctttctagagactcagaattttaaagataaaagattcttaataggctcttaaaaaatctcaaaagtggccaaaatactggataaaagtgaaagagacaaccagcaatgtacaaaaccattttttaaaaatcaatttttaaatgatgtaaattcgatttttaaaaacttatttaaaaaagcaaagttacatcagaaataatcttatattggaataaaaatatctttcaaacatatgcacagcacggtgttaacagaaaatgtaggatattaaatcctatttaagatattattttaagtgtgttaaaattgaatattcacatggaaaagaatcagaagggggcataaacaaatcaaaatattgatttgatttagggaggggtctgtggataagtgccttctttttgaacttacatcattgcagaagtagttataatatagttgtttaagttttttttaatgtaccacaagatggcaaagttaatatccaaatagatgcaaaagctcccagaagggggttgagttttcagagatttgctcattagatggtttaggcaaattgtcctagaagcacaaagggataataagcctgtactccacagtcaggtgaatctggatctgtgattgcttgctagatgacctctaggaagtcacttaacagctctgaatatggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggcacattcatgcaatttcccaactgccagtgggcacaggcagttaagtttctttagcaaaacatctattttaactgttttcttttcaattgaacatatgcacctctttttttttttaaatagaattagattttatgagtcattgaaggacagaagttacttcctccccaaatttgctgccatggcccagcaataactcagttgcaaggcatgctgggaggaacgtcaattcagaatgcaagagaggacagggatggggtgaggatgattcccacatgtagagtggacccctgatggcccaagaatgagccccgagaatgtcccaggggtcctggtaactcgggctcagctctgggctggcagcagtacccaaggatatggttggacttaagggcattgctgcaggtggctctggctgttgtctcagtcagcagtgatcaagttgtaagaaacagaacaccccttcccctgccccccaccaaactggctccaatagctccaaaaaaacagagaagacttttttttttttttttttttttttgagacaggatctccctttgtcacccaggctggagtgcagtggtataatcatggcttactgcagcctggacctcctgggctcaagcgatccccctgcctcgacttccggagtagctgggaccacaggcatgcaccaccaagcctgactaattttttaaaatttttttgtagagatggggttgagacctatgttgctcaggctgctctcaaactcctaggctcaagtagtccccatacctcagcctcccaaagtgttggaattacaggcatgagccaccgcgcccagcctggagaggattgttgatgagaaattagttaatgcgtgcaatgtaccttattcaggtgatgggtgccctaaaagccctgacttgaccactatgcaatctatgcaggtaaccaaaaaaagaggattttattggaaagaaaccacccaaagacaaaggtgtacctgggcctcatgaggagctagaatctgtaatcctaaagcagtctagaatagatttctaggtttctttgtccttgctttctttgtttctcactgctcctggtaaacatgacttcgttagctccttgcagtttgcctatctggcaaattccctgcatttcagatcatagtcctgggaaagagaatctggttggttcagcttgggtcaggtgtttattcctggcccaatcagctggcaattggttgctactaactcactaggaaccttttaaaaggggttgtatctacagggagggaataattggtgctcatgccaggtgagaggcaccatcttgagtccaaggagactaactggattcaagcaggacatagttataggctagtggtacaaacatggcatcattgcctcccaggggaggaaactggtgagagcttggcaggtgttagtgctttagccaactaaagccatccaaggatcttgagtacaggaaatgaatcagaaatgcaacccaggcaaatagagctggggcaggtgggaatagacacagccttatgctctctgttttcttgatggtggcctttgcatattcattcaataatcaaagatctgtggaattccgaggaagaatagaggtagttctagcctttgaaaactttggcctctatgtggagggacaaggcttagaaagctgaaaacaaacaaacaaaaaagctagaggagcatcaattgcttgattctaacagtgattgcaaggctataaaatacagaggaagggaaagttgtgtgtgaacacatgtcattgagtgcacacttacttgggtaaggctttttgagtttgcatggacttgacatgcgtcatctgatgtatcttggcaacacccctatgaagaacaagctgtcattacccccttttgggaaggtagagactctaagtaactgacccaaagtctcagagcaagtatccagtataactgtgactagaacccaggactagctgataccagaaccagggctcttaaccacagcactacacagcctctctggagagaaacagatggttctgagcaataaagggatcagcttccagacgggatgaatccacagaccagcttggaaaatcattaaagatcattaaatagacaaattcttgcagcaacttcccttggagcatggtacatagagctgcccacgtggtcggttttctctgttcatggtatctgattaaaagtggcaagtgtccccctggcagtcacacaggcatcatgttacactccactttcagctgtcttaggggaagattgtctctttgaattcccttgcttcctctggagacctccaggtgaattctgcacctcccacctagtcatcattttaaatcagactatcctcatactcatgttccaaatttgggaaattctagccaaccattttgcataatgtagtgacagacagacatttagttttatttatttactgattatgagagattaaggagaaagggaattttaaattacctgaaggcacttgaagcttagagggcagcggtaatagtgtaatgaagaatcacaataacaatgacaattttgaagaagccctttaaagtcaagcagactagccagtttgaagagaaagatggtgagtttgcctttccgagcttttaattggagttgacggtggaacacccacgtagaaacgtcctgtagccagctggagctgactggagctcaggagagagggagaggatagaaatataagtcaagactcatcagcccagcgagatgagagttgaaattctgagctgtgacaagttcttcttggaaaattgagtaagtaggagagagccaatctggacttcaagtcgatacgcaagaaatactttttttgattttcatatattagagtccaacaaataagccctaatcaaaaaacactgagtgtggtgataaggaagattttgcaataatttcgtaggaggaatggggaacaaaggcaaatttaagggtgctatggaggggaataatatgtaagaattagaggcagtacgtgaggtccatttagttagccgaagcccccatagttcactctttatgcctctcatgcactttcttttatcgcattctattttatttatttatttacttttatttgaaacagggtctcactctgtcacccaggctggagtgcaatggtgcaatcactgctcattgcagccttgacctcctgggcacaagccgtcctctcacctgagcctcctgagtagctgagactacaggtgtgcgccaccatgcctggctaatttttttattttttgtagagccagggtcttgccatgttgcccaggctgacctggaacttctgggctcaaaagcaatccttccacctcagcctctcaaagtgctgggattgcaggcatgagcccctgtgcccagccacattctattttagattagggtttgaattagttgtatacttgttttaaccaagattctgaattccctgagggcaagcctgaaccttattcatcgttttcatccttttaatgcctgcctaatgccatgacttgcaaaaataagcgctcgatgaaagttctaaaactcacttctctgctccagattggctctggattgcctctgacaatattttccagattttgatgttgcttactgtggagtgggagatgaacctggtggtacatgaacacattgcatttatttttaaaataagtcatttaaaggattgatgtaccagagccagactggatattgcataaagatgatggactccagatatgcacttcttttctacagagaggatgaatttccatttatgactttagtatgaaatttaaaatttttaaaataattgtgtttaagttttttttaagtgagttaataaaaatacttttaaaataagtcaattttagtagaaaaggcagacaaacttagtaaagatttttttcttttctttctttctttttttttttttttttttttttgacacagggtctcactcttccccaggctggagtgcagtggcatgatctgggttcactgcaacctccacatcctgggatcaagccattcttgtgcctcagccttccgaatagctgacattagaggtgtgtgtcaccatacctggctaatttttgtatttttagtagagatagggtttctccatgttggccaggctggtctcaagctcttggccttaagtgatctgtccaccttaacctcccaaagggcttacaggtgggagccactgcacccggtccagatatgtacttgttttctatagaggggatgaatttccatttatgactttggtatgaagttaaaatattttaaaataattgtgtgtaagtttttttaacggagttaataaaaatatttttaaaaaataagtcaattttagtagaggaggcagagaaacttggtaaagatcttaaagctggttgggagacaagtcacgtttgggtggatggtcttaggcagtgcatcataatctggtcttaccctacctttccccttttttcttttatatgactccatgaattttactccccctctccagcaataatagccatcaaatcaggaacgtaagtgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacatctggcactgtggattatccacagaaacatctctggcaatagagttgctcctggcatagagtgggcatcattaagtgtttgttcagaaataaaaggacagtgagatgccaaccgtaacatttaatagcttaggcactggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgtaacctgccagcttctgtcttgatgtaccactaaatctccatgttccttctctcccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacattgagttttgtagagggacaagtgagacaaaatatgtaaagcattcagctcatcacgtggtaagtacccaagaaagcttaatttcattattgttgttgttataattattaggcactcccacatttgataaatgcacatatgactgttacatataagataaagttctatgtgctgtatggaagatttttttaaatggtgaattaaatgcttgttatatggccagcatcatgttagacactctacacatgtgtccttgtttaatattctgtgggcaagtgaaaaatgtcccatctacaggtgaagagaaagcccaaaattagattaaataactgctcagtgttgcagttagtaagtagtgcaacaagacttcaaatactgtattgacttaaaaggtgaaatctttgcttcactttcccaccacctcttctcccggttttatagcccctcacaatagctttgcaacttttgacagcaagtcaccttttacgttgtgactcagccatagcaacatataaatataaccaaaacatatattccacaaaaagtacttagtggtgttctgtgcagcatgcactgataatttccatttcatcatttcattatttttctttcttcttctactttttttttttttttttttttttttttttgagacagtttcactctgttgcctgggctggagtgcagtggcaccaccatggctcactatagccttgaactcctgggctcaagcgatcctcttgcctcagcctcccgagtagctgggactacaggtgctcaccaccatgcctggctattttttttttttttttttttttggtagaggcagagtcttgctatgttccccaggctgttctcaaactcctagcctcaagtgattttcctgtctcggccctgccaaagttctgggattacaggagccagccaccatgcctgacctcttttttctattatttttttttaagttgatcatgacccaccaaattgattcaatcatcaattaaagtgagatacaacttgagtttggaaaacacttgtctggcttcaatactcaggcagtattgccaggacatctcattttcatcacatttacagtttgcagccctgtgtatgtttcattccagcccctcagtcagtctgttagagattatcgcatatgttatcctcattttataaatgaagatatcaaggctcagggatgtaaaatggtcttgccaagcctccccagtagtcagaaaacgtggagtcagagctttgattccaaccttctgactgtatgaatgctgctttggagacccagtaactcctgctgcctcgaggatcacccatttattcacttaattaatgtatattgatggctcgctttggtcaggcatggtgctgggctgttggtacacagcggtaaacaaattttacatggctcctggatttgtggaacgttcagtcacatttcgcattagtccatttctttcagagtgagaccccgaacctttgtgttagcctacgtgaccttacatgatgcgtccctcagcaccaccctgggctcatctcctaccctgtcccccttcttctttcttctccaagcacatgaggtgtgctctagcctcagggccttcgcacagcctgtttctccgcctggtaagctctcactctcaatacctgcatagctgctttcgtcatctccttcaagtctttgctgaaggatcgccttctaaataagattatcctgaatactttattgaaactggaactcctttctcccatctcatccagctggtactcccaatcctccatactttgctctgtttttcccccgtggcactttttaatcttttagccttctatttttatttttatttatttatttattttttgagacagagtctcactctgttgcccaggctggagtgcagtggtgtgatcttggctcactgcaacctccacctcccaggttcaagcaactctgctgcaccagcctctcgagtagctgggactacaggcgcacaccatcatgcccagctaatttttgtatttatattttagtagagacagggtttcactatgttagccaggctggtctcgagctcctgacctcaggagatctgcccgcctcagtctcccaaagtgctgggattacaggcacgagccgctgtgcccggctatcttttaatattctatataatttgtttattatgtttagcatttattgccttttctgtgtctacttgctagaatgaaagacaaaggccaggaatttttgttggttttgttcactgctctatcctcagcacccatctataacctggtacctagtaggactctgtaaatttgtttttacttgaatagatagatgaaataaataaccatcaagttcaaaatataattaacaaattatgatgtggtcagagattaaaaaaagaaaagaaaagaaaaaagcccacaggctttcatgaaagagtataacggcagacctaatttagattgggtgggttagaggaagtgacttttttaggctgagaacataagagggacttcagttcccaaattcgttagcgcagactctgccattgcaagccaaaggaacgtagcgtaaaggagagatttcacccaagcagaagtctctaagaagagataaagtgattcattcattcatttagcaaacaccctctgatggaaggagagaaacgagtcacatattggtgttgcccaagggccaaaacacacatctgacttatttaattccagcaacatcactgaggttctactattatctcctcttgacacacaaggaaacccaggtgttgaataacttctccaaatacatccagctattaagagacagagctggatttccaaatgaagtatctttggcaccaaagcttgtgccctttccctctctgggcacctgctatgtgctagttgtgctatcagaaacagggcttacacagccaacaagggcatagcccctgacttgaagaagttcacaatatcccttgaaagacatgctgaaaaacttccctgattaggacacagatttttttttgtccccagttcttttacttctggacatgccttcctagattactgtttttcaaaccttgataattcatctttttgtttttgatagccactatgttatctattggtgagtacctcaaaattcagtggcttaaaacaataagcatttattatctcagtttctgtggggcaggaatttgggaatgctttacctagttgatctggctctgggtctcaaaggaagctgcactcagattgccagctggaattttagtcatctgaagccttgtctcgagtgaaggatctgtttccaaggtgattctctcacaggactggagttggtgctggctgctggcaggaggcctcagttctttgccaaatgtaccttcccatagtactgcttgagcatcctcatggcatggcggcaggcttcccaaaaagcaagtgatctgagagagagcagggtggaagttgtaggtcttttacgcgctactcctggaagtcattcattgtcatttttgcagtatccaatgggttacacaggtcagtcctattcattaggggaaggtactacacaagaacataaataccaagagactgaaaaatcactgtgggtggggggagcatcataaaggctggctactacagctatctatcacctgtaacattatttacttaatattttccactttttgttaaaatcagccttatcctaaacaataatatcagttaagtcacaagattaatatgctaattgtattttccagcaaaaacaaatataaacttgtaattattattattattattatttttgaaatggagtctcactctgtcacccaagctggagtgcagtggcatgatcatggctcactgcaacatccccctcccgggttcaagtgagtctcctgcctcagcctcccgagtagctgggattacaggtgcctgccaccacgattcgctaatttttgtattttgttttttttcagtagagatggagttttgccctgttggccaggctggccttgaactcctgacctcaggtgatctgcccacctcagcctcccaaagtgctgggattacagctgtgagccaccatgcctggccaaagttgtaattattaatgaaaaaaattatctgtgtatcacctatgctcacttgcgtagttccagtgacacaaaccttacccttggggaaacaggaagcccagcaaacagggatctgtcagagagccctggtagttttcatcataaattccagctcttcccccactgtccatttggagccccagaagctacgggatgctaatgttgctgtttgctgtcctcttccaggaccgcctgtactttgtgatggagtacgtgaatgggggcgacctcatgtatcacatccagcaagtcggccggttcaaggagccccatgctgtgtaagtgagaactagtgctgtgctttctccttgggataaatgggtaggttagtggttcctttgagggtgtttttttgccaaagagggatctttaaacacctcgggcatctttttgaaaaaatatttagccagggaagaaaggtgttctgcttaatatgagatacttcttttttttctgacaccagctaagaacctgaagctcagacagacaccatggctcatacctgtaatctcagtgttttgggaggctgaggttggaggatcacttgagctcaggagttagaggccagcctgggcaccatgacgagatctcgtctctataaaaaataaaaaacttagctgggcatggtggcgcacagctgtagtctctcctaaaaataaaacaaaactcaaagctctaaaaccacagctatttatttatttctaattcatgtccctgactgcttagaaaggccctatatcttccttggggattatcattgtagattttatgtgtccatttgctaatatttattgagaacttactataagccaggccctaagtgcttaacaaacatcgtctcacttaaccttgagaataactctgggagggagatgctaccatccctgctttacaaacaaggaaatggagatgcaaggttttgaaagcttgcccaaaatcatggagctagtaagaagcagttcccaaattctgaccccggtttttctttgcccatgttctttatcttacaccactctccgtcttagatgccttcactccatgggggtgaaggatcaaggtgctcggtggcaatggtctgtggttcctgtgatggggagactgattctgggttgttggaaatgtgtttcctctgctgagtcaattccatccccttcggttcaaaaggcagctacagtctcttctttttagaacacagatttcatcatgtcattcccctgcttaggaacatggcaagttataggaattagcaatgataacctctcctggggagttttctaagatcttattgcctctccagagagcccccagagctcatctagaaccccaccttgtcatactagaggcttggtggctcctacccagttcagcttgccccctctcctcccacctggacaggttgtgagcactatgttctgataggatttgcattattcttgtgcttccaaatctagccatttgtatctcctggcatgactctaataggactagctttgcttttacttctaacatctaattgaccacaggctttaattccattgtcacacaagacatgtcaagacactttacatagttccccaaagccctgcccaacctttgtggcataactgggcttcccagttctcttgaaacctctttctttctgtgctgaccttcaataagaggttacactttagacagatgttgtttcttattccagctgcgccattcattcactatataacttgcccaagttaatctctctaaccctcagtttcctcatttgaggaatggggagatactagtaggacctaccttacaggattgttattaggattaagtcaggtaatgcctaaaatggtgctggggagatggtaaaccttcaacagatgttagctgctattgttaagataatttaacttgctatatagtctgaaagtataattctctcttttttgggggggtgggggacagggtctcactctgttgctcagactggaatgcattggtcctgaccatagctcactgcagccttgatcacctgggatcaagcgatcctcttgcctcagccttccgagtagctgggatcacaggcatgtgccaccacacccagttattttttttcttttatttttagtagagacaaggtctcactatgttgcccagctagtgaaactataatccttcatccagttcatcatatcccatgtccccttctccactatacaattgctgaacttctgcctacccccagtttgtccttaaggcaaccccatcaccctctaaaccaccctttgaatccatctgtactttcagcactttatgagctatatagctgaccatccatgggttctttaatgtcctacacctagttcaatattgtattgaattctgagcattgccaagcatatggtgtccttgagtttctccatcgctttttttttttttttaatttcagattttacgctgcagaaattgccatcggtctgttcttcttacagagtaagggcatcatttaccggtaagtgaacactgctgtactttccatctcttcatctccctcagctcctccctgccctgcctctttcttcagctgcttttaaaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcagaatgtgatggatcacattattatgaaacattttttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttgttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaaccccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagctagcacctgtaatcccaacgctttgggaggctgaggcaggaggggtgcttcaagctaggagctccagaccagcctaagcaacatagtgaggcccacatctctaaaaataaaataaaattagccaggtgtgatggtgcatacctatagacctagctactcaggaggctgaggtgggaggatcaattgagcccaggaattcaaggatgcaatgagctgtgatcatactactgcattccagcctgcgtgacacagcaagaccctgtctcaaaaaaaaaaaaaaaaaaaaaaggcatgttaagattagccctggtaagtacaaggcagatagcggaggccaggctatgggatgctggtaggatggagaaatgggaagtggggaccttgtcagaggctttcagagtcctggggcttttagtcacacctgaagtggtgatatggaatctatagggggaaggatgatcttattctgagggcacaaagtccccgccattcctactttctcctaatgatggagggaagaaggtcaagaagaggagtggttttacttggcatgtgggtgatcctagtgaaaatgtaaaaatagagagaagaagaagaatttagaagctgaggcaagaggatcacttgagcccaggagttcgaaactgcagtgagctatgattgtgccactgcactccagcctgggcaacagagcaagaccatgtctctaaaaaaagaagaatttaaattttaaatagtatgatcattctgcccatgcccatgtttgccctcaatgaacacgttcactatgtgtgcatgaaatggcacatggaaatcctctaattcccttagtttctcttttgactctcatagtgacaacatctttttgtgctgaatattattctggttttgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcgggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgagttgtgattcagggctagtttctaatcaatcaggaagccgcactgggatctgggatccatggatccggctcactggccaggcaggtggtaaaattaaaagattagcatttcaggtgctaagatgatacctattccaaagccccttttcctaaactaactacacactctccctttcatcttccactattaatatggtctttaaaggggtatttatcaatcttttaagccagtctgcatctgaacccttcttttgtgtatgtggaagaacagagtcaatcttctactataaataatgaaaatgacagatactcatttcacagcccacctgtagccagggcaggcacacaacccaagctctgacagttggtcatacttactcaagaccttgaatcagaaactagcggccaaggaagcagaaagcatagaatcaagagtgaccatagtaattatcagcaactactttccagaggcaagagaagagggtcttaatagcaataggcagagtccagcattagggcttcgtggaacaaggggtgatgtgtgtgtcccatggcagcttgggtggtggtgtcactggacaagccctgagttgcagttaggcattgtttcaggctgtatagactcttaatctggttcttcagtctcctcaaagattctatgagctccccaatatcctttgatgaattccttttcaggtaaaaatcatcatagttggtttttgttgctcaccatcgagaacgctgatggaaatagagttcttgaaattgatagtcaaatggaaatggtaaaaaataaattacttgacaaaagatgtatggttttatcatttcacagagattgatttcatagtggtaagatcttttaagatgttacaaatcactacctccttcatctaaatctctacttaattgaacagttcttaagtaaagaggatgaaggattatgttagacttaccatctttaaggaactggagatgttgggttgtggggtgggaagggaaaaagattcttcctatcaaacttagtgtctgatttactgaccactgtctctggaatgtgtgttggttttgcccttgatggttttctgaaaaatgaaaataatttctccatccaccttttgaagcagaaatgcggatttattacacagaacaaaagattagggtgtgatatcaaaacactgtatgtgacagtgaagatgacagaggtgccctccagcctcaggactgcctggctcttggcacctgaaacttcttttctataatagatgaagattttatcacttccctagtctacccagctgcctgcttctgagcatgtggtcgagctgaagggttgtcatttgtcactattagagaaatcacatatatcacatatagacctacctagtaagtttatgaaaagcaaattgctgcaaagcctgggttttctgagttccaaactttcacacaaatcatggtggcttgtagatgagcatgaaggctggatatgagcagcaccacggacagcgccaaaggcatggcgtgttgggattggcaaacatcagtgggcaagtgcaagtggacctccccatccctttgaataaggagaccccacagacacagataggagatgccaggatatagttttcagattgtattcttttagttggaaatgatgacagcaactcaattcaaagtaacttaggttaaaagaggcatttattggtgacataactgaaaaatccaggtgcagatctgactttaggcctggataaatgcagaggctcaagtgacgttatgagggcacattttatcaccctccctctaggctctgctttctctatattagattgcttcttttcatctggtgacccctggagtttctagacttccataataccacctgaacaaccccaatgtaaaatgcacttatccctttcctgattatgccagccaaagtgccagcactaatacttaacagctttgattggcccagattggatcacatgcccattcctgaatcaatcactgtgaccagcaggatggaatatttccattggctgggacaggcccacttgaccactgctggagccatgttacatggaagccatgttacacccatgttacatggaagaattgaaggagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggatttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcgtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaagagatcagggaacacttagcattaaatatttctttcaatcagcttctttttttctttgtaatttttagagatattttaaaaaataataattttctgaaaaatgtatcttcttacaaaatataaggagtctttaagtggcaaaggaaaattcttggaattttcctggatccaagaagcgtcatggatgctctgccctttgcttaactttctgtggatctccgtcttttcagaagtgctgtctctttgtgtccttgtgagacacttggcacagttggctgtgtagaaaaagaaaagcacggaggcttgcggacctctttttatctccctgccagactgtaagctgttggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccgattttggcatgtgtaaggaaaacatctgggatggggtgacaaccaagacattctgtggcactccagactacatcgcccccgaggtgagagctgctgggcacacgttcacattgcggtgatgtaccctctgctccccagatggctgtgtgagagctgggaagggttgagggtggtaccttgcaagggaacctcggacagattcttattctatactctaaatcctccctttgagatcacacatgcaaattaatttagcacacatccagaagcccaagcccaaaatacatcaaggtttgggagaaaatttaaataaaacccaaaagaaccatccaacacacatcagtaaaattcttcgtcaaactgttgtggctcacggccatgtgataccgcctaattatgacattgaaatgtttgttgagagaaaaagagcatatcccctgggctggcatatgacatgggatctgtgtcctgtatatgtccctcagcaggaaaatggacaatagcccgtgatttatttatagcatgaaatactaccaggcaccaattcagaagagtgagttagatatatatgtagatgtgaaaagatcttcaagacacattgttagagaaaaaaatcaaggtacagaatgacaaatacaaggccaggtgtggcagctcgcgcctgtaatcccagcactttgggaggcagaggcaggtggatcacttgagcccaggagttccagaccagcctggccaacatggcgagacctcgtctctacaaaaaatacaaaaattagccgggtgtggtggcacatgcctgtagtcccagctacttgggaggctgaggtaagagaatcacctgagccccaggaggtccaggctgcagtgagccgtgattatgccactgcactccagcctgcctgggtgacacagtaagaccctgtctcaaaaaaaaaaaaaaaaaaaagaagaagaatgacaaataacactatgatactatttatggatgaaacagaaatacacagaacactgttctgttttcaatgagtaaaagcatacaaaaatctggaagatttcaaactgattttataacactggttacctctgaggataagggaattgtaaagagaaatttagctatttctgtatactgctgacattttttacaaggtaaatgtatttgggtattacttgagtaataaagtaattctttaaaaataataaggctttactcggacccagtgaagttttccctatgtgatatgctttggtctattatcattttgttaattaattagataggacacaatccataacacaacttcctgataggccaggggttccataatctctggttctcaactctaactgcagtttagagtcgtgagggagcttttacaatgtaggatgcagctggggcatggtggctcactcctgtaatctcagcactttgggagcctgaggcaagaagatcgcttgagggtagaagtttgagaccagactggacaacatagtgagaccctaatctctacaaaaaaaattaaaaattcgccaggtgcactaggtcacccctgctgtcctgactactcaggaggctaaggtgggaggatcacttgagcccagcaggtagaggctgcagtaagcagtgatcatgccactgcaccccaccctgggcgactgagcgagactctgtctcaaaaaaagaaagaaagaaagaaagaaagtgtttccacacttttaaagtacttcaagtcttatttgatcctcatgacaagccaacaagttaatccttttacaaaggaaactagagcctgggatgtgacagcagttgccgaaggtgatgtggttagctcatgacaaagcctgacctgctgcttatccctcccatctgtgggctggaggggaggcaacttcaccagccacacagttgagggtttcttgtgcttgcctgaatcacgaccagcgaggaacttctgagaaccacagatcctgggcctccacctgcagagattctaatgggatgatgcttgggcatcccacattgtttcttgtgtgtgtgtgtgtgtgtgtgtgtgtgtttgagacagggtctcactctgtctactcactgcaagctctgcctcctggattcatgccattctcctgcctcagcctcccgagtagctgggactacaggtgcccatcaccacgcccagctaattttttttgtatttttttagtagagacggggtttcaccgtgttagccaggatggtcgcgatctcctgacctcgtgatccgcccgcctcggcctcccaaagtggaaaacacgttcaatgagaagtgttctcctggaatgctttcccttccttgtcttgagggttacttctcagaatgcatttcattcattcataattgaccagtaaaattgtatacatttatcatgtgcaacatgttgttctgaaatatgcatacattgtggaatggctaagttgagttaattaacatatttattgtctcacatacttatttttttatggtaaaaacacttaaaaatccctcttagcaattttcaagaatacaatagattgttattaactatggttactgtgttacacgataagtctcttgaatttattcctgctacttaactgaaattttgtatcctgtaatcaacatctctgcatttctgattttggaatagaaatcaaagtgggagatagagatcaagaaacaaacattcactttatagccaagtttgctcaaataccctttttgagttaaacaagcaataactgaattataaaacattctaggattagttaacattttgagggcataatatgtgaaagccaccgagtatctcattcatcctcacataacttcatgatatagagattatagaagttaagtaacttctcctgtggtcagacagccaaccggtagacagcagtcaggattcaaagtcagactgcctaaccctcagacctcagcctttagcctttgctgtattacctcttaacctctgacatggttagttttacatccctgcatactgaaagatggacaatcacatagctcttctagacttttccatgttcttgcagtttgggaatatgaattaaaaacttcacaaccatatataccatatgatacaccaattctacatctaggagtttatcttaaggaaatacttggacagatgtccaaatgtctaattacaagaatatatgttacagcattggaagaaacctaatcaactggaaatttataagatagattttggtatatccattcaacggaatgctatgcacagataaaaattgattatgttcatatacaaatattaaattagcaaggaaaacttaagtgaataactggctttattaaagatctattgcccataatcccagtgctttgggaggccaagatgggagctttgcttgagtttgagatcagtctgggcaatatagagagaccccatccctacaaaaaattaaataattagcatggtggtgagcacctgtagtcccaactacacaggaggctgaggtgcgaggattgcttgagcccaggaggccaaggctgtgagctgtgagctatgatctcaccactgcactccagcctgggtgacaaaaagagacactatctcaaaaaaaaaagaaaagaaaaaaagaaaaaaaatcgtccaaatactaaagtgtttatgtaaagcacacacatacacacagagtttaatatgtattcagagaaaagagtatggaatgaagtagaccaaatattagtcataatttttctcttaataaaggattatgggtgattttcatgttattatctcagctgagctatcttttataaagaaatattaaaatagtgacaaatgttgttatctcttaaacgtttttatgtttaattatgttttaaaaacatgtaacgtaaaatttactattttaaccagttctaagtatacaatttagtagtgttaagtatatttacattattgtgtaaatgttgtaacttttacagaggagtaaagacagtttttccttttaaaaattccatgctcactgttttgaaaataataataacaatacaccttacttagtgcttcgaaaaggcaatgtgacagccacaggtgtttgcccagctgcaggtgcctctgcaaagcatgtctgtcattccctgaatagctaatataaagaaacagttcaggtgggcactggccttcttgtaaaagaagagtgaaatctgtctccagaagaaacatgaactgcaaacctccctgatagggtgccttctcttttctagataattgcttatcagccctatgggaagtccgtggattggtgggcatttggagtcctgctgtatgaaatgttggctgggcaggtaattgaattttaagtgatcgataagagaagtcctccctacccccatccacatggtttctttaggagaatgcatgtttggtaacagctcataaattggaacctctatgactttcccggccttggggtcatacaagtctgtggtcatttgaaagcctgggtgtgtggcttcactgtgggccccagggaggagggtctgccagttgaggggagctagggggagggttcaagcagggattcttctcctcccaccctcccctgtcatacaggcaccctttgaaggggaggatgaagatgaactcttccaatccatcatggaacacaacgtagcctatcccaagtctatgtccaaggaagctgtggccatctgcaaaggggtaagtgcatctcttaaagctgtgaccaggaccaccacataaaggcatgtgggctgtaccttgcccaagaacaccccaccaggggggaacacagcctgaactccacccttcactccatttgccaatatgagaaccctgatgtggagctgctacctcccggaggagagagagctttttttctgatttgcacagaagtgctgtagagagctgcctgcagctgcgtcttgctgctggctgggctgcagtctctgaaccagcacaggggaatgcttattgaatgaatgaggtagaaagcacagagattttgtcaaagagctggaagtcatgggaaagggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagcaggatgtgtgtttatggggaaggattgtttgttttgcatcttgtgttggaccagggcatactcacagtgacttctgtgagatcctaaagatcagcgaccctcacctttggagccatcagaataacccgaagtgccttaccagaatgcacatgcttctgccttaccccagagattaagtctgggtatgagtattttggaaaagtctccatttggcttgcagaccactgcctttaaaaatactgtccaaatgaagtgatttttcaactctgatggaagcctgaaagcaatagaattagacgcccagaaaatatgttctacacataatatactaataaaggatttgctctccctccacccagtggtacaggttagaacatggccgtgccttaatcagtgggttcccacctgtgtgtctgaataaaccagggctgccagtcctagatctgtgggatgcttgcagacttttcatgccctactttgttcttcctgaccccagccagatgctggatgcactgtcttgggtgaaggaaagctgggaaactcaggcaggccaatctgaggcttggcccagtttggaatagctgggccagcctctcagcctaaaagcgccttgtcacactgcctaaattcccactctcaatgaatcacctaaggtttgcacctcagctgcataggctaagatgcatgtatccctggggaaaccacctgtgaattagtctcaatcccgaacatctaaagtgaattgcttgaaaatattttctttgagggtgtgaggcagggagaaagaaagtgaagaatagagaggggagtcccagaggtgcattaggaacccaagcaaagcccataaagaaaaaaaaggcacacacgaaggcctccacaggcccccgtagacaagttattgaagggtgggggcgggtagagagaaggtggtacctggagcttttagtttgtttaataattaccagcatataaggatccagagatttctcaaaaacattcagctttcaggtttctcttgaaaaatcagatcttgccacattggcctgtcattcttacaaagcaccagtcagctggattggaaaccatggccctctgtagttggagcttgccctctgtaattctcagacgttctcatttggccaattctctccaagttcaaatcctggttcaggcattaattgccgcaggaccttggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgttttatcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacataagagaaagctccttgcatgatgtgggcacatagtaggtgtttaatacatccacagggtcctccccttcacacgcccgccctgcctggacagctgggggttctaaatgggtcatggaggaaagagcattttccaggtcagctgccttcagctcctgctccaattagcagtttccctggtagagccgttttctattaattcaggacccataaccttcatgattaactggggtgactctcttactattgagtttggggaccattattaattgagtgggctgagtccaatggggctcttccttcaaggagggtactccaaaaacgagtgatgctcaagcaaacagccaaatgcttcctctggaacagcgagccccaggggatacgtctgggaggtgatcagagattggaacagtgattaaatccagctgtctacatggcttcgggcacattagagcagagtgcgggaactgggcagagactccgaattaatgctggatgtttttgcagtaccttttctttgcttggcatcctcctgcttagacagaaattcagttgagcttttgaaaacagtcacctgtttaattgaagcagtgtcctttatatgtccattcccttaaaggcccgattttctactaaaaaaaaaaaattagtaaaaccttactcagatggctattcccactttgaacaaacttgaagcaaacagaagcccaaatagacaggaccttagggtgaaaaccagcagacactgaacagctgagactgaacataaagctataagagtcctgagccaggcagagctgttcaaagccttgccctgctccttagctgtttgaccttaggcagatgactttacttctctgcacccacatcctttacctggaaaatgggggataatagttgctgaggccttagagtattgttgcaaagtttaaagagtaatgggtaatggccgggaagcctttagcacggagcctgaacgcatatgatgttgtcatactcagtacacggaagccgttattgatgttattatcagtgtgaaccaaaacctcactgccctttctttcctcccatcctaatcttacacaaatgtcaagccttggctcaatttcctcaccctccataaacctctcctgacaaagccaggccacaaaaattcctgagaaaaccacgtgtgaaatgcactcccatttttcttaaaagcccaagttttagagctaggcagaggtggagtctgcacccagctcttactgactctaccacttcctctctggagtccttactgttcctcaacttctctgagtgttcattgcctttttattcaaatgggaaaaatagtatactcacctcattgggttattatgatgatcagggaagctcatgcatgtaaataaagaagtagcagctcggcgcggtggctcttgcctgtaatcccagcactttgggaggctgaggcaggcagatcatgaggtcaggagatcgagaccatcctggctaacatggtgaaaccccgtctctactaaaaatacaagaaaattattagctgggcatggtggtgggcgcctgtaatcccagctactcgggaggctgaggcaggagaatggcgtgaacccgggaggtggagcttgcagtgacccgagatcgcgcctctgcactccagcctgggtgacagagtgagactccgtctcaaaaaaaaaaaaaaaaaaaaagaagtagctagcttagaatgtaagtgctcagttaatttccccaccctggaggatacactttatatgacaagtacatgcttgtgtgtgagaccacaaattatcttgcgagggggcaacaggctgagtgactgtccaacagtgtaggaatgaatttctgggttcattccttccccatcatcagcaagtcctgggcagaagattctgccatcatgggcttctcaatgtgatgtcaactctggaaagcttttggacttgtatgcttctttctttttttttaattaatcaccaactcttctgtctttactccctgtgcatttgctcaagtcttgagatcagagatattttcatgctgctttggactcatttacaagaggaagcctgtctggtttcatcttggcgcatctattcatcttgttatttagcactcagagacccaaagatggagggttttgataattaagtaatttaaacggaacaccaaagaaacctcagcggctttgtgtgtaatgtatgatacaagggaaatgagctgggctaggttttgactatttaatgggctttcagaaagtaattacttgaaacttgggcccctttgactaatactttttcttctgttttgtcatttttgcaagtgctttactgagaaatgcaaatggtatctgaatgaatgtagcctttgcttttgtcaaactccagttttcttgttgtgggaggagggaagtttgaagatattgaaactgtcctaattaaatgcactggtaattgcacaaaacttattcttaaaccaaaatggataaatggatcatgtggcatttatttttttctttctgtttttttttttttggttgtttttttggttttgttttttttttttgagatggagtctctctctgtcgccagactgtagagtgcagtggcgcgatctcagctcactgcaacctccgcttcccgggttcaacaattctcctgcctcagcctcccaagtagctgggactacaggtgtgtgccaccatacccagctaatttttgtatttttagtagagacagggtttcaccatgttggccaggatggtctcaatctcttgaccttgtgattcgcccgcctaggcctcccaaagtgctgggattacaggtgtgagccactgtgcctggccctcatgtggcatttctaacttgaagttcacggccacattcaggcttcgttttgattaaccataacagatgattggcagtgggtcctattatcaggtcctctcctgcaaattcctggctgggattttttgctgggataaaaagcaaaaaacaaaaatgagttgagattcttcatttgcgctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggcagttcagcagccagctcccacccaaggcaaaacagagtgaagcagagactgaagtcctcttgaactgaagaccccctccgggagggtttgggtgtggagatggctttgacataagttttataatgcaagaataaaactctcacatttcccacagtccatgtaccaacaggaaggttttctatccccaaagactcagcaggaagtacttgtcggcatcaggaaagaagagtttacacctgaattaatcaaactgttattctgctgggaggatatttccttgtgaaattaaatagagggcagacttggtgactcaatgatgggttgtaaaactactgactgaggctgaagagtgaacataaacaccatcattgaaacctaacgttgtaagggtttgagtgttaagatgaagaagataataatggtagttattttgatactagtattgttattcatttcttgagcacttacgtgctaggcacgtaatgataatagttttgacatcagagggttgttatgatgcataaagcactttgtacaagcctggtacagaggaggcactcacagagagctgatcatggttttcgttagctgtgtcatacattaattaatgtcccggtgtagagtctttgaggggcagaatcctgctgctgctattccttaagataacatctgtgtgtacattggggtcgaagagggccccacatgtcatgagcagcatcacagcttttatgggaccatttggaaaaagatgaaaaggtaacctggaaaggaagagtgagctctttgttcaggaaacagggaactcagaggtgagatgcataactcatatggtttttgtggggttatttatgagatcttgaaatgtggacctccctttcctctcttggccagatgcacacgctcccatccccaccagcatagaacccagcggacatctgggggtcatgttatagctgtagtgcagtggtttgcaaagtgtgctgtctatcagtatgcagtatcagtatgcagtgtcagagccagcggtattgacatctcctgagcactttaggaatgaagttcttggtctccaccccagacctcctgaatcagacactctaggtgtggggcccagtgttctgtgtttaataggctctccaggtgacttgatgagctctcaaggttgagaatcactgctgtggagtttggcattaggagctcagccagggaagctaggcagagaccagagggaggtagcatggagaatcatctccttttttttctttttttaaagacagggtcttcttctgttacccaggttggagtgcagtagcgcgatcatagcttactgcaacctcgacctccagggctcatgcgatgctctcacctcagcctcctgagtagctgggactacaggagtgtaccaccatgtctgcctaattttttatttttatttttaaataaatggggtcttggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccatctcaaataaataaataaataaataaataaataaataaataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggcctgccccgcaggatgcagcctcctcagggctgctccatcttcatggtatttggggctagaactcggtgctgtgggatgcagcagacctgtgagttgattgacagatcctgttacagtcagtgtagtatgtaggccctgtgtagtaagggcttagtgaaagggtgtataaagttaagatgtttatataaaatctcacaattttggctgggtatagtggctcacacccgtaatcccagcactttgggaggctgagccgggcagatcacctgaggtcaggagttcgagaccagcctggccaacatagtgaaaccccatctgtactaaaaatacaaaaattagctagatgcgatggcatgcacctgtagtcccaactacttgggaggctgaggatagagaatcgcttgaacctggaggcagaggttgcagtgagctgagattgtgccattgcactctagcctgggtgacagagcaagactccgtctcaaaaacaaacaaacaaacaaaaaaacaaaaaacaacaaaaaaaaaacctcacaatttcttttatatatcagaacaaatttttgaaaattaaacacagtttggggcaaataaaacacacccacacccatatgtatcccatgcattgttggtttatagcctcaggggtagtgatggttcaaagtcaggttgctatttagccagcatctgttagcaatggttatttacaaccagagtccattttgaccggttaaatattttgaatagccctgctaagcagtaatgaatataagaggtctagcctcgtgcctggctcatagaaagcactcaggaaaaggtagctgttattatcattgataatataaaaagattacaatacttagtcattatcaacgagatccctcaactgttctgcatttgatatgatttcccactgacctgtgtcttgaattcctccatgtgggtttaacaatgactttcaaagtacagtgatcaggctgtgctacatacttcaaagtgttctggtaccagctctaaaggagcaggtgctaccttcagtctccttagactgaattagaaataataataaatgatacattatccaggtacagtggctcatgcctgtaatccccacactttggaaggctgaggcaggcaaattgcttgagcccaggaatttgagaccagtctgggcaacatggcaaaaccccgtctctacaaaaaatacaaacgttggtgggcgtgatagcatccacctgtagtcccagctactcaggaggctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggatgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttatctgcttatctaactctacatcaccctttgaataacttcctagtttcctatataagtgagtttatctgtaggaaaagttcagagtgccttctttctttttaagcccctcttctccttcatttttatgacattgtgtgtctgtcttagtctgttttgtgctgctataagaatacctgaaactggggcctggtgcagtggctcatgcctgtaattccagcactttgggaggttaacatgggcagatcacttgagcttgagcccaggagtttgagaccagcttggggaacatggcaaaatctgtctttacacacacaaaaattacaaaaatcaaccaggtggggtggcacatgcctgtagtcccagctacttgggtgactaaggcaggattgcttgagcctgggaggtcaaggctgcagtgtcgtggtcacagcttgctgcagactcgacctcccaggcttaagcaatcctcctgctcgagtgacagagtgagaccctgtctcaaaaaaaaaaaagtggataacttacaatgaaaagaaatttatttggctcatggttctggagggtgggaagtacaagatcaggggctgtatctggggaggaccttcttgctgcatagtaacctgatagaaggcatcacatggcaagagaacacatgagggagggtaacttactttttaaataaattcactcccacaataataacatcaatccagtcacctccaaaagttcccacctctcaacactgttgcattggggattaagtgtccagcacaagaactttgggagaacacattcaaaccatatcaccacatttgctgatgttcttcctaccttcacagccactcccaatagaaattccaactccacaaagacttccagtgacagttgaatttggagggttgagaccagctcatgacccagaaaggaaaacagaaagcttactttttgttttgttacaagtgcagtctcttaaaaataaccacaaaatgcccccccaaatggcatatggaaaacagcacagagatggtgtgttaatctacctgaaatgtctttctaaggaagtgaggcttggatgggaacggaaatgcatccctttttcttcccagggtacacgtctttttctcacttcctctaactgggagccccagggcctggctttgtcttgtagcttcctgccgtgatgcaccaggctaagtgggaaggtttctgttctatgtctaaagtagcactggcaggtcctcattctgcttgtaattgggatgggaatatgggtaggaatttagggtttggcagagcgtacaggacctctttcaagccagagcacagccctgtcagacttactcactggacatgaatgggtcagtcagccctcagcagtaaccaccagctaccatgttaagtatttgatgtgaattttatcaagtcattctcgccacaccctacaagaaacttgagcttaggggacttagctaacttgcttgaaggttgtatagctgggaattgttggagccaggattggtacccaggttagcttaacttttaagtccgtgccacacaatcagatacatagtatgaggcaatgggatgtaatggaaagcccatgggctttggaattgaacagatgggctctggatcttggctctcctacttgaccctatatgaccctgaacaaactgttaactcttaaaattatctgttaagtagagataatccttttcctgcctatctcacagccttgtgggaatcaaagctataaaaagataggcaaatagaagggataattactatttgagggtgagtttacttgaagccaacaatgtgggtttaggatgaatggtgaagaatagataagaaaaaaaatgatattctgttgacatgggaagatgtttagagtgtatttcatctagtttcttttaaaaagcaagcaaaagaacagagtcatgattccacctttgtctaaaaactaaaaaacatccattcatctattcatccagccatctaggatacaaaccaagatgttaacataatacagagatttggggtggcgggattaagaaggattcttttgtgtgttttaaaattttttatggccaggcacagaggctcatgcctgtaatcctagcactttgggaggccaaggcgtgcagatcacgaggtcaggagttcgagaccagcctagccaacatagtgaaaccccgtctctactaaaaatacaaaaattagctgggcatggtgatgggtgcctgtagtcccagctacttgggaggctgaggcaggagaatcgcttgaacccgggaggtggaggttgcagtgagccgagatcgtgccactgcacaccagcctgggcgacaaagtgagacttcatctcaaaaaaaaaattattattataattccttttttttttttttttttttttagagacagggtcttactctgttacccaggctgaagtgaagtggaacagtcatagctcactgcagcctccagttcctgggctcaagggattccccgtgcctcagcctcttgaacagctgggaccacaggcatgcaccaccatgcctggccaatttttaaaaaattctttgtagagacaggttctctctatgttgcccaggctggtctcaaactcctgatctcaagtgatccttccacctgggcctcccaaagtgctggtattataggcatggcaccaccatgcctggcatcttggtgctttttaatagcttgtttgtttctgcgataaatgtaggagactgatagaagagtctggatctcttgtcaaatctaggatcaaatcgtggtcagatacttaaactaaacccattttctcattgcacagcaaggacttcatagagcttttggggggattaaaggaggtaaagcttgcaaaacacttaacacagtatctggctcatagttagtgcttaacatacactattatttgtccatttgattttttttcatccctgggttctagaaacgcagtggtgaataaaacagatgtgattttgctctcatgtggcttacagtctagatgagaacatagacaatcaacagagaatgaacatgtattaataattatagactgagatataccagattttatttctgttaaagaaatgaacaggatatcttgacagagaataacaggagggaagaatgagaatcctctttatttgaaggtggtctggaacagcttctctgacagggtgccatttaaactgagatctggaggaaatcaaaacactggatgttattttttaatgaaaattaagaaaagcaagagcaaaacaaaacagacttagtatcaaacacaaaagacccctctcctactgacttcctccctaaataaacataagagataaaagatccctgattgtaagggaccttcattattagcagaaaaaggagacttaaatctctctttttttctgccaaaacccagaccacaaatgactttttaaaatgatcaaatatgtatgcagctttgagcatctgattctccctggagtgggtccctcctgtattcggctgtgggaaactggaaggcataggaacgaccctgcatttcactggatgtgcacatgtgaaaaagaaagatgcgcttgtctttttgcctaggctatgtagcttggatgtcttttcatcgtgaccttctggtcttgttaacctgaaggtgtcctggtgtcttgatggaggctgggcaggtagctcccctgagccactagcctcatgttatcaaagtcggctaggcaacagacagcagggaggagccttatcctctcctccaccatcttaccttgtccatgccctctttttacctccatttcttctccaggctctttcctttcctcctccaaagaagcaatgtctctcttgcaggtcccactcaagtgagatgtcactccctccagacagagttcctggcccttcttgggttcctttcctctgtgctcaatggcagcacctgtcccatggtcccatgcagtggcctgtgtgtgcatctgtgtcctctgctagatcttaagctcaacggggacaagaacaggtaccctcttatgtatcgccagagtccagcatgctgctcggcagaggatctacaacagccaaatattagccttccttattatcccttagcaccaaaatacacgtcaaagcagccacttgttttagagtttttttgcttcattttgttttgagacagggtctcactctgtcacccaggctgaagtgcagaggcacgatcatagcttgctgcagtctaaacctcctgggctcaagtaatcctccaacttcagccttccaagtagctgggactacaggcatgtggcgtcatgccctgagaagttttaaatttttgtagagacagggtcttgctatgttgcccaggctggtctcacactcctagcctcaagcgatcctcctgctgccttagagtgttttactaagatgaagcatgttaaagtagcatcaggctaaccttaacaatttacccaaatactcccattctctttatttctatttttcaatttcttccatgataattgctgtctcatttaaaatagctttcacagcttcttttcttattacaaaataataataacaatacctgattgttatgtaaatttttaaaatataatcaagcataaaggggaaaaggaaaaaattaaaaccatctgtaattcttcgaatctccataagcctgtgtataaaatgtgtacagatattacgtatacatttgtgtatataatttatagaatgggaagatattgtacacactgttagtaattatataactatgtcatttaatattcttctacatcttcttttaatttttaagaatgttttgcatggtaatacatcaaatagatgtatcattatttatttaactgttttccctattggcccatagtagattcccaatttttctttcctctgacgattctttgatgaacaccctgtattttgatggggtaaatccaggagtatagaggacaggtcagggaaaacctcgtggaggaagtgacactgctctggagacagaaaggatgcacaggagatagctggatgagtggagaaggagtggaaggcaagtgttcctggcagaggaggcagcctgtgcaagggcctggagtcacctccaagagttcatgagtgttctaggaactggaaatacttcagtatggctggagggtgtctcagggggtgggggacacaggcagggaaggggccattgaccaagtgtccaggaacaggtcctaaatggccccttaagccatgctaaggagtgtgggctttgggcaatggggagctattgcagataagagcagggaaatggcatactccagtcagcgtctttaaaagatccctttagctggccatggtggtgtgcagctgtggtcccaagctactcacaaggccaaggcaagaggatcccttgagccttggaattcaaggtggcagtgagctatgatcacgccactgcaccccaacctgggtaagagagcaagaccttgtctcaaaaaacaaaacaaaacaaaacaaaaaagagatccctgtggcagtggtgaccaagccaactccacattcaacagcaagactctgttattaattcaatgaaacagaaattaaaagagaagagaaaaagaaaaagagcttacgtgtaacaggtcacagataagcttttcaaactgtctagattcttaaattcaggagcgtaattcaacaaatcaaccttcttactcctctccttaatcctgaaagaggtgcttgtggtttaaataacccagttggtttctggcccccattcctgttccaggagccccattgatgtaccctgatgacaagggagtcggattttctttttttttttaagctgagtgaggctgaagtgttcacccaagacaagccagagaggcaggtgcaatccatggtgcgtttttaattagatcccagccactgagctgcccatacttcaaggacacagcaggcaggaaactgatctgggctgtgtctcccaagggctgacgtctccatttagggagcgctcctgaagctaatggtcagtgacagctccatttgaaaaacacagaaacacttaacagggaggctgtgatctgccagccctgtaagctgctgattagcagggaaatcacgctccctctgtatcgcacccccttggttaatccctgttcttgtgtctcctctgtgctatctcacttaaagatttcattgttctctgaggcaggagggagtggggagagggagggggaggttgtggagctgccagaagctgtttcactgtctcccatcacagcctctggggaggcccaggcgaagaaacagccttctggtgtggatgggaaattgatggtttttaaagaaaaatggtccctgaagatgctctgtgtctcagcaaatgtgcttcctagactggctggcttgggttccaacacccaggccaaagaaaaacacgcacgggtctgccttatagtcacaccaggatgccataccagcagtccctgccaccatcacctctttgttgtctgctctgcctcccctttctacagtcctaagccaccattcctctcctgtggatgactgcggcagtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaatccatcagcaaatcttgtcaactctgaattcagaatataccccacatccgaatgcatctttccatccctccaccaatcaccttccttcaagcccccatcattcttaactggattatcataaccacctcctcactggttgtactgtttccactattgtcccccgctcatttaatctatccttgtacaccacaccagtgatcctgtttaaatgtaaatcagggccagtcttggtggctgacacctggaattccagaactttgggaggctgaggtgggaggatcacttgaggataggagttcgagaccagcctgggcaacatagcaagaccccacacacacaccctgtgtctacaaaaaaaaaaaaattagtcctgcgtggtggtgcacacctgtagtcctagctactcatgaggctaaagtgggaggattgcttgagcccaggagtttgaggctgcagtgagctgtgatcatgcctctgactcaagcatgggcaacagagcaagaccatgtctctaaaacaatgaaatattataaaaacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgctgctccctctgcctagcatgcctttcctcccgacatccaaagggcaccctctctcacttcactgaggtcttgctcaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagctaatatttgtatttttggtagagacggggtttcaccatgttgcccaggctggtcatgaattcctgagctcaagtgatccaccatcctcggcctctcaaagtgctgggattataggcgtgagctaccctgcccggccttggctttatttttcttcacatcacttatctccctctggcactaaaacatatattcacatttacagttacagtctcgtttgttgcttctcttccccagtaaaatgtaagttccatgaagcatggattttgtatcattttctactagcacagagcctggcatgtagtgggtgctcagtaaatccgtcttgaatgagaaaatgaataaacaaatgaatgaatctggacaacaattctaaccacagtgagtttaccgaggggtcatccttctgtgggagcttccctccactggccagcagaaaagaccccaggtcttcatactatgtcagagagttctcattttctgagacctgaagccaagataacaaaaacagcagaaacaatttagcttggaatgacaaataggtttccttaagtctgacaagagtcttttaaaaattcaagactgtttccttagtatttaaaacttaaacaccatgcaaatgccctattataggaaacatacgctgtctgtctgtagggatttgtagtagaaaatgggaactaaataatacttggagccatgatgcgttgatcacatactcagtacctgttacttgcattctctcattttatcctcatatcacaaccccagtgtgataggaattaaaattgctcccattttacaaaagaggaaactgaaactttaaggaacttgcccagagttgcacagatagtgggtagcataatgccagggtttgaattcagtctacagactcacttttttttttttttttttgcgatggagtttcccttttgttgcccaggctggagtgcaatggtgccatctcagctcactgtaacctctgcctcctgggtttaagtgattctcctgcctcagcctcccgagtagctgggattacaggcacctgacaccacgcctggctaattttttgtatttttagtagagatgggatttcaccatgttggccaggctggtctcgaactcttgatctcaggtgatccacccgcctcggcttcccaaagttcagggattacaggcatgagccaccgcgcccggccccagactcacttttactcagataagaagtgagcaggaggcagaggctcttggagacctaagtcccttgcatgcacagcaaatacttctgcttccctcaacaaaaaggctttgaagaagagcgtgcacctcttgactttctcaatgtaccttcactcctccagcaactgaagttcagtggcagccctccatttctcatcagtatcaccccagttgccaattgcaatgatcctttttcggcaactctcctatttgacctctgaaagatattttagttataccaatgcccttcacctggggtttctcccagtccttagcttggctgatactgttctctcctggttctcctcctgctgtcctaagacactttaaggagcatttttatcatgggcaaatggaaataaaacacctatttcacagagtttttacatgaatgaaaaaggtcatatattcaaaaacacttggcaaatgtctgtttcattgaaagtgctcactggtttttattactcttgttatctctttccactccccatattctgtgctttaaaaaaaaaaaaaaaaaaaaggtttttcaagacctctctcctcctgtgcttttttttccttttttttttttttttttttttttttcctttttggagtcaaggtctcaatcactgcccaggctggagtgcagtggtacaatccctgctcactgcaacctctacctcgctggctcaagcaattctctcacctcagtttcctgagtagctgggactacaggcatgcaccaccatgcccagctaattttttaaagacagggttttgccatgttggtcaggctggtctcaaactcatgacctcaggtgatctgcccacctcggcctcccaaagtgctgggattacaggtgtgaaccaccacgcctggcccagaacctgtgcttctgactccctctggtcatcaccaggactctcattggcctctcaaagtcgttatccaaaatggaattaatcatctttctcagttttcacactttctctgtctcagttcatacaaccacagtctctgtcattcaaaccagagacttcatcatccccatccttgtcttcccgctggccccttccccacttcattagttagtcagccaccaggctgccaccgtacttgtatatttatttatttatttatttatttatttatttatttatttattttgagagagagtctcgctctgtcacccaggctggagtgcagtggcgcgatctcagccgactgcaacctccgcctcccgggttcaagctattctcctgcttcagcctcctgagtagctgggactacaggtgcccatcaccacgcctggctaatttttatatttttagtagagacggggtttcatcatgttggctaggatggtctcgatctcctgactttgtgatccacccgcctcctcctcccaaagtgctgggattacaggcgtgagccactgcgcccagtcactgtacttgtaaaaatggagccaggaacttgggctctgatgtcagatggacctggttcatcttgctctgctattggtttgctgagattatgaacaaattacatagtctccgtggtctcagttccgtcatctataaaatggagatcataataatgcccacttcatagggccattgggaagattaaataaggtaatgcaagtaaagaactttccagtaaacagcattttgcactggtatatagcaaatgcataataaatatcagcagtcataattgttattactcctactactattatactattaggttgtggttacctcgtagagatactgtgttgaaaacacatagagcttttgtgcaaatgggttttgctggcaaagaacaaggaaccccaaattagcggtttgccccttctcattaggtgggaattagcatgtacaggtgtgagcacccatgcatgcatgcacacatttgcagacatgtacatacacatatgtgttataactctgcctcagatgggggcctttttaatatagaaacaccagcaggatgggtgagaaatggcaatggttttctctctagaacctgattgcttcaccaaacaatggtttgtatttcctcccacatccctccttcctaattgaagagggaatggctgaatttacctcctggcaccttgcatttgatgttcagtgactgatccagctaaccaggggcctcgtggttgcccaggcgttgcaagcatcaaacccagatcttcactgggatcttcctccagtggctggagtttataaattgtattctgttgagttggaaaacatccactgctcctgattgagagctggaggacagcactttgaggggtctgctgctataaatactgggatctcccaggtgatgtataaatgggtcactactttgcatcttgcaccacctgaaacatctcaggtgccttaatcccatgttttccaacagatgagcttggctgacttctcggggtgggttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagg

SEQ ID NO: 36956 - DNA, 153875 bp, Homo sapiens; identical to SEQ ID NO: 35889

SEQ ID NO: 36957 - DNA, 33722 bp, Homo sapiens
caaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacgccacagagcctcggggaacccacggagtgctggtgggaggagatcaacagggctggcatggaatggtaagggccagtccctgcactgcactggggctgggaacatctctgcatatccctcctcctgggggctgctagactctcaaggaatatcagtaaccaaagcctgggcaaatcccaccccaaacctcaccactgcatgctctgggtggagcagggctgctgctgagcggactacatgacaggacaaaaacctgggatggggagtgtctgtgggagacagactcctctgtggctctgttccttccagaagctgttctacctactctcagtttgggccaggggctggtgtaggtcggcgagaagcttgcttaccagactaccaaaagatatgtacagaaactgaaagtaataaactttatagaaattaaaactttctgtgccatcggaatggcatttttcttttttagaaatttatttttaccattttacaaaagtactggcccacagtagtttgggaacaagaaaaataaacaattgatctctcagcacggagggtttgagaactattgatttagagcaagtgaatggaaaagaggggacaaggacatttaggcaaaagaaagtggaattaaatagctgtctactgccttgattaaatgtgctctctcaattatgagtactgaggtccttctctctgcctgaatttaaagtgggttttattgctggaaaatagtttactaaagggttttggagagaggtgctgtcttcccctgactgcattctgccttaagcagtggcatggaattttttcgagcttgtacttttttgtggggtgtgattgtctcagctgggtctcagcccaggtgcttggtcaggagctcatcctagtaggcactgactgctaggctgattatttacaacagcctagatggagccagcactctaggaggcttggaggagagaacggaggaggcagtccagggaggaggaagcccacctggagggctgctgcatgtgctatctgtagagcaacccagatgtgtggcaacaagtacttagtgtagtggggattggaggggtcaagcacaaaatctggccaggtgtggtggctcacgcctgtaatcccaaacactttgggaggctggggagggaggatcacttgagatcaagagttcgagaccagcctagggaacacagccagaccctatctctacagaaaaaaaaaaattagcccggtgtagttgcatgcagcctgtggtcccagctactcaggaggctaaggtaggaggatcacttgagcccagggagtcgaggctgcagtgagccatgctcgcaccactgtattccctcctgggtggcagagcaagactctgcctcaaaaaaaaaaaaaaaagaaaatagaaaaaagaaaaagcatagaaccctgggggacacaaccagtagagaggtgatgatgggaaatccaagaggaagaaacaccgatgggtgggggagccaggaaagagagcgggcctttaagtaatgacaacagctaccatttattgagtgcttaccctgagcaggctccatgctaagtgctttatgtggatcatctcgtgtaatgctcaaaacaagggtatatcccatttataggtagacaaactgcagtctagagatccagtatttcctcggctagaaagctggggtttggatccacagagtctttgcttcaaagagtttgtactttgccacagtgacgggctcctgagaggctgctgcctccacccagagtgggctcccacccgacagctgactctgtcagcagagccagtgccacaggaccagattcagggcagttcttcctcctggagagggtggggacctgcaagaccacagcagaagcccagccccagagggatgatccctacttggttaccaggactgtggaggggctcagccggactgtagaaggggtggggagaggactcacacaggcagcagcaggtgagggtgccggggctgtggaggctgcttggacagcctttgtgggccattctcatccacccccatggcctctggtgagcagatttagttattcaaaaccccttctgacagatgctgattcagagaccaggctcaccttgattgttgtctccatgactcctcacagccaggcccactgcctaatgtggagcatggcaatgacctaattacaactgtccctccagtcctcacctctcaggagcactatcgcatgggtgcgactcctttctaacagccgttttttgtgccacagtcaagcagcactcagccatggttccccaagccatagaggaagagccctaggctctgaatcaggaggcctgggtctggatcctggttctaatgacttgtggtgtgaccttggcccagacgctcagccctccagtctcccgcctcatttggaaagtgagcagtcaggctgcatgatctctgaaggctccacagagctgtggctcacccctgaaaacactcttggctttttcttgcattctgttgatctttgtgttcatccctgctagagagagaagccaaatgatgtttagttttaaacttgccaactgtgactggtttgtcatgaactcccaaactatttgaagaaaagcaaaagaggaagaaggtgaaataacatgattttatttggcccatgggagtcaagggaaaagctgataggcgagatacctcttccacctcctcttactcggcatttttgggtgtgcagtgtctagtaattttggtttcctttcctccttccaccctctgttgcctccttctccccgtctactaatcacagggttgaaaactcacaaacatgcaaaacaacttctttacaataagatccagctgccccaggactgacacgaattaccctggaagcacttttaaaaatgattatgcctttgagttcagcctccagtctcagtgaaaaatctgtaaggaaagaaattgcttatgggctggggagctattacatctgacgttggctacaggcttagtctgttctcagggaacagttgttgatggttttgtgcagttgggctgccttgtataaccaaattagctttcaggtttattttaaaagaggggaggagtctcgaatataggcttgacaatagcacataggatctgctaaaaagaaaatctttctaatcaaagtgccatctttaaaaggtgttgccatcatagctgagtggtctgtggtgctgccattgatcacagtttctctgttgaaaatcacctcttcaagtgccggcttctgaagtttggatgatggtctctggcactaacaactaccaggaggccttacctgggtccccatgagtggtatttcaccatcccagggcatgcctaggttgttctcagggaatctgctctaacttgggtcagcacaggctgtagggcactgggtcctgtgtggaataagatgaaggtgaaattttctagtgagattgagctactgtgtagcggaaggagccctgggcttggatgcaggaaacctggattcacagctcctgcttgtatctgtgacattcggtatctcattctggcaaaaaagaaagagaagaaagaaagaaagagagagagagaaggaagggagggagggaggaaggaaggattgaaggaaggaaggaaagaaggaaggaagaaaggaagggaaagagaaaggaaaggaaaggaaaggaaaggaaaggaaaggaatggaaaggaaagaaaagcaaaggaagaaaaaggaaggtgtgactcccacctcacaagctgctacttgtgttactgtgatacttgtaggataaagtataagaaaactctaaagcaaattgaagtctaaaacaaatgcctagcacatcatgggcaggtagtaaaagtttagtgaatctgaaattgatgtggctgatgttgggcaagccagctttccacggagtctgagttcagaggaaaagtggtccatttattggtatctactttttaccccgggcttcaaagaatctcaaggagaagttttggagtggcagtttgtgttagagctgagtttatgaattcaatgacaagccacagactggagaagaggagaaagaatctatgcaacagggctatggcagcatcgaggtgcatttgaaggtggagaggttgggtgggaactccgttttccatggtcggactatttccctaatctaagcaagaccaagcctcagtgtagttcagggcagtcgtcctgagtcatggttctgagtattgagtactcacagggcccacttcctcggggatgctttccaagaccacctcctctccccacacatctcgctgtctccactccctcagcctgctttgtttcctacaatgcccttgtcactacctgattggcatttgtttcttgttttgtctccctcactaaaatataagcttcatgaacacaggggctttgtctcattcaccactgtatccccagtgcctagacaagtgctggtacataacaggccctcaatacatatgcagtgaaagaccaaatcagcagtccaaaccccagccagtgtccccacggccctccgcaaggaggcctgcaggttttcccacaggggaaccattttgcttatgtctttgattcccaatattccagtgtctatagtaggggttccaactgtattgttcacatctcattttgatttattgcatttaccaacatgcaggatggtctttcaagatttcttaaggatcgctaaaacatgcacagaggatggctgacacactttgccgccgcagaatgaagtttttatcaggttttcattctctcaataatcttaaggtctcgatcaatttcaaaaattgaaagtaaactctttatttcaaaagccataagggctaaatgctgcacagtaacctatcctggtttgacatttgtggaagaactgatgaaatcagtttggtgttataccaaggttaatttcttagcatttcttagcattcctagacactctagagttatgaaaattaacattagaggaacctgggtgaagagtatacatgaattttgtgtgctgtctttacaagcattctgtaaatctgaaattacttcaaaataaaatttaaaaaaataaatataaggatgcagcacaaatatagtacaacagaatcgtggaattccagcactggagggggtcttgggcacaatctagagcaacctccttacctcacagaataggaataaaggccatgagactgaagcaattaaaaactgaataaaaacattgctgtcaggttaggaactgtcatcctctttttacaaaagtagatataaatatcagtagaaggggagagatgggtcatggagcaattctgtttggaattaggagagaaatccataactttacataagtataggttctatggccctaaccctgatctacgtggtgatttatgatttatagagtattcctcatttatatgttcatttgtttattcattcactaccaaatgcttattagcacaaactttcccaggccccaggaagatggagatgaataacatacagtctatgcccatgagttattcaaaagctaatattgtttgatcttcacaacagtattggaatccaggtgtttcacacatgaggaggttgcccttgcatggctagcagatggcagacggaggacctgagccagccagcctgattccacagtgctgtgggtgatatgaaatgctgatgttatttttgttcctggataaagccatagtgagtgctgacctaaaaaagatatcaaatccacctaaggatgacttctgagggcaagaaggctgagtgtgggagaatagggttatgacagatctaggattcttgccaactttccatctaggtcactctcctaagtgctaggaatcaattgtctgggggaacttgagctctgcaaaaatggttgttggctgctcttgtaaggatggcaaaagctccctcctcccaggaggggatttgcttctgtctgggaacctgcaggacacaatcttctcaatcaataagagatttctgcagagttaagatatcgtgtgtgtgtgtgtgtgtgtgtgtgtgtgtgtgtttctttgagggatcttgaagtattgaaaagttaatgaagtttagagtcagaacaattctcaaaatgcagccccactgaccccactactacctttactcaagtcgtctcaactccgaaatactcagctttcacaactaaaacacacctccctagaactgttgttgtgagaattaaataagataatatatgtacattaacttgtgtccttaggggaattacttaccttctctaaacctaagtttccttatacgtaaaatggtgatcgtggtgagaagctcattatttgaacccattttataggattgttttgataattaaaataattaatgcacgcatagtgctaagcacaatgcctgcacattgcaagtccttgataaaggttatttattattactttatcatgactactctgtgtaaactgagactcatggagacaagtatcacacagttggtaaattacaaagctggagttgaaaaccaaattgctagattacagagcctctgaaatatatcattttgcttttggaacatataatttaatcacagtctataaatattatgtgtacattataagtgtcttgaatatttattacattttaatagacacggagatagcattagatctcttgtttaaaaatattataattgatattcataaactcacgtcaaatttactgtgatgctaatgtagctcatgcaattcctgtgtgacctggaattgctctcaggacataaatgcatctcacaagataatctagatcttctcagaggccttaggggaagcctctcctgcctgtatttttccaaaaaaacctgaggaatttgtatttttggaggcattctcgctctgtcctgtgctaggtctttctatccagagatgctgttctgcaggtcatttctgcttcactgttaaaaccttgtagacagactagcagacttaaaacctggacatggagaagacagcagaattcttacccagatgcaggcaggaagagagcagaatgtgtgcaacttaacactatttaaagagactgttcatatccccaccatggtggcaggaggatgagcagtaaacggtgcagtgttcaaaaactttgcattgtagccccatgaggctactcagtgacagtatgtgttaggtgaaatgtgtaatggtgatatcaacatgtcacaaggaaggaaagttagtatgatttggaattgtcaagaaaggaaggatctttgaaggaggagaggcttggtattgccttttgtgctctgatatgtgctttctgaggctcctctcagtgtctaattggagaagttcaatcctgacaatttctaatgtaggctccaatatttactgaaagtgatgtttcgtgactaggatgtagcctgtctttctatcagattacaggtacttttatcatcatggtagtaataactatgacttcccctgcctttcaattatatacgttgtgccaggttctatgctacacttgatatatagcatctctttagtttttgtgtaatactgtcaggttaagaactgtcatcctagttttacagaagtaggtataaatatcagcagaaggggagagatgggtcatggaacaattctgtttggaattagcagagaaatccagaactttgaaggcttcttttactgggcaaacttgcccccaactgtgtttgtctctgtcccttgccacttcactgctccactgtccccaaccactctcctatttctctgctcctctgtctttggtaccagtctacttatttccagtatctgtattatcatagtgtctgcttatcagttacagtgtctggtaattctgcctgtccaatgtcatagtgtttacttatcagtaccagtcttctgaagagattccagaccaagtgcagcatcaggtatagagtaagttctagtgaatatttgtcaaaagacttaatgaacattctaaaattctgtgggcctttttataaatgcctgatagcaactcaaagaattattctggggaaaatagaattaacaaaaatcaaagctttactctaaaagaaagaaactcttttggtactatttaagacctcatccacctttggggcgggaaagaaatttgggagtgttaaggatgctgtgccacatggagtgagccacttgtctagatcatgggcaaaacttctcatagtccatctctgcagtggggttggaaactggctaacagcccttgaaacacctgtgtgtctgtgaagctgggaaaaaaaagaccagcacaaccagcccatctattatctatttaatgaaattttgagagttcttgaccaagatggtgctgcttccttttaccttgttcatcacttgactcaaccccacaccacaccacctaaagtccaaacttcttagcaagtccaacttctaaaattgtatagaggggttcaccaacaaaaccagacactcacacaccttgcaaatgctctgtaattctgcctgtccaatagctttggacttggtaaagaatgcagacaacaagaagaagtcctgtccagcataccaatcagagctgtgggaccatctcgaagagatttattatatttcttgagagctcatgaacatgagctttgacctcagatgaatctgagttgggtcctggctcttccagttactctcttggccgagagttttgtaggcattatcactgactccacacagtgccttaggtgaggctccacaaagcatgtaaaggtcagggctaggactagaactcatgtctgctgattcctcaacaagggctctttcccctgcaccccactgctgttatgttttactattgcagatacaggagaaagtcttccgttttagctttcagggtgatgaccctgagataaatcattttcagaaagtccactttctcagaataggttcacaaatgtgttttcagaggaggagtaattaccttgtgactttccttctagaaagcttccagtttcagatggagcagggctaacaatactccagtttctgaaactgaaattgaacctcagccttcaaagaggtggtaagaaaaaaaaaaagtatgtcttctcagatgggaaggagagtcttgtaagtaaggtaccagtgccctcctgctctaaggaaatagtcttatttccttagagctgcggtcatgttatacaattcaccaggatattagccatcgtattggtgactgttaggaactcctcactcacatccatgaaggggcctgaaactccctccaagtagtttccctccaagcggaatagagcattgagccactgccctgttctccaggccattcaggagcaacaaccaggtgctgtgaagtgagtcagagcattagtcatttgaccgctacccatctcttttgaaattgagtttgagtaactttagcaatgcaatccctgacagttcccccagtcctgttccatttagaagttgcctctcttctcacctagctctgtgtttgtaatcctgcagctatggccagtgtttaggtgagtcttgttaaataaggagctttgttaaaagtgaaaatgagaggaatggaggagaggaatgcccaaagctatatttattttgccccctcatcatggagctgcagggagagaacggaagcaagaaaagggattgctcacccaagatccatgtaaactacttggagggagtttcagggcccttaatggaattgagtgatgagctcttaaaagtcaattctgcctccaataatgggacatagtcgggtcactcattcggtccctcattcttctattaaacatttgctggacaacaatgtcagacactgcatggaatactacttcctgagagtggtaaggcatactaaagtacctgtgctccaaagtgggtggctaagacatccaacctcattgagctttgttttagggaaacagcagctcagggagggcctatgaatccaccagtgttttactgattagagacaggggagccaagggacagcttttacaaagtagactcataattactgtgtagactaaacataagtataatgacactaataagcaatttattaatcccaggaattttacatgcgttgtcttatttggtcttcacgataactttaatacatatgtgctattattatgcccattttacagatgaggaaactgaggctattagagggcacgaaacccgcccagatgatacagctaagaacagtggagccatccagcagcatagccaatgctcttggccactctactatctgctccccacagtgtgaaaaggtacccccacaaagatccggctctggaaggaatgctttcacataccaaactcctgaacaggctgactctaccaaaatgtgaaggcaatcaaaccaaagccggaggaggagggttatgtttggttatctaactttcactatatgttcttaggctctgagtctgtagggtccaaataatcttcacagggcagagttatctgaggtggtgtgtgagaaagtgacacacacttcccgtacaggcactggggccagcagcctggccaacagctggcggggaatttgtggaacttggattgccttcagaactggtactccatgaaacagttcggcttatcttcctacatttatttttacttaggggaacttacccccatgggagctctgtcccctataggggtctgagtacagaagacaagccaaaacaatggaacaacaactccgtggaaaccacagcccagctcagttctgaaagggctttgttttagaggaaggcagcattttagtgatggtaggagaacaggtcacagagagcactagcttatggcaaccttctctttttggacacatatgagttttgcttatgattcttagagcttcatattgaaattacctctcacctactttactaagaattaggatagaatagaacaccctggtagatcagcccctaaagctacctttccaccatatcatgagcctagtccattccactcatatagcttgctgaagtatgccaggcatttacaaagtgattagtatactcctgatgagatgcgagcaatggtagaatgaagaaggctacatcagtcatatgcagaaaactgaaactggaccccttccttacaccttatacaaaaattaactcaagattaattaaagacttaaaggtaaaaacccaaaaccataaaaaccccagaagaaaacctagacaacaccattcaggacacaggcatggacaaagacttcataataaaaaacaccaaaagcaattgcaacaaaagctaaaattgacaaatgggatctaattgaactaaagagcatgtgcataccaaaaggaactatcatcagagtgaacaggcaacctactgaatgggagaatatttttgcaaactacccatctgacaaaggtctaacatccagaatctacaaggaaattaaacaaatttacaagaaaagaagaaacaatcccatcaaaaagtggacaaagtatatgaccagacacttctcaaaagaagacatttatgtggccaacaaacatatgaaaaaaagctcaacctcactgatcattagagaaatgcaaatcaaaaccacaataagataccatctcatgccagtcaaaatggtgtttattaaaaagccaagaaccaacagatgctggcgaggctgtgaagaaataggaattcttttacactgttggtcggaatgtaaattagttcaaccattgtagaaggcaatgtggtgattcctcaaggatctagaacaagaaataccatttgacccaacaatcccattaatgggtatatacccaaaggactataaattattctactgtaaagacacatgcacaggtatgtttactgcagcactatttgcaataacaaagacatggaaccaacccaaatgcccatccgtgatagactggataaagcaaatgtggtacatatacaccatggaatactatgtagccataaaaatgaatgagatcatgtcctttgcagggacatggatgaagctagaagccatcatcctcagcaaactaacacaggaacagaaaaccaaacagtgaatgctctcactcataagtggaagttgaacaatgagaacacattgacacagggaggggaacaacacacactgggaccagtcgggggtagagtgtgaggagagggagagcattaggacaaatagctaatgcatgcgggccttaaaacctagatgacaggttgataggtgcagcaaaccacaatggcacacatatacctatgtaataaacctgtacattctgtacttgtatcccggaacttaaagtaaaataaaagaaaattgtaaaacctagatacatgtataataaactacacagttgcacataccaaaaaaaaaaagctagatcatcaaagagccataggtctcaatttacaccttaacctgcattactgagcccctatagctgagttttctagtctgccagaacttcttacaagtcctgggaacagggaattcaagctaatttacatggttgaccgaataccgagcccatctctcaattcttctcacaacataatagcaaagtgattgatacagaacagtagtagagtatgagatgtttaataaatgaatgaataaataaataaataaataaatgcatatttgaattatatacattaggtgaataaatgaataacaagtaataaataataaatttaaaaggacggatgatttctgatgacagacaagtaatatatttaatatctaattttgttagatctgcaagttcattttcagcaatggaaaagaataaatgaaatccacttgttgataatgttacaatttgtgtgtcaacaaggcctctctcaccagtcagcacacggtacttactttatgcattatattttctgaaaacttatcttcccatgaaatacaaggttgcattccagcagctgtctggccatgcacatagacaactgcctgctctggctctgcccactcataagaggggatagaccaatggctgggatggtgggaaatgcaaagaaggagaggtaactgaagaactattttggaagggtttgtgaaagagctcatgctataaggtggaaatccactggatttcatcaaagggccatggctcaccatacccatctgggctttgcatgctgtgtgggggcagaacaaatgatcatccttgtgctcaatttccagggctctgctgttaagcagaagaaatgtttatttgaaattcgtcaatacattgtgcttctctttgtcttctttttattttaaattccagtaaaatgaattataatatcttttattttaaatgacatgcataatacaatcttgaatttgtaaaattctagatgtaaaattctagatcctggataagtagcaagaacagtggaaatgccctgactgtgtagagcttatggtcttgtgggtggtggaaagattcctggataagtagcaagaacagtggaaatccactgtggtcaggtagaaaatagtgttatcatcacagcaaaaagtgggaagcctgaagacgccataggaattgggcccgggaatgggagaaaatcatactagagatggaacaaaggaagaaatgattgtactattctaagtcaatgtttagttcaaaaggtgctgtgaagaccagcagcagcacaggtagaatgaaagagcaaaaattatttcttgtctgtggactggagtggagcggttatatatttgaagaattaggactaagcagctaggacaggaaagggatctttagagggggtttgaggcattcagttggcctgttgcaactctgtaaggactgcctccacagccaggattcttggtggccaccaggaatagaattctgagaaaaacatgccatggctgtgtagagcttatggtcttgtgggtggtagaaagattcctggataagtaggaagaatctgggttgtggtcccagctttcctactgggctgccctgggcacattcaccatgcccatctgggctttgcatgctgtgcaggggcagaacgaatgatcatccttgtgctcaatttccagggctcttctcttaggcagaagaaatgtttatttgaaattcatcaatacgttgtgcttctctttgtcttctttttattttaaattccagtaaaatgaattataataccttttattttaaatggcatgaataatacaatctcgaatttgtaaaattctagatgtaaaattctagatccacccatttatgcaggcttccatctaacaatatatattgaaagaggtatgacaggggcagtgttccctaaattttgttcagttagaaaattctgagtcacttaaattttaatggaggggctatgttatttctacaaatataataaagactattatttgcataaaatggaataaattgttaagaatctaggtcagagaaagagtgtgtaactgtggcagtggggtcttgggaaggggtctgtgtatgtgtcactgttcttaggttcctggggttgtcttctcttcaggtaccagacgtgctccaacaatgggctggtggcaggattccagagccgctacttcgagtcagtgctggatcgggagtggcagttttactgttgtcgctacagcaagaggtgcccatattcctgctggtgagtctggcagccgaccaaaccctcatgactcctggggtgggagaggcacctaggaagtgctctagcttcaggtaagcttgagggtcacacacaagcctggaaggcagcgctggcatatagacaagaatgaatgaatgacttaggaggatgttcccgccaagagggatctttcaggttatccaaccccccacatccttcttttggcagaaaaggaaacagaaccatagagccggcactgactggcccaaagtcacccacctactctgtgggaatgccaagtcttaagcttaggcctaatgactcccatcccagtgctgttctccttctccccaacttctggtaacttctcatcatatccaaggctgcagggcctatttgggaacctagtttcctgtagtctttctctgggagaaaccaatcctctcatgggtcagagtctagtacatagttatagacagaaaaaataaaatattaaaaaattaaaaaattaaaaaaaaagattgtgctgttttctggatccatttggaattccagcctctgatgttttgtttctttccctatccctgggctcatgccgaatatctcctgacctagccttccaattgactaggagaatgtgtatattgtcatttgccctgatgacttacactgggtgttgataacacaaccggcccaggtttttttaatctgaaaatgagccaggcatttctgccttgggcaaggggatccagaagtgtcaacatgtgaaggttggctccctcaagtgattgatctctctacagtttgatgcttgcaaggacagcttcacaggtcatgcttattctctgcaatcagacagcttactccacagatgcccagtggcacacagtatctctagggatacaaagccccaaaagcttaacgtttttctttttaaagtaaggaccgatagtaaattcagagctcaaagtcacctgtcactgtatgatggagcagaaacctcctctagttcttcaaaatcgcttccataaagcagcttttactcctctacagtgggtgaacaggcctggcaaaggattacgatgccactgggataggtcctgaaccaaagacctaaagatctcttgcagtggaggaggtagaaggagcaccagtttgggcaaaaagaaacttgagtttcagtctctgtgttggcctttcctcacttccctcccttctttcccctttccccttctcccctccctctcataactctgcaggctcaagcacatcacctaaaatgatgaccaccttttttgagtctccaagatctttaagactctgatgaaaactatagaccttgtcttcaggggggaaaatgcacttagcatgttaatacaatagtttgcagagaatttcgggagtccttaaactccctgaaggccattcatgaacacactgccaagaacccctggatcataagttgaaattccaaggactagaagatctttcaggttgtgttgaaccctaaaaatgtcttaattccaaagacacttttggaaaagatgatccagatgccagaactgttttgagaggatgaaggaagttccaaagacgagtgcgccctaatgaaaggggagagtaggtaggagcttggcctccacaaatctctcattcctggtctattaacagaatggcacttcccacaaggaaaccagcctccctttgttgcaaagcattaaaagccagttaaaatgtatgtaaattacctgaaagagcaagcaaaacctaatactcagtcagtgaatttatttactacattagtataactttccctgaatcagactccaaaggaacacatcagggctggggtatgctgggtggccaggaggagtgggttcaggagcaggggaaagagtgaggaggtgaggaggtagccctgcacgggctgcagtggggaggaaggggaacatggacagcctaggggcagctggaggcctggatgttggtggctctgtctctctgcccttcgtagatgcctctgtcacagcactttatgcattttaccacctgtgtacagttgctcctctctacctggacttccagtgtctggaggatatggggccactcactgatctttgtattttcaatgcccagtatagtgcttggaacatagtgtcttcttaacaactgttgaacaaatatccacattaataattgtggagggtgtatataatgtgaagtggcccagaaaatataattctcttacataaaattttttgttctctcccccatccctccacttctgcccagaatataagctctacacaagcagagatctttgtgctgacatatgccaagccctataaataatgacaggcacataacatttgtttggatgaaggaatgacttcaggctactttttgttatgagcattaaataagataatatatttctggccttgccactgtctatgatcacacagagctgacctgtcttgaaacagagtccccttcaccctcccagatgcaggagagacccagcctcctcaccaactaacaggacattcaaaggcaaactctgcccaggaacaacctagcaggtgtcaggtcattgcaggaagcagaacttgagagcggggttggttatgcagaggaacaagacatgtgaccagttggacagtctgttgttagatgtactaactcattcttccccaggcagagaggagtaagctgaggcagcaacattcctcatcacagcaaggctcgaggtctctgcagagatgagtgggagagcctgctgtgtctgtggccatgccatcatggttggctggcccctgcccaaacagaacaacaacagatagtgggcttgggcctcaaggctttgggtgaccaggcaggcaaggagctaaggctcactggttttagaaaatttgtcaaggccgggcatggtggctcacacttgtaatcccagcactttgggaggccgaagtgggcagatcacaaggtcaggagatcgagaccatgctggctaacatgatgaaaccccgttctctactaaaaatacaaaaaaaaaaaaaaattagccaggcttggtggcaggcacctgtagtccctgctactcaggaggctgaggcaggagaatggcatgaacccaggaggtggagctcgcagtgagccgagatcacgccactgcactccagcctgggcgacagagcaagactctgactcaaaaaaaaagaagaagaagaaaaaaaaaagcaaagttgtcaaacagaagaaatagggggtggatgaaggtaagtgtgagagaaagggataaacatctaaattttcctggaattcccatattccgtggatctgtgggatctgtgttaacactctgagcattgcttcttgaagcttatcctgtctgtttatttgaatgctgagacctgaaaaagacaggtctttgtgtttccagttccaccgttgttttaatgatgccccagatttccagtggtcacctggagactggttccaggatacttctgcttccccaagaatgctaggtatcgttcctctcacatactttagaaaggcttctcaagctcccttagatgcaattcaccagctaagatgctaaaaatgtaatgatcatatagacatatatgtaggaacaaagtctcaatgttaaagattgatagataaagatgagcaattttgagttgccagagatattcatgtctctgctcacaaagtttacccaaagccttgatctgcaatgactttgccactctgaacccaccccaacccccataccctttacccttccttaccccatcctaccatccagacatgttgctgttggtctgtggagccaaaaggtggggaaagtacagagaattaatccaaaaggcatgacaagtcaactttgaaacaagtcccactaaggtgtggttccacctgctggttctatttctgaaggcatggtgttagagctgagagctatcacggtcaccaaataaaatggtattttttcaaagaaaacattggagaagcagcagaacaagattcaagtgtgcaccatggtacacagtgtatgactcactatcccgctggtgtgtctagacattttagtggcatctttaaattgcctgagtcatgatgttgtattatatgtctttctaaatgcctccagggcataaattaggtcttattttttcaacatctccaggatattacccagcacaaaatagactcttaataaatgtgtcagatgaataactgaatgttgcaagcccctaggaacagtaacaatggtgaaacctgacattgatgtgatgatgttttatagttgacaaagacttctttcatgtacattattttatttgatccttttaacagccttacagagtgaagtgagaactctttttcctgcaccttcccacagtgaaatgctgataaccctcttatctgaaaccttcccttacatgactttaattagcttgaattacctcccagggaactggacccatgtgggtgggaacgacatttttccccttccctctttgaaaggcattcttcagcacgcagcctgacaccgtatgaactagctaagtgaatatctagcgcctgcgtttgtgagcacttagggattcagaaatatcatcactctgggctggaaaaaacaaatcatccaaccaactcccaaatgagtatgagatttatttgtttggtgggaaccaaggtgctgctctcgtttcagcttgtgcggtttctctttggatattacagcctcactggactctggcaagaaagcaaattcctgagagatgtggacatgccattaggaaatggtctccactggattggatgaatagtgaattttatagatatttatttagatatgaaaattctaattcttagtctagtggtctgcaaaccacaaacacatgtcactgaagttgccacaaccctttagacattgtttgtcataatctctcttctccaaacagctcagcagctgcaggctgcacaccagactgtctactgtccaggcggagactctgtgtcccaggatctgatggttgtgaatcattttcttttccaaatggctcttctccagacccatggcctttcattaggttcattggataatatcttttgactgtaaaataatgcatccatttaggtaacctttacttttctcttcaaccctgatattctgtctctcagactttgcattctccactgcctacttccccactctctgtgtgcaagtcataagccagagagtgctttttttaaattcctgtatagctctagttaacatcagttgattagaacattcttatctctcccaccccaaagcacccagtcaaagctaatctttaattcttagcctctttgttcagatgttaatacaagatagggagtgtttgcatgttcactcctgtaatgctgttttagggacatgaacaatctcacaggcctctgcattgctgtgcctgtcatatgccacctgtgcccagacagcctcctgcaattcagctcccagaggcctggtaagaagagcagcttccattaggtatatctcctaatgttagttaacaggtgcagcacaccaacctggcgcatgtatacatatgtaacaaactgcacattgtgcacatgtaccctagaacttaaagtaaaataaaaaaataaaaatgaagagcagcttccatactggtcctctgcgcaagctggaagctattactatagagatggacatacttaagttttgaggaaattggactagatgtctcaatttaaaggaacttatattgggtttagatgctctgcgccctactaaaaccattgccttccattgcatgatgtacatagcactcattgtgcagacagcagcctctctgaacttgagcaaaatctatcatccctttcatctgctggaatggtttccataattattgtgccatatttaaaatgtagacatgtacaattggcactccatatctggggttccctatccaagaattcaaccaactttgaatcaaaaatattcagaaaaaaacaataaaaataaaaataacaatacaacaataaaaaatgatacaaatacaaaaccatatagtataataactactcacatagcatttgcattatcttaggtattatacgtaatctagaggtgatttaaagtaaacaggaggatattcataggttatgtgcaaatgctacaccattttagatcaaggacttgagtttctgaaaattttggtatccatgggggtcctggaatcaatcccctgcagatgccactgatgactgttgtattagtccattctcacactgctaataaagacatacccgagactgggtaacttaacaaaggaaacagtttaattgactcacagttccacagggctggggaggcctcaggaaacttacaaccatggcagaaggagaagcaaacatgtccttcacatgatggcaggaaaaaatgccaagcaaaagggggaaaagccccttataaaaccatcagatctcgtgagaactcactcacgatcatgagaacagcatgagagtgaccgtcctcttgattaaattacttcccactgggtctcttccatgacatgtggggattatggaaaccacaattcaaggtgacatttggttggggacacagagccaaaccatatcgactgtatttggtgcctgcattataggtgatacctctctccttatgttcaaacttcaaaagcagaaatatcatagatgtgtctggctaagtattggttaacccaaggccagctacttagaacaaagtaaacctctcagttacaaaccaaatctgatgctttattctatctagtctgcttccctctactataatagattctagaggcaatcattcttacttctatttattaattcacttaagcagtcaatgaatgtgaatggatatgaaataataacaattcataggctttgggtgagaccctactaatgataatgatgataataataatatttatttattgacacttaccacgtgttcctgtgttactgcatttaatcctcacacacaaaaattatgatactatcatacagatgagggaactgagctatagaagttgtggctcccttcaaagttccaaacttgactcaaccagtctatctgcctccaaatcccatgctctttgcatagtactgagctgtctctagatgaggaataagacttctacaggtgaaatattacataatagcacagtaggcatctggtagaaaacagagaataaaactattttaattggaggggagctgttgaaggtcaagtagcccccactgacatgcaggcccagggtgaccaccacataatgtggctaatgaaaatcaacacgagtcaaagtgaatgtgcttactgactagccctgggcttggacagtgagttagaaactcagttccaagagagcaatttggaaagtgttcagggactttcctctactcatttaagctacagatatccctggaactgttattccctcgtgttgtgatacatgtctgaaatgtttgaaatgtaaagtcccaaaatgccataaaaggacagacatggacatttgtttttatttcacacacctcagagcccctgggttcagattttctgtgcagagaagggcacttgggtgactaccagaggtcccgcttggccaatccccagctcttgtgggaagaagcctggggattgttctctgtggctgttttcctttacacataactccatttggggtttattttttctgtctttacaaaactaattcaaagggggtctgatgtagctcctaataaagacaaactaaattaatctgaaatatgttcattccttatagcttacttggaaaagcattatgcaagaggattgatcatgaacagactggctttatttaacaaacttctcaatgatttgactgtcagaaagggacatctttttagctgaatatataaaacgtaagccaacctcaacacaccaaatccgcaaatgttgagtttctcctccaaacccacctctgaaccagatcataaaagcatatttgattccatgcaccagtgatccctcaaagagctcactatattggccatcatgatgttatacagtattctattatcttgctaaatatatagtgctgatgtattagtccattttcatgttgctgataaagacatacccgagactgggcaatttacaaaagaaagaggtttaatggagaactcacagttccatggctgaggaagcctcacaatcatggtggaaggcaaggaggagcaagccacatcttatgtggatggcagcaggcagaaagagagcttgtgcagggaaactctcatttttaaaaccatcagctctcatgtgacttattcactagtatgagaacaacacaggaaagacctgcccaaaggttcaattacctcccactggatccctctcacaacatctgagaattcaaaatgagatttgggtgagacacagccaaactgtatcagctgacatgtcacaggacatttgaatgggatatttaaagtaatgtgctaattgagtggtagagaaatagaagaaaaacagaattcaatattgaatgaccaacagaagcttctctaaaatgttgtttgagcataagctgggctataaaagatcatttggaagacattctaattttattcttattttttaaaaagctgaagtatggcttcctcaggtacccgttctgatctgttcatatgtaaatgctggggtttttttccagtttttatggtagggagtctgtggtgtgtgcttttctggtgtccccacaaagtgggccaaggttggggatatgatgtttcctgaccatgagatgaagctgtatctgttcatgtgcacatcaattggagggaaagtcctgaaagaggagcttccaggtgacaccgactaatccagttgccctaatttccccaagtgaaacagctgtaacaaacacatctcagtgctatgaagtttgactttcatagaagaaaagtgtctagctccgaataaggtctcgtagaggtgggttttcacaaaaccttacgctgagtcactttatgtcaaggaatagattgaaaatctttactttaactattaaaaacctaataagttctcaacccaacctctgacaatgaataaaattggccactgtatataactagattgtatctctatttccctttctaaaatggatgtgagagcgtatacctggactcagctctgcaatatgtctgttcttgtggcaacggagccgagacatctatcagcagcagctcagtctatgatattgtatcatagcaaacattcattgagtccagttggatctgttaataattttagagcttcaagaatcttagatgagaaaaatcctatatcaatcttaaaattgtcttcagttcgaactgatttccctcagctcataagtaaaatattattaatttttttaccatcagcttcagctgacacaagagttgtgcaagtggctttatgttatcaagttttttcttagctttggaacaactctctgtctttcatcttgacagcagaaaaagtgctgtgaagtgagaaactgtaccacaagagtcattcatctgaaagtgcgcatgcacacacacacacacaccccacacacacaccagtagttttgctttttttgttgttgttgttgtttgagacggagtctcgctctgtcgcccgggctggagtgcagtggcgcgatctcagctcactgcaagctccgcctcccgggttcacgccattctcctgcacagcagtagtttttattaaaaattaagtaatagctaaaattgaataaatctattcaaacactttactttaggggaaaggagaaaataaggcttcccatagaaatgtttgaaaagtagactcatttcaataaaggcatcttcctgacctgcgctcttcttcatcttgccaagctgaaggtttgtttgattgttttaattggtctaggaatgtatggcaatgctcagtatgaagtgtgtttttccaaaaaactgcttaaagtgacctagtaattcacaaggaattcacaaggaagctgcaaccacaccgaactcttccccgacctacactcgcaaagcccagtgtcacagcttaggaaaccctgatcattctgcttccttgtagcctcttttaatttcctgaaaagtccctatgccctgtctcagtgtctagttctgaacgtttaaattcttttttctctctaaggagctattactgggctttcacttattaggacactttgtgcgcgtgtgtgtgtgtgcgcgtgcacatgcagtgtcatcaagcgctaaatgcagccacatatatctggtttgaaaatacagaacacagcatcctgggccacattgactcaatagttcttcctatggatggtgtttgggaggttcactttctaccagtgatttgggtcatttctcccttggtatttttatttcataaagtaggagagatttccatcgatatccaacctccttccctctcctcctttacccaggtttctctaggacagtctaaactcaatcccatggtgttataacaaaaacaagacaaaataacaacaaccaaaagtcacacaaaacaaaacctgtctgggaccaagaagaaaaagtaccaatggtcatgcacctcaccttctctaggacattctagaaattcactggacatcagtacctcatggagaggcttctcggacaaactgtccagttagacagggggcttatgtctggtcactaccaaaaatgaagcaacagagaatcctaattaaagaaagcatgaaataacattttccttctttgaagcttaaaacttcttgatgtttttaaaggtaagcttttctttcccactttattccgtgatatttatccaagtatctgaagacagatcagagtggtcagtaaaaacttaaaaaataaaaatctagcttcataatttccaaatacttttggcaattggatttagcttaatgcagtgttgctgtatgtagattctgccttagcaaaaaaaagaaaaaacacacaacttggtaattaatttttacacattgtatccagagatgcttcaaaagttttagaaaatattttttgttccctgaagtaaggaaaacacacaccccctcccacccccatgcaacctcttattctaatttgcattattgatgttctcaacaaacctctctttccttgggttaactttaatacagtccttgttagaattctcatggatcataaatcagtgggatccaagtaaggccctattagttctacttataagacatttaccatgctgggcgcagtggctcatacatgtaatcccggcactttgggaggctgaggcgggtggatcacttaaggtcaggagttccagaccagcctggccaacatggtgaaaccccgtccctattaaaaatacaaaaattagctgggtgtggtggcacacacctgtaatcccagctacctgggacactgaggcaggagaatcacttgaacccaggaggcggaagttgcagtgagccgagattgcaccagtgtgcaacagcctgggtgacagagtgagacttggtctcaaaaaaaaaaaaaaaaagacatttacctgaaaggtaaagtcctgcttctggatctctttagaagcacaaaataagtttctggatttgcaggaccttatttcccttcatgaactcgttaagcaaaaacacaggtacctcactttgggttggacttggcatcctgatagagcataattacgtcttaggaaaagtcaaatcagagaacaagggttagtgaataatgggtaaaaggaatgattatgaaccaagagaatgagctaaccattgatctttctccatctgtgcactgagatcctcctaggagcccttacagtttataaatcaatcttttcatgatttaatgacaatcttggagaaagatcaccatcagtctgcagaggagaagatctttctagcattaataaacagtgatctggtaaacccaaatcagatgaaattattgacactcacaaactagttgttttccaagcgtccctggggtgtggataaagactttggaggagctatttcatggtaaaaggactgttttggtcctgaaggttccagtggcaaagcccttatgagaactgggggattctagactttattccaggatggactaccatggacctactcatatgaaggctcaggatttactcaatattggaagagaaggaaaggaaaggaggaagaggaagaagaaacaaaatagttcttagtgattcaacacctaccatgtactagtatagcacactcatcactcatttttattagttccaatgacaaacctataaggtagactttattcttctacagatcagaaaacagattcattgactttccccaggccatatatttattcagctaatatttattatgtatgtgttttaggtgctggatgaacaatggtggacaaggcaaaaactctacctttggggagcttacattttaattaaataatttttgaacactttgttgactataactcacaataagaaacattaaactatcgcaatatgtacatcttataaacaaacacacatatatatttgaaacaaaatgtttacatacatagactcgtccttactgcatgtgatgcatgcttttatattttcttttctattttatgtctcttttaaagccaattaaattgattttgttatcaactaatgaatcataatctaaaatttgaaaacattgtcttagttgacttgaatagaataggaatagtattgatattaatcaatatcaagaattccaaagttattttgataattccaaagcctggggaggtatcttcatctttttcagtgcacagtttaatggcctagaaaaggaagatgagaagtgggaggagagctgtctgtttcttcacagcctggagttgtttggtggatgtcatttaacttcagtctggatttgccaggatgctcaaactccatctcttcttcatagtgtgtcttctgtttgctcccagcaataataatgtgtttcattttcctctaacctttgttcttcctgcataggctaacaacagaatatccaggtcactatggtgaggaaatggacatgatttcctacaattatgattactatatccgaggagcaacaaccactttctctgcagtggaaaggtgagaaagacagccccttcccaatgggctagggttaaaggagttgggactaactccctgcaaggattttacctgcaggaatttataaacacacacacacacacacacccacacacacacacacacgtagaatacaagtgaaaatttcttacatgcacatatatttctgcaggaactttgacctgaggttttacttatcttagtttcctacctggtcaaggattaactgcagttttggctggaaaatgggaggcagtgggaagtgagctgttctcatgagctcacctcatggagctgctcaccttgcaagtgagggtggattccagcctgctcaagagcagagagtcctaaactcggtatcccttgatggtctaagcttttcccctcactcaatttcaaagagcacttttcctcatgaaacaccaagaggagaaggcaaatatgcttagaggagtgcccattgtcaaaatggacccccttccaccccgtgcctctatatcatccccactttgggttttaggaaagaagagagaagagaaagaaaagggattggagataagaaacacacagaacctactgtcttagtctgggctgctataccacattaccttagactgggtaacttacgaacaatagaaatttattttcacagttctggaagctggaaagtccaagatcaaggtgccagcaggttcagtgtctggtgaggggttgctcgctgcttcagagatgttgctttattactgtgtcctcacgcatggtggaaagggcaagccagctcccttcaacttattttatatgggcactaatcccattcatgagagcagagccctcatggcttaatcacccccctaaaggctcctcctcctaatactatcacattgagtattaggttccaatatataaattttaaggggacaccaacattcagaccatagcatctaccaaccatatttagaaatgaaaggagttaacaatccctcagtaaacctgcaaaaattaatgaaagaagagaatttaaatggcctaaagataaaaacagcactaacacttttttcatcacctttctctcacaatcaactccttaatcctatctcaaatacatcaaaacggtaagaagaaaacaagaattgtactccctattaatatagagaaatgtgtgggtaaattcaggtgttaatgattggtttggcctacttttagtcagccgataatcactttacacagaaatgaattcctgaaaagttaccaataaatattttgcaaaccaaataacacttacattaactcattagatagtatgctatgatgaatttgagtgtgacacatctttggtgtgtgtctgtgttttcaaacagaattacatcttaaataaagtgaacttatttaatatgacctagaatttctttttttttttaaaaaaaaaaaaagacattaagtagctctggaaaggcacaatatatgttgcaggctgatcagcaaaaacctttatgtttacccataggcaaaccactcagtttgcacacattacttatttttactttagatacactttaaactagcttagttaccaattttctagaagcagcaaattagaaagggaaacgagtatatactacttagaatgaaactcattccaccaatgagaataaatagctggatgacatgataacaaatatgcttaagaaaaataaagaaaatgaaaggctcaagaactcaaagaacatgggttgtcatttagcagggccatgctccccaaagtgcaaaacgaaataacaggggtgctcaatgctccaaatgatgacttcagctcaacaagaaaattagttctatgttccctgtttaagaaagcaggaattaatacagtaaaggaagagtgccatccaagattagtatgaaataaatatatctgagtagttaaaatgctcaattcagttttcagtaaattcactttttagtaaatttttcggttatgtggattacccagaatcatgaaaaactgaaatattatgtcattgcattaatttaaaatgagtatcctccccccaaaataaaataaaataaatatactcatgcaactttgctactgtcatcaaaaataagtagcttaatgatccacaacttgggtttcttctcctctgctgaaagatgctgaggtccccagcttggagaactattgtcagggcaggactccttgtgcaagagctttccctccacatgcaaatcatagtggtttcctcttagaatgctgttgttccatctatgcgctattgacatctagggccagatatttctttgtttcagggtctgtcctttgcattctagatgtttagtctacccactagatgccattagcaccccaccctaaccaaaagaagttgcagacattgccaagtattcccttggggagcaaatttgcccccactgtcctggtgtgaaatcagagactgaacctggtggaatcatttggtcttcataagaccaagtctaagttttgctcagcatcaattaatagccttctaaaagagtagtttgaatgcctgatcataagatcttgtttatctgtgtttgttgctacacagataaataagacctggctgcagtaattacagacatttggtaaacccacaggccaccaattttctaatttccttctaaaacaatctatgacctcttttgacaattgcaggaatcaaaatatcacccaggccctggtatcacccagaccctcaagttgatcacccagatttgtgttgagggactctatacccaattgttctaaacaaacgacccggagcaacagactcagaattagaaagcctgccttaggctgtttgagcagagtgagccctgcttcctaggactaagagcaatcagccccacttttcagtttagaagctggatggaggccttgttagtcatagtgtttaggataaattgttgaaaagagggcttgcagattgaaaagggagatagataattctgagtttgtaaaggaccccaccaagctttggaatgatttgcataattaaatatggaaaaactcttcgtttttgccctttatcaggactgtgcaaagggcatggcagccacgtgttcttctgggcttaagattacctagttaggcagactgtgtggtttaagagaaagaccaagatttgagtacaataaactgcgaatctgaaattgtcacctattacttgtattaccttaaagcaagttaattatttctctgagcctggtttttcacctaaacaatgaatcgttgtgaggattaaaagagaaaacacgtaaagcatctggtgcaatgccagatatattagaggctacaattatcattatcactgttcaacagtattagaccacaggagtgtcatgcaatgtaggcactcaaaacatttctcttaaatggatgaataaagaacataaattcaccctgagcaaagaacattccttgaaatgtatccacaccacatttttcaaaatttagtaatgctatgtacactcttcccatccccaaccacttaaacacataggcaattcataacaattcttgtgatgccagaatggcagccattttcttttttaatttaagggactttttcattcctctgtagcagtgttttctgaagggaaacacatgtatagcacagagcccagtgcatggtgagcactcagcatatgttaagtgctcagaaagagtcagtgggaaaatggacggactttttaaaacaagatttttttcttttttttgagacagggtttcactctgtcacccaggctggagtgcagtggcaccatctcggttcactgcagcttcaacctcccggactccagcaatcctcccacctcagcctcccaagtagctgggactacaggcatgcaccaccacacccagctaattttttgtatttttttgtggagtcagggtttccacatattggccagactggtctcaaactcctagcctcaagcaatccacctgcctcagcctcccaaaatgctaggattgcaggtgttagctaccaagcccagcctaaaacaagattctttacaatgaaatggagatgatgttaaataaatgcttttattccaagctgttaacccacaggtccttgaggtactttctggaggcagcaggggtgagctgaccaccagtgatgaacagaggcctccacacagccagtgacctaattagtcaccttcaagggtgacctgaactcacagatttgtcggttcttgggaaactgcataaagatgtcttctaagagcaaagtgagattaagtgtcccttcagttcccagatcctccaaatgttctctgctgctgtttccccagcagcgattcttcctgccatgtcctttctcactgacattcattttctgactctccctcccacagggatcgccagtggaagttcataatgtgccggatgactgaatacgactgtgaatttgcaaatgtttagatttgccacataccaaatctgggtgaaaggaaaggggccggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcact

SEQ ID NO: 36958 - DNA, 2390 bp, Homo sapiens
acagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggtaagcgcgacgggcgaagctggctggggctcttgccagcccagtcctccgagggcagggtttgcccggaggaagagcgtgaggcgaagctggggaataacaacaggatgtgcaacaacaggatgaggagggctgatttaatgcctgaagttcgcagcagggctacggggcacttcctttattaggccacttcggggagcaaagggggtgtgggctcgggtccccccgcccgatcgcaggggaaggggctgtttgtgcagcgtccggctgtgttatgagtggtagctcttccgtggtggctagcccgggtgcacaggctgttagtgggatcttgggggtggtggttcgcagccgacgtgcgcccgggaatcctggggggcagaggcgagcaaaagtggggtgcgctgtggtgggcgacacgtgtggcgcgggtctcattatctgcccttttcacttccaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaa

SEQ ID NO: 36959 - DNA, 32387 bp, Homo sapiens
cttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggtaggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaaggtggtgagctgtgaggggccccggtatctgcgcggcctccccgggggctgtgcgggttgggggtacttagaagcccggcattacgtaagaaccgtgctgttagcgcttccgggggttggggagcgagacagaggttgcgctgggtcccggtggccccctggtccccctaggcagctaacaccacaatcttccctgggagggggtccgcagaagggcgcgcgctgcttctcccgcttcccaagctgtagcggggcgggtcgggagccagggttagggtctggagacttgggaggggaccggtgccagaagcgaagagctagggttagaaagttaggtcaattaaggggggggcggtgcggataaagacggggtgggggttggccggggcagtcatttagtgacctcatccctggtctccggcgggcgcgcacgtagagagccttctttgatggctcacaacacgcccccctcccccaggtcctagcgcccagggtgttagggctgggtccgttggggcaggggtgatctgatggtccaagcatgcacgtccgcctggcctttcgaccccatcctctggccctcagttctgtccagacctccccgcgacctctcgctctccaaagcgcctttgtcagacctttcttctccgcacctctttgtatgtgtatggatggagggatgggtgggaggttggaagaaacctctccctttcactgctggtccgctcgcctgcggacactatgggtgatgtggatatctcggaggcagagctgagagggcatctgggcccaggcttttggaagccgaggtgcaggttcccagatgtctgggtgcaggaccttggcacggagccaggctagcttgcctggcactgccgttctcctgtggacacagccaggccccgccctctcagaggcttggacgggcgtgggggagcaaagccagccgatgctctgggaaccgattccccgggagaaaacccaggcaggctgggcaagacttccgagcgcagggatttcatacaggatcctccctgccttttcccgccctccacgctctagggaaggaggacttctggagtcccttctctgaccctgtgagggagagcagcgccagccaggagaaggctccaggtcatcaaggcctgggagggggagggaagggatccctcctccctgctctctaggagtagagattggcaccaggggcacgggccagcacagtggatcctgggcatttcttccagcctgggtgtagcctgaataggggtgcccttcctctccctgaaagcacctttattccatgtcctcagcggcagagctgggaggaaagggaaccatccccctcacttttgtaatttctgtcacctgagctcaggtgaccagctcaggcctgagaagggaatgggagcagagagggttttattgaaatcaggtactagtcctctgggaagaatcctcttttggggggaggtggagttgccgtggttcccccacccccaggactcagcaggcattcagtcctaaagtgggcactgccagatgcttccccccactccccacccctgctgtgagccactgcctcctgttgtcatggcaactgggaattagggttttatccagcagcacatgcccaggaaggcaaagggaagaagggtggggggtaaccccctgccctctcctgggagaacgagggagccactcctagcctggggaggccctggaatggaaactggggctgtagactccatgcttggttctgcccagagcacttggtctccttgtgccagctctgagctaagaaagggagagaggagagagagccagccagaggggccgtggagaggtagatatcactctgtcagccccccagataaatgtggaacatcggcgctttggtaggcctaggttccagaagcaaataaaatcaatgtggttctgactctcagggaacctgcagtctaggagtactcatgttttctactttggctcaaattctggactcttttattattttttaaatgactttttttttttaagacaggttcttgctctgttgcccaggctggagtgcagtggcgcaatcatggcttaccgtagcctcgacctcctgggctcaagagatccccctgcctcagccccacaagtagctgggatcataggcatgcaccaccacacctggataatttttaatttttttgtagagatgggggtctcgccatgttgcccaggtgggtctcaaactcctgggctcaggtgattctcctgcctcagcctcctaaagtgctgggattataggcgtgagccaccttgctcagccaaattatagtcttaccctctaaaaattctacttgtttcctcttcaaaaaacaaacaaacaaaaaatacaacaggaagaaacactttatttatatacttatttttgagtcataaaacctggattttcattttagctctccttattagctttgtgaacttgggcaaatcagttaacctcccttatcctccctggtctcctcctcctcagagaaataggcgagtaatacctgctcttcctgcttcccaggaccgttggaatcattgttgttctccaacccccactttctgggcagcaccttctcccctacctttctggctcgtcctgaaggggaggctcttcctattcccttccccattgctttgcccttgtatctgctcatcctcctctctcccctctccaggagagacgtttcagagcccttgcctccttcaccatgccggttgccgccaccaactctgaaactggtaagaagggggtgaggatgttagcttatttcagtggttcagagggtgccaggcgaggacttaggggtgggcacttgcacagctccagataagaaccaactggctccactgctgtccaccctaccactcagccattccttctggcagctgctgtggccatctcctctgtgtgggttcctgtgctggaacggagaagagaaagaataagacccatacctgctccagtgtagggctggagcacaactcacctccgtggagggcaggggatgcatgctccagaggtgacccgtactattgctggagggcagtggcataggaccaggccttcaggaggtggccccggagctgggccttggagaatggcttgggggtggagggattacagcagcacagcctggggctgagaagtccataatcgctgcccactaggccagcatgtgccagaggtggacagggggtactggggaccaggaagctgtgagtgaaggaacaagaataccaggttaggatacctggacgtggctctgtaggaggcattaggacaagggagtgggccactcagacaaactagcaaagcctcagtggcaaactgcttaacctcttggagctcgcatttcttcttctgtaaagaggctgctgtgagacgcaaaggctgtaatgggagagcacattacttttaggaatagtcataattattatgctgctgttgctgccgctgccaccaagttgttgttgttgtttttgagacaagttctggctctttagcctaggctggagtgcagtggcgcaagcttggctcactgcaacctctgcctaccagcctcaagtcattctcccacctcagcctcccaagtagctgggactacaggtgtgcaccaccatgcccagctaatttttgtatttttcgtaaagacaaaaatgttgcccatgctggtctcaaactcctgagctcaagtactccacccgcctcgacctcccaaactactgggattacaggtgtgaaccactgtgcctggcctgagttgttattttggcattaaccctgtgtccttgaaacagtcacctccttttgaagacctgagatttccctaagatgagatgatgggacaagatcagtgttcttaacttttttctttttctttttttttttttttgagatggagtctccctctgttgcccaggctggagggcagtggtgggatctcggctcactgcaaccttcacctcccaggttcaagtgattctcctgcctcagcctcccaagtagctgggattacaggcacctgctatcatgcccagctaatttttgtatttttgtagagactgggtttcaccatgttggccaggctgtcctgacctcaggtgatccacctgccttggcctcccaaagtgctgggattacaggcatgagccaccacacctggcctgttcttaattttattggtcctgagtcacttagaatctggtgacagcagtgagccctcatcgtagacatatacatccatgcacaaaaggtatattctactctaggggatcatggattcccgtagtgcacgcaggaccccagaaggttaagttccctgtgctagaggccctctgaggcccgggcagctgggaactgctatggttctgctctgagttgtctgaacttccccctgcctggatgcctccctcccatgcagctccttcccttgctctaggccccactactgcctctgccagaggttccagggctgccactttgggtagaatgattcctctgtgcctcctctccgagaaagtgaagggagtgagccagggcctaaactgtggtacacttgtccaggaaaggcctcttctccttgcagtggagggatggcaccaatgtccccagcttctgcagcatcagagggctcagtcccccatctcctgtccagcctgctgggctccctggggtctccctgcctctttcagcctgcctaggccccactgtaagctgcttaggcattaattaaacccacccctgagcctgtgcttaatggcctctccagccgggactgcccagtaaacccaccaatagtgcctgactggggcgtaggaggaggagcaagcccagcaatttggcttcgttgttgcagaccacttgatgggggcgtggtgggggaggatgggggacagggagtggagccttggggtgtggcggtgggttctgcttcctcaaaggactcctggggctcctgctccccttcatgttgttcgaggggctgctcctggcttctcatattcaaaggaagaagtacaaagtgtttttcttccttcaggcagcctctgtcctatcctgagctacattagctcccagcttcaaaaatctaatggtggattctgccccttattatctggtggtcattatacttcccacaggatagagagacagctgtgtccctgcctctgagttcaggctccccttccctcctcctcccctgggagatccctgccttggactctgcaaagggcaaagctaataagatcctttttccgcccttccccatgggtcagtatggttgaagggagggaaagggtatgggtgtattcctcttgcagggagaccccatatctactttgggtagagtcaggggcccttttcctgagacttgggagataaatggacagtggcactgggctgagaacttagagatcctgaacctggcatctcctgacctgcagccttgctccctcttcccctgtcaccagattccctcccttttttggatcaaggctgggatatgtggctgctttcaggtggagctgtccctttaaatctctcctccatccctgggttactgtcctggtgtgtaattctactgtcatggcaaccaggggtgcaatgcgacctggtgccactcctcagggaatgtctgagtggaggctgcagtaccctgatggtggcctcttgggcacaagatctcagaggaatggggtcaccggagcggagctgagtccttcccttctgcccacacttttccctgtgtgcaaatgtgccctcatttttcctttctggggaactgagttccaagatgcctgacttgcttcctgggcatcatccccttcattaagaggaagaactcatgggagatgggggaggggaagaagctgctgtgaggcgaggggtaagcagggctggggcaccatccctacccacagcgatgccacctcccccacgtaccctgcctcccagtggctgaccaagggtgggtagggggaggcgtctgaggcttgaggtatttgccccatgcccaagtgaggctgcctcccggtggagggctgagtcgttcttggggacttccttagactgagggactattgtaaaggaaacagggcctggagaggggactgagagcagaggtcagagggcatagggaggaggtggcatggggtgtattagaggaggggcttctagaaaagagggtacagggacaagatgggccaagacttttctccctcgggtctcctgaagctggctgtgaggggagggtctcggagtaccgcgccagtcttgaaggggcagcatgcctaccccctcctcaaaacttcctgttagccgcctcctccccatccccaccgacactgacatgctggggatcgggcaatctgtgggactagggctccctcccaccactcttctcccacccgggttaccgcctgctctgcaccgcgcagcgccagtcagggctttagccaatcagcaaggcggtcacggcggctgagccttcccattggctggttcctcagagggcgctcctcgactcccgccttccccagcccggccaggctttggctggggaggcggtagacggcggcgtgtaggacgctccgggagtccccgggtctgggggccgccatggcaggcagcccaggcagcggggtctccttggagggtatatccctggagtcttctgaggaagcggagctccagagggaaggtagggaagggcgggccagatgggggcggggcagctggccccttagcctaccttcctccagcagagtcggggcatctggggagggtggcctgggagaggtcatctgagggcaccttcaggagagctgtcctgggcagagggcaccaactcccttggctcagtcctcccctagataacggagggaatctggcataccctggcaggaagggaagggtccctgccctggcctctttcagagcccactgagggcctcgcaggtctctgaccaatgccaagccccggcctgggcaagaggggtctgaagggcaagcttgcacttttttttctggagaaggcagggagcaggaggaggaaggagatgggagtccaggagtccctgaaccatctctgccagctccagttccagtgccccctcctccccactcctgttccttcctggaggaggggggcactgacaagagcattgagaggcgccaggggtgcatcctccgccgtcctccgtggcttgggtactgttatgcagatgtaggcatgggcggcatggtggcagagtaatgatacccttcgcccatctctgcccccagctgggcacattctgcttctcgcttcctttccccggaacttgccacagcctggaactcccacctctgtcagtgagtgaaggcagccctcacctcaggtctcgggggcattgttgcggcccagctgcaggtgttatcgtgtcctccattatgtcccatttcgggctgagagtttgcttatccctgtgatgacttggtgtgacctcagcctttgggtcacaccaaggcctccagtgcctgtttccctagctcctgccagcgttccaggcctcagctttgacttcctatcatccatgttaatttctcagtgattatagatcattgtcactcagagctgaaggcctgtaaacatcatctagcccaatccatccattttacaggcaggaaagactgaggccagtgagggacagtgacttgtacaatgtcacactgaattagtggtgcttagactggaggctgcaggccctggctcctgtgtggctgcctgcttgactctgggcctgtactcacggacttgctccgagtactgtctgtctcatccttgagcctgccaggtacaggtggctgagccctgggcttcagcccatctagaggttgagtgaggagcttgtggttttcttttctttttcttttttttttttttgagacggagtcttgctctgtcgcccaggatggagggcaatggcaggatctcagcttactgcaacctccgcctcctgggttcaagcgattttcctgcctcagcctcccgagtagctgggattacaggcgcctgccactacgcccagctaattttttgtatttttagtagagacagggtttccctgtgttggccaggctggtcttgaactcttgacctcaggcaatccacccgcttcggcctcccaaagtgctgggattacaggcgtgagccaccgcgcccggccagagacagtcttgctctgccacccaggctggagtgcagtggcgtgatctcagctcactgcaatctctgcctcacaggttcaagcagttctcctgcctcagcctcctgagtagctagaattacagacctacaccactatgcctggctaattttggtatttttagtagagatggggttttgccttgttgcccaggctggtcttgaactcctggcctcaagtgatccacccaacagcttgtggttttctggtgcagggcaggatctgcaacctgacacctgcttccctttctcccttctctccacctcagagtctcttccagctgcctggagcctcccacctgctcaggctggcattacctagggtggagagaacaggccaaggaaattgtccccttcctccaggatccctgtcccaggcattcaagggcctggggtgcctgtgctgggcagggaggggaatgttgccggggaggggctgccttctgtgggacatgggggtggggaagtggcaagtattgtggtgtgttttggtcttctgtacccagctggtacctgtgtatctcactgcccgtaccttcccccagccatgcagcaagtcctggacaacttgggatccctccccagtgccacgggggctgcagagctggacctgatcttccttcgaggcattatggaaagtcccatagtaagatccctggccaaggtacagtgctccagggaggtgggcacaagggcactgtgcttggggaggcacagtaggggatggggtattagctacagagggctttgggaatgggacatgtggcacaagaggcccccctgaaggggattgtagaagaaaatcatgcccaggtgatgacctgagtggctgcaggtagagggggctgcccccacacctgtctggtgagtgcgtgggtggatgtttgttgactgccagcttgtggagtgtgtgattggtgcgggctagcatgcacatgttggagaatctctagaattcatcttgcctgtccttctgcctttgggcgttttgtgtgtatgtctttctaaggtcacctgccatgtatcaggttggggagagattgactaaaagagaaaattataggacaatttggtaatgacagtgatagaggtggatacactatgcattttgggagcataaaggacaggtgtctaacccagcctggggtgggtgaggagggcttcctggaggaaggaccacttgagctgagtggaagaatgaggaagagggggagggcattctgggccacagaagagcttgagcagaagcacagaggtaagaaagagtcaggagtgtgcaggggattggaagggctggtgtgaggctgagcctcaagtgtaagacaatgcgagctgtgcaaaggttggcaggtctggagggcactgggggctgtatgtgggtgcttgggcatccttctgtgagtatcagggaggctttatggttttttttgttttgttttgttttgagaaggagttttgctcttgttgcccaggctggagtgcaatggcgtgatcttggctcactgcaacctccacctcctgagttcaagtgattcttctgcctcagtctcccgagtagctgggattacaggcatgtgccaccacgcccagctaattttgtagttttagtagagatggggtttctccatgttggtcaggctggtctccaattcctgacctcaggtgatctgcctgcctcagccttccaaagtgctgggattacaggcatgagccactgtgcctggcaggctttacattatttaagcagggatatgatggccaaatgtgggtgttttggcagccatgtggaggactgttggggggttatatctgaagttggagaggccagttagtggctcttcagtggattgagtataagatgctgagagcctgaaatggagctgtggtcccagaccttagggtaaactggtggaacttggtgtttggcagtaagggctagggtacagtaaggcacctgggatcctgccccagggagtgtggaaggatgccccctctcctgagggggggaggtggggatggtgcccatggctgcgttggaggcaaggctgggagctgtgggaaatcagacctaattgctcagatttcttggtgaaggtggagcagtcctctcctgggaattagggatcagagatggagcaggaagattcagaagggaaggtttgactggtcactgaaagggagaaggaattaaatggatggggacctcgactgtccatgtcaggtgcccgatttcccagggtgggggtgactccatccagagaggaagagaaaggagcgggggctttggtccagggcacgtgctggcctggggctgtggaagtcggatgcagggaattgtgaagggagctggtgagagaggctcagagaaaagaggcccaggctggaaagaggcagaacagggagaaaatggaggtgaaggctcggtggctctctgaggtcacagagtatttgaggggtgatggtagggatatagatggaagagaaaaagaccaaggtcagaggaagggaggtaggaggtgaaagttttccaaggaggacagttctagggatgccatgataatgtagggtggggctgcagtggacaggtaggtcatcagtgttgaagacacccagaaatggaaggctcaggagtgggatgggcttgtccacacacctattggcatgtagggctatggcaggcgtcagggtggggagaagactgaggcagtccccagggttttcagtgcatggtggtggaggtgaccaggaagtcggcaatgacagcaagggtagggagaaagaaggtatagccaggtggtgggttttctgtagagcggggactctgtcacaggctggctatggctggccctggcatgggatgtggaggaccacgtcccactggagtggggattgctgctgcaggggacaccatgtccttggattgtagcctattcacattatctgtggaatggttgaagacttgggaagattgttaacagcgaaagatgaaaagttgcagaggtttaatagtgggaagttctggggaagagaaaactgagcagattggaggagattggagaaaggcagggtgcttttcattcagcaatcgaagatcctactcatttactaaagataaagacaagaagctgggagtaggggcatgcacctgtagtcccagctactctggaggctgaggtgagagcattgcttgaggccaagaagctcaagtgcagttcatgtaacatagtgagagctcgtcttcaataaataagtaaataaataataacaattatacacatttcaaacatagagacttccatgaaggcaggaatgtttgtctttttgattcactgcagtatccccagagcctacaaaatgcctgacacatagtaggtgctcactgaatatttgttgaatgaataaatacaaaagagcataaaaaaataacaaactcctgagtacccatctccaaaatgttaataatgtttgttttgactcttgccatttcttcttaagaaataaaaagtatgaggcacacggcacggtgtggcttacagctttagtcccagcactttgggagaccaaggtgggtggatcatttgagctcaggatttcaagaccagcctgatcaacatggtgaaatcctgtctctataaaaaaatagaattagctaagcatggtggcattcacctgtagtcccaactactcaagaggctgaggcaggagagttgcttgagctgggtaggtcgaggctacaatgagccatgatcatgccactacagtccagcctgggtgaccgagtgagacactgtctcaaaaaaaaaaataaataaataaataaaaagtttggcacagttaatgcctctccccttcctcattttcactgcattcccttcccacaggtaaccactgcctagagattgatgtcatttcattgaatgttggcttatcttgcctacatatgtgtttagctgtaaacaatatacctttgtgggatttttttttagacagggtcttattccatctcccaggttggagtacagtggaacaattatagctcactgcagcctggaactcctgggctcaaatgatcctcctgccctcctgccttagcctcctgagtaactggggctacaaatatgtaccaccatgcctggctaatctttaaatttttttgtagaggcagggtcttgctacattgtccaggctagtctcaaactcctggcctcaagtaatcctctcagcctcccaaagcactgggattataggcatgagccaccatgactggctctacctttgttatgtgtgctttttttttttttttttttttcctctggagtctcactctgttgcccaggctagagtgcagtggcgcaatctcggctcactgcaacctccacctcccaagttgaagcgattcttctgcctcagcctcccgagtagctgggactacaggcatgcaccaccatgcccggctaatttttgtgtgtgtgtgtgtgtgtatatatatatatatatatatatatattttgagatggaatctcactctgtcactgggctggagtgcagtggcacaatctcagctcactgcaacctccgcctcctgggttcaagcgattctcctgccttagcctcccaagtagctaggactacaggcatgcgctaccatgcccagctaatttttgtatttttagtagagatggggtttcaccatgttggccaggatggtctcgatctcttgacctcgcaatccgcctgccttggcctcccaaagtgatgggattataggtgtgagccaccgcacctggccatttttgtatttttttttttttttttagtagagacagggtttcaccatattggccaggctggtctcgaactcctgacctcatgattcgcctgcctcagcctcccaaagtgctgggattacaggcgtgagccaccatgcctggccattacgtgtgcttttaaattttatataaatgaaatgatagtgtaaggtgcttctgtttttgagatttctatttcatacaagtagtacagctatcgacctaagtatagatatagatagagatagggagattcatttgaactgcggtgtggtgttctgatacagcagtccccaacctttttggcaccagggaccagttttgtggaagacaatttttccacggatcagggtgaggggggtggttttggtatgcaactgttccactcagatcatcaggcatttgttagacttctcataaggagcacacaacctagatccctggcacgtgcagttcacggtagggttggtgcccctgtgagaatctaatgccaccactgatctgacaggaggtggagctcaggcagtaatgcttgctcacctcctgctgttcacctacttcctaacaggccacggatcagtactggtccatggcttgggggttggggacccctgttctaatatatgaatagagctgtttgtttattggttcccttcctgagagatgtgtatgtcactgctgattttgctgtcttaaaaacagtgctgcagtgaacatcctcatatccatctgcttctgcatgcatatgagggtttctctagaatggacacttggcaatgaaattgatgaatatgtgcagttttgaacctcaacatctgtaactttccaaaattgatttcagagttgggtttatgagcccacatcacctctgggtactttagctattgtctccacagtgagacagtgagactctgctttgtgatggcagagtctcagaatgagacagccctcttgccaatacccttcaaagcagggtcccccttgatagcattcctctctggtccagtccactcgacagtccactcgacagctctctaatgatgggtttgctggctggctggctatgtcattcactcatttgtccatccatccatccatccatccatccatccatccatccatccatccatccatcaaatacctattttgcactcgccacataccaggcacagtgctggggttatggcagtgaactgccagatagtttgttttcctgatgaagcccaagtctgtcttcctttcactggacaccacaatgccccagtcctgggacctcacagtaaagcctaattgaaaatgaaccaatgtgctgtgtcacattgtaagtaaactcccttctctggaaacgtttttggcgagaagctggtcaggattttttccaagaaattcctggtatggttccggatttgtagagcacaatagaagagagtatggacgtttcttcccctctgagacccccagtatgaggctaatgggctaaggcaatccagtaacttctttctccctgtggttgtgaaacaaacaggaagtgaatctccataaaggagcctacctgagcccactggaaaaaaaaaagccattcatttcttctgtccttgtatgggtgagcctttgcaatgtaaatttgccactcctctcatcaaagacagtgtctctcagagctccctgcattggacaatgggacctacttcctccttctcaccaattttaatcattatgtgtacacagacaaatttctaacctaatagacaaagcactgtgatcaaagatccagctgcaaaaacttcgtgaagtggcccagaaacccacaggaatgaaatcagattggagccacatgtggtagctgttggcctccctcccttacgctgtggagctgggcttgactctgtctggggatgtggcagacagtgtaggaggggccaggctgggtagatctgggaccagggagggacagggcctgaggatacaaacccagagggttaaaggccctaagggaagtcaagtctggcagagagatcagaagtccaggcggttggctgcacacagcaagtggcggccctggcaggtggctggcatctgggacggctgacatggatccagtagcaggtgttccagctacagacaaggccaaggtgaggaatccaaggcaggggacattcagaaattcagaaaaattgttactaatggggacagctgagaggcatgtgaaggctgttgtgaactaattcacatgagatgaagaagaaagaacacagggcttggagtcagaagattccactgaccagctttgtgagtttggtatatctgtcaacctctctgaacttcagttatttcttatggaggaatttttaaaaaattaatatttctttatgtatttattttaaaagaaaggtgaggtctcaccgtgttgcccaggctggtcttgaactcctgagctcaagtgatcctcccaccttggcttcctaaagtgctaggattacaggtgtgagccaccatgcccagcccagttatttcttttgagaagtggggagaatgatacctatccctcagagtcgtggtggggctaggtggaggttatggaagtgtaagttttttttttttttgagacggagtcttgctttgttgcccaggctggagtgtaatggtgcaatctcggctcactgcaacctctgcctcccaggttcaagcgattctcctgcctcagcctcccgagtagctgggattacaggcccaccatccccggctaatttgtgtatttttagtagagatggggtttcaccatgttggccaggctggccttgaactcctgacctcaggtgatccacccacctcggcctcctcccaaagtgcaggaattacaggcatgagccaccccggccagaagtgatttttgaatcaggaagagttgttataatcttagcttcagactagagttcacagggaggcctcttgttctgtggggaggctagggtggaagacctgggaaagcaagacagggccctagaagaataaaggtctagggaggtcactaagataggggctctgacaaggggacatgacaagcagagggtgtagtggtgaggccagtgtatcagttcacttttgctgtgtaacaaaccatcgtgctgtgtcgtggcttaaaacaactgtgatttaattcccctgattttgtgggttggttgggtggttcttctggcctgggcttgcttagctggggctgggtggtccgggatggcctcactcacatgtctggtgtcttagctgggaaaactgcaatgtctgggatggccagacccctttccatgtggtctctcatcctctaggagggtctctcatcctcagccaccttcacatggtagtctcacaagcaaggaaggacaagcctccagtcacaagcactttctaagcctctgctcacatttgataatggcccattggctaaagcaagtcacatctgtcaaacccagattaaagagttcctttactttctgacacactactctctgggacatcttttaatttaactatttaattatgaaccagggcttcaaataggaattccctgtcttttgccatgatcggggggttggagtggagggcagagggaaaacttttcagtgaaatgactgtgtagtgtttgcatttgcagcctgctacagctctggattgggagcaaacagaacagagtgcaggctggtgccactataaactagctgtgtctcccacttaagcttctggtctaccatgagcttgagcccctgctttgctgaggataattttcagagcagaatgaaatgaatggctaccacagaaattcaaatcactcttctagttctgggccatgtgtcacttaacatgaaaaagaagaataagtcttagcaaaataatagtgagtaaaaaagcagtaagggaaataattgttcacttaatgttaagtgaaaaaaaatcagaccccagggatggataaaatcatgattcccccctttttttatgtcatagaaaatacggccgggtgcggtggctcacgcctgtaatcccagcactttgggaggccgaggtgggtggatcaccagttcaggagatcgagaccatcctggctaacatggtgaaaccccgtctctactaaaattacaaaaaattagccaggcgtggtggtgcatgcctgtagtcccagctactcgggaggctgaggcaggagaatggtgtgaacccgggagacggaggttgcagtgagccgagattgcgccactgcactccagcctgggcaacagagtgagactctgtctcaaaaaaaaaaaaacaaaaaaaaaaacgcatttggacagacacaattccctttttattaactatattcatttcagaatttcagaagtatgtagaatacatacagacacattacaactctttaactgggaagccagggaatgacaaacacactaaatcaagatggtgctttcagctgggcatggtggctcatgcctgtaatcccagcactttgggaggctgagccgggcggatcacctgaggtctggagttcaaggccagcctcaccaacatggagaaaccccgtctctactaaaaatacaaaattagccgggtgtgttggtgcatgctgtaatcccagctactcgagaggctaaggcaggagaatcacttgaacccgggaggtgtaggttgcagtgagccgagattgtgccattgcactccaggctgggcgatagagcgagactctgtctcaaaaaaaaaaaaaaaaaaaagatggtgatttctgcaagtgggaagggtgagtggggcatgtggttagatgtaggatattgacaagagctttgttttttagtttgggtggtgggttctcttagatccttgttatatcatttaaaaaatctaatttaggccaggtgtggtggctcacgcctgtaattccagcactttgggaggccgaggcaggcagatcacctgagctcaggagtttgtgactagcctgggcaacatggtgaaacctcatctcaactgaaatataaaaaattagccaggggtggtggcgcgtgcctgtagtcccagctgttcgggaggttgaagcacaagaatttttgagcccaggaagtggaggttgcagtgagccaagattgtgccactgcactccaatttggactacagagtgagactccgtctaaaaaaaaaaaaaattatttgttcagcctactgaattgttggttttgtatttgaatgattaaatgtttaaagtttcctctgggctatgaggttgagcttggagagctgtgctttcatatctgtgggtataaaacgtccaggggtggccacaggaggaggaatggattagcccatggtgggaatgtcattaagtcaaagataggaggtaagcagcttaggaggcaccctggcttcccccttgatcacacacgtctcctcggaaaacttgtcctccatccgtggaccagatagtgctaaagtcaaaatgagtgacttctctaatgctcacatcaggacacctgtgccagagctggctcctgttaacccaaaagagccatgcaagggttgccatggtgagattgttgctgcctgagtgccattgtttattcttgacactcagttatttgggctttgattccaacattgtcctaggcacagggtaacagagccagagctgggacgcctccctcactctggggctccataggctgggccaagctaaatgactgaaagtcacataggggtctgtggaagaccagccctctggggcttgttcctttccccaaatgctactcctctgccccatcagttgtctgtttccccagtaggttgtggatgtcagtctaaaatgctgcccacccggcagaggatggtatgggaggctgtggggccatgtggggtgctgttccctggcctgtttgggaaaagagaaggcagaaagcatctaacctttattgagcacctgctgtctgccaggcactatgtccatctcaccaaatcctcacagcagtcttatgaagtattactcaaatctcaccatctcatggctaaacaaattttctattatgaaaaaatttaagaatatatcctgaacctccatcacctagcaccccacttcaacattcaacaagtcatgcataatcttgtttcatccacacctttaccagcttccctctctcctccattgttttggagtacatctcagccataatagattgtatctgcaagtgtttcattgtgtatataaactcctgggctcaactgaaaaggattctttaaagctacactactattgtcacacctaaaaaaaaaatcaaacaatagttttcttttgaatttttttaattaaaaaaattttaaaaaatagagatggggtcttgctgtcttgaactcctgggctcaagtgatcctcctgccttggcctcccaaagtgctgggattacaggtgtgagccattgtgccctgccatgaatttttaataaatggtattggaacatctggatagtcattttgaaagatatcaaagtgtatttattcctcacatcatatatcagaataaactccaagcggatcagagatctctatgtgaaaatataaatcatacacgtcctagaagaaaacaaggctctgtatatgggaaaagccctcccttaaaaaaaaaacaaaaaaacaaaaaactatgcctcaaaattcagatgcatgaaagattattaaattcacccacattaaaaaatttgttttttgagccagggtcttgctctgtcactcaggctggagtgcagtagtgcaaacagtgctcactgcagcctcaatctcctgggttcaagtgatccttccacctcagcctcccaagtaagagtagcagggacatcaggtgcatgccaccatgcattaaaatgaggattaaaaatgctcaggtgaatttttaaaatattttgtagcaacaggggcttcccatcttacccaggctggtcttgagctcctgggctcaagcagtccttcctccttgacctcccaaagtgttgggattgcaggtgtgaaccactgcacctgacctaaattttttttttttttttgcatgcaaaaacaccacaagcagagtcaaaagacaagtgacaaactgggggaaatcatttacaagaaatatcacaaagggctaattttcccaatagagagaaaacattttttaaaatagggaaaagaataaaaaccaagacctgacagaaaaattgggaaagacatgagtagacagttcacagaaaaagatatacagatggtccttaatcatatggagagatgtttgactttactcataataagcaaaatgcaaagtaagccccaatgagagatcatttctcctccatgtgattggcagacatgcaaatgtttgatcaacactctggtggtgagcttcaagaaaatccctcatacagtgctagcaggagagcaaactggccaaagtcccatggaggggaatttgtcaatatctaagaaaattacgtatgtatttgctgcttgacccagcaagacttctaggaatttacatggaagatcttctccacagatatagaatactatgccggagtcatttactgcaacattatttgcaatagcaaagtattagaaacaacctaaatacccatggagactggttgaataaattacaggaatccagtcatgcaatggagtcaaatgcagtaattaaaataataagatgggcatggtggttcatgcctgtaatcccaacctgggaggcagaggttgcagtgagctgagatcgcgccactgcactccatcctgggtgacagagcaagactctgtctcaaacaaactaacaataataattaataaaggaagatctccatgcagtttcatggagtgatttctatgacatatttttaaataaaaagccagaaaaccaaaccagttaaataaaagccctagggtatcaaagggtatatacagtgttctgtgttttatgtaagaaagggcaatatatttatttaatttttttttttggaaacagagtcttgctctgttgcccaggctggagggcagtggcgcgatctcagctccttgcaacctctgcctcccgggtccaagtgattctcatgactcagcctcctgagtagctgggattacaggcatgtgccacatgcccggctaattttgtatttttggtagagatggtgtttcaccatgttggtcaggctcgtctcaaactcctgacctcaggtgatcctcctgccttggcttcccaaagtgcgggattacaggcatgagccactgcgcctggcctttagtggtgatttctgagattttgatgcacccatcacccaagcagtatacactgtacccagtgtgtagtcttttatcccttacgcccctactacccttcccggctgatttttactaatagatttgtgataggtagtagcagttgtatagcaattttgaaactgctttgaatattgaaggacagaacaaataagtaaatatactgatgttattgggaaataagttctcactgaaggagaagggagacacaaatatggaatgggggaagatgagaaaaatcctttaattttatttggagccattagtatctactaatgactgccaaagaaatgatgcccagaaacaatgggtattgagtgtccacatcttggtttctaaatactatctcctgctaaaaggaatcagggttccttggagaaattgctgattccagacctggggtagggaatgcatcagatgagcctgtgccagaagggaagaagatgctcaaggactgatgggaacatgtcaacaggacagaggtgtgaatggggctcccactggacaaatttgggataaactgggtcaacgaagatagtgatcgtaatggattagaacacatggaataaaaaaaattcatagtgatatcatgagagagagaaggagagaaagaggagtaaggtggtagggagaaaagaagagctcattcttttttttttttttttttgagctggagttttgctcttgttgcccaggctggagtgcaatggcatgatctcggctcattgcaacctccacctcccaggttcaagcggttctcctgcctcagcctcctgagtagctgggattacaggcgcccaccactatgctaggctaattttttatatctgtagtagaaacggggtttcaccatgttggccaggctgttttgcaaactcctgacctcaggtaatccacctgccttggcctcccaaagtgcagggattacaggcgtgagccactgtgcctggctgaaaagctcattcttatagcagaatgccaataatgtagaaggaatgatgggaattaggtaatcactattttgcaacctccagtataataactcatttaggcaagggtcataaattgacactaaatccattggtgaaggattttgggggaacagaatagtcacatagtctcaaagtatgggaaagacacaaagacacaagatcacctacgtagaactcttgtcaaaaggattaacgtaagtctaatcatgaggaaacaatcaactaaatctagtggtagagcatcctaaaaactactggcctggagtctaaaaatgtctaggctgggtgcagtggctcatgcctgtaatctcaggctttgggagcctgaagcaggaggatcacttgaagccaagagtttgagactagcctaggcaacgtagtgagaccctgtccctacaaaacaaaaacagaaacaaaaaaaacaaaacaacaaatgttctgaaagtctaaaagttattgggatctgttctagattagaggagaataaaaagatatgtcaaccaactacaacatatgatcatcaattagatcctgaatcagaaaaaataaaattataaaggatacttttgggacaagagtgaacatttgaatgtggactgtcttacataatgtattaatgaatcgatgttaaatttcttgcaggtgataatggtattgtggtttatgcagcagaatgtctttgttcctatgaaatacatgctgaaatactttgggataaagtggcttgtgttgtctgcaatgatctttcaaagattcagaggggaaaaatggtcttcatatatattattgaaatggaattcttttcttcctgacccatctaacctaacactccccactgggctggtcactggcgaaggattccttttctgttttcagcgctccttggtatggagcccggagccagcagagcaacaaataggtgcagggcctgctcctggcaccgtgttctgatttcctgtcccctcattcgctgggaacactgagttgagggcctggagacgcaagttcaagtcccattgaccctgggaaagttattctacctccctaatttcctcatcctgggcttcagggtcttcaaggccccacccaaccatgatgtctggtggaagaagccatctttgaacgccaatgcatatagggtcctgggagctggggacaatttggtaacttctaatgaccctctgtggcaaggggatggaaaggaaggtttgtcctttggtttcttccttccctaaactaggtcctagtaattttggggaagaaaggagacagcaaggaatgcatgtgcacgtgtgggtatgattgtcagtgagtgaggagctgaagctgggggctggggggtgggatggggaaaatgcctgggggctgagggaggaccctgcttggtgtcccagggctcctggggaagctcctagccccacctgttctgcttccacccccaggcccatgagaggctggaggagacgaagctggaggccgtgagagacaacaacctggagctggtgcaggagatcctgcgggacctggcgcacgtggctgagcagagcagcacagccgccgagctggcccacatcctccaggagccccacttccaggttcctggctgctagggctggggtgagggagcaggaggtgggtggactggggcatgctgctgttggatgggccagcaggaagttggatctgggatgggaagagacccgggacactgccccattgtcccttctcttcccaccaccccccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctggtgaggactgggcagggccagaggtggtgctggtgagggtggggggattgagaataaccaatgaacggacaaaaaaggccaagtgtggtctgaagatgaagatggggccagctttgtgcagggaaggattgatgcagcaaagggtcgggggaagacccaggagaccatagacactgcacacacacctgtgtccgcacctctccagtctgcccacctctcccctcattagtacctgctgtaagtgaagaatttaggcagaaggatggaggaggactttgtgagggtgggggtgggtgggtagggacaggaatggaggagctattaggagactatttgaagattctgacttggagcaattggggcctcatcttacactccctctgacctccagggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtgggcccctcacccagcacaaggcccaagggatggctgagcctcctggctgtcaaggttgcaggtctcacggaggccctcctctcctactggtttcctccagggaagatgggggtgggacctgcagcccaggggcagctgaccgcagccgccgacaggcctctgccgctgctgcacctgcacatgctcccacattggctggtattatgcacgcagccacagcctggggtacaagtgtatgagagagcgcctgcattatggtcagcgttcttcacgtttgtgcgcgtgcgcagggtggggttgtcatatgtcctggatagctgtctcctggttggtcaattctgggggtgtggctgctctgtctccctatcctattgggtctctcgccctccaccagagcccttctccaaggggagagggtgagtggagggagggatccaggattaggtgccagggtcctgtgccctacttggtggtcccgcatccttggtcctgagatctgaatcctgtagtactagatgcaaagggaggttggcaccagggaggagcatgggcaggcctggaggcatcactcctgcagggggacagttccattgccccttagtctctgtgaaaagagggggcatggggtagacctccacctgcagccttctgctgacccttcccccgaccctttgctgattcctgggcccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggtgagctgcgggcacccccgcatctctccaggtatggtgcatgggagggcgagggcacagggaggggtcctcttgctcaggcagatcttggtctcatgtccgttttaggcatgccatgtcgaagggggcagtgctgggctcattcccagccagctgctggaggagaagcggaaagcatttgtcaagagggacctggagctgacaccaaactcaggtaggaggtcccccctaccccacacctccaatctgggatccaacagggccctgtctgcctcactcacccatctccctatggccagggaccctatgcggcagcctttcaggaaagaaaaagaagcgaatgatgtatttgaccaccaagaatgcaggtgggtatcagagcgccccctcccttaccctcctctaacatggcatgcctttccctgtccccacccatcacctgtgacgacgtgtgcctggctcagatgctgccagccgtgtccctaggccctgcccgactcccccctgctcccctgttccaagccctcttgccctcagcctccctgagagctccgcccctccctcaccgtgcagcctggtgagcagcgccatctccctgtgtccagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctgtgagtgggagctgggccctgctgagttggggacaaggagcagggctcccctggggccagggctgggcccaccgaatgggcatcttcatgggcaccaggccaggtggtacctttgggtacacgggttggggtgcacgccctctgtgggtggttaggggaacttcaggctcaggaagggtgagggaggtgtccagccaacaggtggcctagcgggctgggctggcgtccactttccttctcttgtttcacttgctaaaagccatgaagaaagtgagtgcccagctgtgcacccgggtgaaacaggctacgagctgcatgtgtgtagccttgtggaagacagggcttcttagtggcagaaacagcgggggtggtggaagctcctggctgccagaggcaggactaagagcactgccctggtctgcttggctcttgctgtgtggctttgggctgtacattgccctttctggacctcagcctctcttctgtgggctctgggctggaccatgattaccagctcatgtctctgtgtgtgccaatggggagagtggggggcaggtgtgtgcaaaggcagcagtgctggcaagatggggagcagactgcacctccaaggctgggaaacgggggcctgggtaggggtgcatatatgtgtctgaggcactgtaacctgcccctgcccatttggtccaacctacccccatccccctagacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggtaccgccactctgctccttcccagcctgcccaatgtcctctctgctgcctcattgctcccccatatagttccagacacctgtcacctgaacacgcccatgtaccccctttgccctcaactactgctagaaacccagcccacctggaacctttctcagccttccagagtccccactcctcctctagtctcctccagtcaccccagccacctgccagctgtttgtcatttgtcccaggactcatgtcccagacccccgggcacccttttctcatccactcccaagtgctcaccccaaccccagttaccctcacagcctttctctggttcctaggacagacatggggatatactccctaccttgccttctccttctgcaggcggtgaaggtgctacgaacggccgagtttgtcccttacgtggtgttcatcgaggccccagacttcgagaccctgcgggccatgaacagggctgcgctggagagtggaatatccaccaagcagctcacggtgagggctctgaggtgtgggggaggggtctgatagctgcctagggtggtgggggacaggcctgagctgacagagagaaggaggtggtgttggggagggacaggggcctgctccagttatcagtgaggcaggacgtggtcccccctgcatagatgtggaaggggaggtctgagagaggaagtccaaagtctcagagtgagccaggcacacacctagcctgggatacatgtgcttctgactcaaggcccccggctcagcccactctgcagagacagagtgctggccagagagagttcccgagggcaactgggagaggtgggctggaggtgggccaggtgagcttgggttgcttacagctgggggaaagctgaagggtaggagaaagccagaggcgggaaggctggctggagggctgagtcagcgtcagggagcaggcagcgcctggaggagaggcttcaaggcctcattgcagaactccagccccatcctccttcctatgtcttgctgcgccttcccaggaggtggagggtttgcggcgctctgagcgcaggggtccctctgctggccatgcctggtgctgcagcattccggccccaggtcagagcgtgcctggggcccaggagaggctgtctaggctggcacccttctgccaatgacccccttaaggagctctggacctttgcctgatccccattctgggcacctcctccttggcaacaggtgtggccaactggagctgttgggatgcagctagcttcagcttatttaagtcagttgtcaagtacccttcctcacccctgcccatccagcttccactgggtcgagggtggggttgccctgggtacttgtggattgccctggtaccagcctgtctagctgcataggtaaggcagcctagtcagacttgagggagcactggcttgagagtcaggcagaccctgtttagccactgactggctatgtgacctttttataccttcattttctctgctataaatgggaaagaattaatcctatcttgcagagctgtagtgaagattatgtggcatgcaaagcatttaggggtgtgattggcagttattaaagcttatttcctccctttcactcaccatctgtggttgatggtgagccactttgaggcacgcagagaggggcccctgcctccctagccagggagtccacaccagggttgggctttggggagggggagtgggggcagctgtagctccttctgacagtgggggtgagttgtgggcactgactgtagggaggtccccttgtgcctgggcaggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaag

SEQ ID NO: 36960 - DNA, 316886 bp, Homo sapiens
agaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacggtgagcagccagagcccgggcacccgctgccaaatccgatcctgtcatggtcctccagccccctcccccttccccgcggcgctggatgggttgagggggttggagagggtgctgccagctcggtgtcgtctacacagagaggggacatgcgtgacagccactccgcgctcccctccaggccctgaatgtcagagttaattctgcatttgtggggtgggggcggccgtggagtgtgtggagcgcggtgcagccggaggggcggcgagtcggggtgattcgggttcagtgtcctcgggctcaactttccttcaacgcccccgagcgatggcaggagggccgcaagtcttcagccggagcccccttgccagcctcttctcgccttccactcctcccccgccccctcgttgactaggaagaaggtccctggtggcatccggaaaattctaggattgcccggtttcgccctccgcgccggtgggtgaagcacacccatcccctcgcgggggaggcccggcctcggtatcggggaaaggggttcgggtggagcgtgcgttcccgctcccgtcgccggctgtgcacacgtcggtaacctagcaatgcccggggagccgctgccgctgtggggctcccctccccagctctggcccgggcaccacgtgcagcttccacgccggccggggctgggtcgagggaggatggagcagctcctggccagccctcccctttggagaccgccagtgccccccaacccctgtcggctggaagcctttccgggtgagcgctcccctagggagaagcttgacatgactcgactcgtccccgctccgattgcccgccgctcgcccgctttgccctcttctcaggctttcagacccgtgcttgctttgactctttacttagcaataattggctttgcaaacgcccatctctctaccttgctgtcacctctctcacttctgcttcagtgaggagactgtggcggaaggcggcaggtgcctgggagatctgcctgggagatggcctgacccaaagctggcgggggcttcgcatagggagcctccttgagtttctgccttgtgtgcacctggataccaacctacacggagataattccctcttaggcctggaggcccctggcataatccagtcagtctatcctaggtgtaggggtgcaggctgactgccttgtctgtctctctggatgctggcttggctgatgctgctgcaatttaaaatgcaaaaaagccctaaagatgttttctgttttcggaagcctgtggaggaaatgagtcccaagcatcatgaattttcatttgcaggaagtgtcagtgcataatctagatatttgttatggggtttttggtattgcctgggtgcctatggaagattttttttcggtactgaaaaaaatgcatttgtggctgtggaaagatgttggagtaacactctgaaaatgattaagactattgaattattggtactgcctttttttttccccttggtgatggtggtagttatgttagagaaaagctgttgtatgtatctgttactcattagagatagatgggttttacaaatcagagatgcggagtaaatgtgggaatgacctcagttttgtcagaagaaatgcactaaaagaccctttgtgaagacatgatgtgaaggagtactaaccccactgggtgtgatgcagcggtgatcctgtgtgattgacactgagaccagagctcgtggacttttcttgactctccagctgactaaagcccagcttgtgaaaaatagcacatgagattcaaaatggaaacataggagtgaatgattcccctgttattgatgggagacaacctttgatttttttctcctacccactggatcctcatttaaaaaaaaaaatctttgtttttctccttctccccagaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaagtatcctttttttgggggaagtctttctcattttctcttttaccatctgttttttaaaaggatttgctttctgaagtgacacaaagctgtagcagtctggaatgcgagtaacagaagttgtatataaggggtttcattgtatataccttcctgtctcttcgggttgcagaggggtggctgtacgggtatatttagcccactgtctggatgtgtgtatagtagtagtagtagggggagggagtgacagcctgaaacttcacaggggcagataattaaaatgtgaaaccaacctttggttattggacattagatggttagttttaaattcagtgttgtctttgggcaatagcatgcattgaacctattgcaaacaaggtatacagattagaaaaaaagactgtataagactctgtttgaagggaatacatttttgacctttagtagaatcttctcattctgatgtttgaaatttgcttctgcaactacaattaatgctaaggttgcttctagtctgacatttggtgattctaattattcaggtagctgcagatatgagcacatgcttcctagggagagattacttttgattttttttctctgatcagtgctataacttcctggaatttccttttgacaagttccaaagaagcatttggaacgtgagcatgagggagccagtgaagggagaggctcgtgtgtgcctcttcctcctgggcccttatgagttatagaacagccttttcagtggaggaatttgcagttgctgcctttataaaaaattctgtctatgtccttggactggaggtacatttctgggtgtctcctttgtatttttaaaattgaactccaaatgccccagaatggctgtcatgtcccagatcttggaaaacgattgtgcttcagcctgcttaaccccttccctaaatctggaggccaacctccagttactgccactcttcagagaaggttgactgaggccttctttctgagcaaatggctttttaattaggcagatgattcattggtctgggtaaagtaaagcatttcctttccccagaagtgtgtttggaactgtcaggggccttagaacagttcctaactataggaaggggtgtgaatgtaggaattccctccaccaggcccagaaggatggaggggccacaccaaaaagggaggatgttggcagccagctagaaagtggagctgaaatccccttataatttgaggatctagctcggcagctatttgcatgccctctgtctttagctggctattttctgtgctaatggacaggagttaaaatgaggtaactgtctagaaagattttggagagagcagccaaatgctagggtaggatttgaggggttctcatgtgctttttcattttgcagcagatgtcccttctctagagtgagttatggtgtctctcacatagctggggttgtgtgtgtgcattttcttttgaagttctctagtctgagaacgaggagggagctcggtaagccagcatgtggcccagtggcattgctagattcatgacaatggctgtaccttgccaggaagacctcagactggcttgacacgactctgagtaagcagagacctctttgtggggtcactacttttgtgtggagtaggtgggaggcctgatgctgtttctctttgtgcacggtaatgtgtacatagcaatttttgcatgcagagtgaattcctggatcacgctgctgtctcccttttccagttgccagacacatgtgtacaggaattaggggacgtggctgccaattcagggagaagcctgtttacaaatgggacagtttgtaaaatagatagacccttaagcaatatatgatttttttttctctttttttaatgacagtttccttctaattcagggagcaggctatagaaatcctttccaccccgggcagctctgtcaaggccccatccgcagtgggagagcaagggtcaagggtcatttgtttttacagacaggcatgacagagtgtcctgccccctggaggagtgagggatgttctccttatcagaaggaattgttaggatcagacccatctatttctctattgctctgttctgcttcacttgtgaaaatcttatggcagtgagatggtatccacttgtacctggagaccaaaactggaccaacataaagaaaaaaaaatacaacttatatttagtcttcctgaacagtgttagtatttctcagatgtgctggtttatcatttaggtattgggaaattgaaaaggaagaatacctattacttaggtattgggaaattgaaaatgaagaatggaagaaagagggagggaagagactattgtgtttctatggagaacaacattggggcccttgactttagatttcagtggggacctacaaaaaggaaaaatggaaagggaattctgaagtcttaaggtgggctatctgaaagttggatccctgggtgaaaaagattttataatattagatgagttgagagaaccaatgtgaattaaagctgactggcttaaaaaaaataaacccatcaaaattagtaagggaataatgttattcattgcctttttttcgttgagttatgaaagctcttcgaagatgaaggttttatgaaactcaagatctctccagaggccgggcacagtggctcacgcctgtaattccagcactttgggaggctgaggtgagcagattgcgagtccagaagtgagcagattgcttgagtccaggagttcaagaccagcctgggcaacatggcaaaacccctgtctctactaaaaaaaaaaaaaaaaaaaaaaaaaaaaattagccggcgtggtggcacatgactgtagttccagctacctgggagactgaggtgggaggatggctggcttgagcctgggaggcggaggttgcagcaagttgagattgcgccagtgcactccagccttggtgacagtgagaccccatctcaaaaaaaaaaaaaaaaaatgatatctctagagaggtaaagagtatttgtttcctgtggcatttttggatttcccagaagtatgtcaggatgaatggagaatagtctgttcgtatgctccagttttaagtaccttgaagtgtttagttaaaccatggccttgcctcttgtgggtgagtgtataggcgaagcactgtggtaaaatcaagcccaggaattgcagatgaggctggtgctcacaaaaccttgtatttggaaaggctgaaaacccaaagaagaaaaacaatcattttggcagatgtcaaattttgtgttgccagttttgacaatgtctcttaataacaccagaatgtttaggtaagtatctcttgaaggctgatctcaaagtgattcttccagacagaccaccaagattgagaaatgttaaagcctactttgaacgtgtctggtgctgatttcttatggctttttaatttaatttgtttacaaattgagcacagtaacagcatattataaactgagctccagtccggctctaatctgaaacagttatagccatcgattcctctagcagagaaagcagaggcgggagctgaagcctggctcgctgctgatcacatctgaggtattggaatatgccatgagaaagttataggtagaatgagaaggtcctggtggcttggcctggcccagtccagacaggcgatttaggctgaccctgccaagaatagcccctgagaaaatggctctaacacatggaggcaaggatctgcggaagacatttatcccatgatgatttctctgtgtctaccacagccgggaacttagtaaggctcttgtcacttttaaacctgtaagaagcagaaacctagttcacacagtgccctaattggatgtacttttaggttttaatatgcagtgtgcagccgaagaatgagtgtaacatgatccttgcaacagaagaaaaggacacggagaggtcatttggtaggaggctccactgtgagatgaccaccgatgattacttctgccgaaaacctagcagtcacagcagtcagccgaaataggatttgtgtatgtcattttccttttaaaagtgctttgaaagtggtgtgatcgggagtgtgatgagggacatggtttatgtttccataacacatatataccttaacacattttttcagaccatttgacatatttatattattggctatttttgccaattgtgtggccttagctatttacatcccattccctgaagatgattctaattcaacaaatcataacttggtaagtgtccttagagttcctgctggtcctggtatatggttatcatttgcttctatacttaaactggcagctggccttctgggtggttgaagtttatagctatgcatgtcgtgtttcttggagctttgcaacagtggttttttgtttgtttgtttgttttaacctgtattctcaaatttatactgactgaaagtatttaaagtcatgaatcttttataaatagatatggaatttttatggaagagatttggagcagattttaaaataactgttatctccacataagtttttgctaccattcttttcctgataatattagcttttttcttttctttttttttttttgtttttaatctagtgttcttgggagtggtgggtactttggtcagttgttctggtaagtagagaattatcgtagactttgtacatgaactatttttagagaagtagaatataacaaaactaataaatctacatagagcataatttggagaataatacatgatattattgaatacatgatataatattaaagtttctactccacgtcctatgaaatgctccaagagaaaatgattgtatggttaaataaatcaggatgcttccatatactttgctgccttcttaaagatttatagtgcacattagcttagtaaaagctttgggaagttctgcagttaaaaaacaggtttccttttatttaactcagctagtccctaaaagtaatcagtcatgaattctttaaacattttttttttttttggcaaaagactttaacatcatggaaccagtggtccatggaacttcctttgggaaaggttgatatagttttttttttaaaaaaaaagcactaaagagtactagactgggactaggatcttgtcccactcacctgtcaactagctgtatttggggtcatttctcatacctttctgcattgctgtgcagccacctggcaattaggaggattgggtaagaagattgctagtatcgtttttacctctgacattctgcaatctttctttgatgattcagaagccatttcaggatttttctggtgctgcagcatccttcttgcaaggattggttctttgcaatcagaagccatgcagaatgggagatgaaggggagcccattctggataacaggaaactctattgtttttcttctcttctcttagctggttccgtttgtttttggcttctcatgttgaagctctattttagcagggctggatgttcctaactgagcgagcgttgtaaaggcaaacacactaggctctcccttgtgtgggagagctctgctggcttctgaagatagtgaaattatgctcttgtgaataagccttaacgatttatgtacaggatttcatgttacatttaaaatgttgtggcacatttcagatgtaatgtgatgtctatttgtatgtgggctttagtagtttgatatctagagaattttctaaaaattttgggaattgatgctgaaaatacaactataaatgggagtcggataaccacataaacactggtagtatatatttggacaatgccagagatcatttgtgtaactttggacattttatgtagcttttgatttctttgtagacatgtgacattagatgattgttttaaagaaaaagcagaagtggtggaaagcctcccatcaatggagatagatcatcgtagtctaggccacagatggtgttagccttgttaccaaatttaacgacgtggatggtgacccagattgttacttttcgtagctcaagagaacatgattaaacaaacttagaaaataaatacctttcagaaaggcagattaattcagatcagtggaataattaatgtagctgcatgtgtaagccaattaatattctgaatttttcccagggaaattcagggcactgatataggcactgtcagaccatttggatttctcagctaagaagtcaggaaataaaatacaggaaatggattaatctttcccttttgcaccccttctccagtgaatcttttcttgactattcttaagctttgaacttttttttttttttgtggggggggatttggcagtgtgttaatttggtgggcctttctaaaagccaacgtatattcctttgacctcttcatatagtattctgaaactcatggcattcaactttgtgtcttgctttcacttgggtggtcacatggccagatgaatttttactctgcttgactctttaaatacttcctttcccactgtgggaagggaagatctttgtggatttccttctgactctaagcaaggtcccatgccatgttggtcctcccatgagggagctggttttttgtttttttttttttaaatacatttgacccaatttgtactagagtgattgctctatttttgggattggtttagaggcagctgaacgaaacttatttttcatctgtagtaaatacctttcatttaatgtgaatggtaaaatcaaagggcagacgctgaaatgagttgcaaggctgcatgtatctggaagctgctggttttctttgcctgatagctccatgggaaagatgcagttgagcgatagagtgagatccagggccagctttatgtatgatgtttctgcctgttaccagttacctagtaaaattatgactttttttggggaagaaacgtggccatccccattgatccaatgtgtctttgttctagatagtatgtaactcagctagttttgggatttggagactaccttggggggcagaagttttcccagggatagtttttgttctttatttttttaaaaatataaacactctcaagtttctctgcagctttcgtttatggacttgcagggctagtggaggctggagtcatggaaacggtgcaactcagttcccacagtaatagccctcctagttcagtcaatagcagtatttcctcagttccacttactgaaagcaaataccattgattttattattattttttttttagcacagaggaggggaatgcctctgtatcaagtgtcagagtggggatgattacaatatcatacttcactgtgatgaaaaatgctttatttcatatcattcagtttcttataagcaaaccgacatggttgaacagttttgagtctgtgtaatctgttcctggtactcttcctcccggtgctacctcttacttctctggagtgtggaactgcttgaaattaaaaatgtccagaatggagatcttcatctgccaagtcagaccttctttgatccctactgatggctgcactcacctctaagccatctctgaaccagcactaagcgcccggaggcaaaggcccatggcccatgtctctctatccccttatctagcaaagtgcctgatgtaccaggtgctttttatttgtttatttgtttttttttttttttttttttgaggctctgttgcccaggctggagtgctgtggtgcaatttcggctcactgcaagctccgcctctggggttcatacctctctcctgcctcagcctcctgagtagctgggactacagacgagcgccaacatgcctggctaatatttttgtatttttagtagagatggggtttcaccgtgttagccaggatggtctcaatctcctgaccttgtgatctgcccgcctcggcctcccaaagtgctggaattacaggcttgagccaccgcgcctggcctatatgcacatctttatcctctggagcgtcttcaaaatacagttaatagtgaagcattctgaatccccagccatgcctgatgcagtggtaggggtatacagtagatgttcagtaaataagtattgctgatgtgcaccaagcgaatgactttcccaggagaagcgccaccatcattccttcctctgagccatgtttcagattttcttgggtggcaggtccctttgtggatttcttgcaggtccttagctgggaatgagtgggaaggtgtacgtgttattcctgaaaagcttagggtctgcggcccttcttgtgcacctctgcttaaaagagcccacagtgttggctttcatagcagagcagtctaggaaattttgtactctggttccagggctcagagtagcaagagtgctgggacctgtctgagaagcagtgctgggctgtggatgcttgcctgtggcaccagatgccttacagtggccaggaatgctgcgggacagtctactttgattgctttctttcctccatggctgagatctgagtgtagtgttaactgggcttaaaaatcaagtccgttgtatctgcatggtcacgtagttcggcatctcatggcttttgcacctagaggtgtgaaccataatacctgaaacacaatttcataacctggctccttgggcttagcctatatggtggaggttaggtctgtatatcatcaagactgtgtctttgcatggttgtcattctgttggaattgaactttcttatttctgtaggcctaggttctgtctattcttctcagacagctcatatgctgcttcttcccttcagccttctctgatacttgtccactccccgcctgcctacatctgagtacttgctttccctctggacacccctgtgcccagtccaactctcctgtacagacaccagcccctttcccctggtttataactgttgtgggaagtggcgtggagtgtgatggtctgctcatgggctgtggggtctgacagcctgactctttggctgattagctgagtgactttggatggaactagaatatgagttcctagaggctgagactgcagtctgatttgggtgtatagccttgtgaacttaatcctgtgcctggcacacaggaagcacatcaggaaatgcacgtcaaatgagtgaataaataaatgaatgaccatacaaggactccatggtatattcttgtagatcattagttaattatcaacaattggctaatgattaatgtttgcctgagaggctgactttttgtccattagtaatgacatcccaggaaacacctggcagagttcgtctttaatttcaggagtatatctttctttcttggcaaatttaactattaaagagagaagaaagacaagtacttgatactttttgaatctgtaagttataaacctgtcttctgtattcaatgttgtatattagccacattgcagatgattctatttggatggatgtgtgactgtcacctttcacataaaaattgattgagccagtcatagtggtatgtgcctgtagtcccagctatgtgggaggctgaggcaggagtcttggttgagcccaggagtttgagactgtaggggactatgagtgagccactgcactctagcctgggtgacagagcaagactctatctcaaaaaaaaaaaaaaaaaaaaacaaaaaaatgtggtagaaggggagagagcctcaaaatgaccagagtagatggactcgtgtagtaaaactttacccaaagttggtttcctaatgatataatgtgaaacagtctatgtgctatacaaataattatatctcttttgttaagccttacgtcattttgacaaaggctttacttgattgagtattgacggcttttccaaaataaaatccagctcttaattgagatttgtggctgggcatagtagctcatgcttgtaatcccagcactttgggacacttagcagggaggattgctggaggccaggagttcaaaaccagaatgggcaacatagtgagattccatgtctccccccgccaaaaaaaaaaaaaaaattagctgggtgtggtggcgtgcacctgtggtcccagctactcaggaggctgaggtggggggattgcttgtgcctgggaggtcaagactatagtgagctgtgattatgttactgtactctagcctgggtgacagaatgagaccctgtctcaaaaataaaggaaaaaaagaagaatttaggttttttactattaaaattccataagaggaattccagtgggggtccttgctcatttggtttgtttttttacaatgtgaatatcattattttatagtcataccttatacaacgaacctccccatctagacccttcactagtgagactaccttagggtgaggatatttgggtatattagagtattagccagaactctttgggttacagattgtgggaatacaactcactcaaattggcttagctgaaaaaaaagtgcgtatgtatgtacaatttataaactcagttaaccaaagagtccactgggtagaaatggcatcagacacagctggaaagggggggctgaaaagatgtcaccagcattctatccctgccctgcaccctcgggtttctgagccagagtctgactgacctctagtaggtcagcctcacgttgcctatgtgtacatcttcctcagctcattttgaggagggcatgtggggacgtgcatttctttctttttttcaaattttattttattttaagttccgggatacatgtgcaggatgtgcaggtttgttacataggtaaatgcatgccacggtggtttgccgcacctatcaacccatcacctaggtattaagccctgcatgcattagctatttatcctgatgctcttcctcccacatttctttttttttgtttttagcatttattttaggtttgggggtacatgtgaaggtttgttacataggtaaacacaagtcgcacaggtttgttgtacatattatttcatcacccaggtattaagcctagtacccaatagttatcttttctgttcctctctcttcccccaccaccccgcaactcaagtagacccagtgtctgttgtttccctctgtgttcgtaagttcttatcatttagctcccgcttataagtgagagcaaggcatttctttcttaatctcagcttaagttcggcattttaacaatgattgcatcagaaacagagacctctgtagcagattggtgggtagttttctttttttttaaccttcctcattggtgtttgtttactttttaactgtctgacaaatgtgaaaagtacccaatacagggtgacagcatgcccagcagtagagacacttgggtgttaaataccagtggcggtggggacacgccccaacagaccccaacagcttctcaccaaagaaagttcctaaaggaatggaagaggttctagaattctggaggtggggtgtacagggagggaccatgtgcactgttactgttgagtggacagatgtgcagaagggaggggtgtcggcgggtgtccctgccccagcaagggtagagggctggttagcagttgatccaggagtagatgttagcatccccaccatgcagctacaggatgtggtcctcaagtcctgtctgctcatgtgatggaaataaggagagtggtggaggcgggggccttccttttttaattcaggtgagattggtattctcccagctggggttcctgtgggctgtaagggtgtttggctgggcaggcaaagccggaaatgggtggtatggaggaagaaacagaatagctgaagatgggatgaaggaggaactgcctgaactgatcagtgagctccacagccccctctgtgtgtgtgtgtgtgtgtttgagagagtaagagagagctcatgctcatgagtgtgtgagttaggggaaaggtggaggtgggcattgttgacacaggccttgcaggacgaagccttcctttggtggctttaattaagcagggccccagacactgcctgggctggagaaaatgactttcttctccagaacttcaaagcaattatttttgctaattttttccttcctccctgttaggtgagtggtagttttagaaatcacaggacatctgttgaaattattgaatgagtgaacgcgaggtgaggctggagggaatcaggggctgacccgagggagggcggggaggcaggtgcagactgctcagtgagtgtggtgggatcccggtcttggctggccctgtaggagcccagccagggaaggcaggaagaggtggcctaggttagctttgcctggggattcaaaggggccaggcgagaggctcatgctctttctccttccctttccctgccatgctcatcttctgagggctgacgctgaatccttttcctgtgtccgtcagggattcctgcataacatagactcacagatacttttttacagctataagaggacgtatttataagaaaggaaattgaggcagctttattcaacaaatattgattgagacctcctgtgcagagcacagcagccctgtgtttctgccttccagcccgctgctgtggctccccatgccttgttgtgaaggaaaacctacagtgtggggttggaaaacagccagatttgttttcatattttgcattcttactataaatcatcactcaaaattgacacaagtaatacatgaatacattgtttcaaataattaaaacaatacagataaagtaacaaacccctttacctacccaactccttctaattacaatgatcagttccgtgtgtcccttccgaattgtttttcacagcgtgtgtgtacgtatgtatatatcacctgtgcattttgaaacataaatacagtttgagtattttaaatttcgtgcaagtgggaacatgcattctatggcttcctttttcccactcaatagaccttacagacctttccatatctgtatgcagaaatctaacaacttcatagttggtgtaaaatattccatgtatgaatgtaccacagtttatttgttttctttgtgatgaacatttagggtaattccaaaagttttactgtttcaaatcatgctgcattgaatatccttttgtatgcttctttgtgcatgcaagaaaacgtttgtctgggatgacaactcagaagtaaactctccgggttggagggtatgtgcgtttttaatatccatgtttattgccacatcattcttcactaagcctgtactcttttacctcacaccacatctcactgcctcagcagtcatttcactctgcagagtgacctcatgtgttctgtatcttaggctgtacaaaaggaagtcttgggggttgggtctggcctctctctgggatgttagtagcatctggagcatctggttagagtagaaagtccacaaacctgagccctagattttaggaatctattttgcaccagtgaccagataaaaggcaccaaaacttattcttgtctcccttgctttcagtcccaggtgcttagatactattgtttcttttgagtgaaatattcattccaggtagctaataggtaaataagttcctaatacaaaaactgagtcttattttggaacgtttgcttgctacggactggtttcatgacaaatactgcctttatgtccctgttagttggggaagaagaatatccaatccggtatgtctctgatgtcccgtgttcttattatctgttttattttcacacacagtaaaatctcgctattattatggtgtttagggtttgtgcccttcttatttccgaaatctctgaggtggtttagaaaatagaatttgatgaaagtgggacaatggggaatggaagcaaagtctacttgccagggtgctcgaggggaactgattgctgacacctggacatggaattggcctcaaggtttcccagcagcggcggcgaaaaagagtacatcctgacacacagggtttttatcctttcgacaaagggaagcagccacgctcattcagagcagcactttctaggaagcacatccaaggaggaatctccagcgcaggtccttgtgtaaggtacattgttggagcacaatgagccatgtcttcgccgtgcttttgtcggggtcagaaatgccgcgcaagcagatggtccctgcattcatgtttttcaggggtcagggtacgacattaaactgtggtataatgaaaatggaagtacttctcatttctataaaaacgctgctttttgattatataaattagtataggatgaaagctgggaagatgaaaaaagagtagtttaacatagccattatttaatcattcataaagtactttttaaagcatttattacgggtaaaatatagtcccattagacacattccctctttgtgctaacttggtttaactcaaaatacaaagggatacaggaatttatgcaaagaacatcctcccctgcccccgtaaaaccatatttgaatatatgtggttttattattttactctaatgtaatttaaataaatgaccaatatttttaaaaataagaaatccttgaatattcttcagtaaatagataacaacagggtataatgaaacactgtttatatttaaatgactgctttgaaacggtgtgaaagcagcttaaatgggtaaaatgctgcccttttatgtcagtaattagccccttggtcttttttcacgataatgcaaaattgtacttctctgtaggcttacacaaattctgaattattgaaatataaattaatggtgaatctttctaaagctcttttcagaatttttatctggtgggagtgaaattaaaacatccaaaattctaaattagaatgtggcaaagtagagacagccagctagaatttggtaaaagacaggtgtttaataaatcttttcctagacatccatgggttggtactagtgtggtggggtagagaaagctttggcgtgttttaggttggccaaatgaatcagttaattgatgttattaaagccaggtgggacaatagtaggttagaccgcctggttttgattgaccctgaatgaggaatcacagacatgatgaggttgggattggagaggacatcagaaacctccatatgggtctgttcctttttcagacccgccagcatgacctgccctgggttacacagtgagagacgaaccgcatggggatgtagggcagagcatctgtctcccaatctgttttcttcctacccacctcagttacaactatgactccaggttgaagttgggcatctcctatctgaccaagggacagggtctaagaacagcaggggcagtgatgacaaaagattgtctctttaaagcaagctgggcattgagtcaacttttcattatctcttcaattattttctttgtgtagtattaggtcggtgcaaacctaatgacggtttttgccataatacatcttccgaaagatagtttccatcacctctccctcccctgcttaatttcataaaatactttattgctttcttcatacataccaacctgtagaaatcatttgaccatagattgccacatttattttatggaaatagccagggcacaggccagcggatgtagtagggcaggagagaatcagcagagctggctaacaaatgcagtgggtctttcctcagtttcttgtttttgtgtggttagcttgccctgtctttctgactataactggaggcacagtggttattgcctttgttactagctgacattggctgacattgctgagctaggtgggctttctatatagggtcctgtgctgaataacagtgtttcagttcatcagccaagatcaaagtcggtggtcccataagattataatggagctaaaaaattcttgttgcctagtgacatcgtagtcattgtgcctttgtaacattgtagcacaattactttattttaaaaataaatttggtagccaggcgtgcctcacacctgtaatcctagcactttgggaggacgaggtgggcagattgcttgagttcaggagttcgagaccagctggtgaaacctcgtctctaccaaaaatacaaaaaaattagctgggcgtggtggcacacgcctgtgattgcagctactcaggaggctgaggtgggagaatcacttgagcctgggtgatggagattgcagtaagccgagattgtgccactttattccatcctaggtgactgagaccccgtctgaaaaaataaaaataagtaaattcaatgtagtctgagtgtacggtatttataaagtgtatggtagtgtaggctttcacattcactcatcactactgactcactcagagcaacttccagtcctgcaagctccattcatggtgagtgccctctacaggtgtactgtattttggcttttatacagtatttttactgtaccttttgtatatttagatacaactggtgttataattgcctatagtattcagcacagtcacatgctgtacaggtttgtggcctagcagcaacaggcgatcccatataacctaggtatgtagtaggtggtaccatctaggtctgtgtaagtacactccgtgttcacacagtgatgaaattgcctaacaatgcacttttcaggaccctgttgtttatacctgttgttaagctatgcatgactgtaatctcctctaattcccatttaatctttaccataaacccacaagggagatactgttaaaaaaatcctcattttacaggtgaggaaacaaggctagaaatggttatattgcttgcacgaggccgtgctcctggtaattggcagggccaggattcacacccggacttctgactcaagcgcccacgctcaagtactaggccatgaaagggagtccaggctcacaggctgatgatgcctaaacaccaagcggaggagggtatgaccaaagggcagagccagagaggagaccatgggggagctgacggcagaaccttttgggggcgtggggggtgggggtctctctggctaggcttcacattcatgcttttgattagtgattggaaccaaggtctggggactggcatagaaactttccaggttaggattcagtcccagctttgcctttcactggctctgtgactgggtcaagccctttctgcatctgctctttctctgtggaagaggaaataaaatggctaaaggtgttatcacaggccctggctcctagaaagcactgtgctgtgagccagaggtttaagatgggcttcagcctcacagcagtcctgtgaggtaggtgtcgttagccttagctgtagatgaagaaactgaggcttgggaagaccagccggcttgctctggggcacctggtgaagagctggctggatggaggattggatagtgatgggtccctcctgccatactagaagagcttcctggacagtttgcttggattggagtttaatttctaaagccatttttttaggtgttcttaccagactgagctagtgcatctgtcccaccgaatagcctaagactttagtggtcatagagggttttgcagcggatctggtgaagaaatgaactgaaaatgagcctgctggccataggagggcctagacctggaccataccccatcatcatttagacaataaagggtggttaattcccttggaacaccaaggacagagagggggctagtttaatggtcaggatctgattctgctgcagctagaagactgaagcctgcctctacatggtggtccggggtaaaaagttcaaagctcagcacactacccacaaggcttggtggtttctttacgtgtgactttctcagccgacttgaaatccaccaggtgtctcttgttctctgcttggcccaggtgggagcccctgattgtctcttgacttaaatgttgctcagaagaggaaataaagcaggagctaaggagcacaacgatgtcagggggattctggcccgatggtcgtgcagttcctagatttggagtcgtgaaaacaatcactaacacctgcgtggtcagggacggcctatacggcacttcatcatagggtctgatttttatcctcacagcagccttgtgaacattgctgatatttgacacaccaggcagccaaggtgtggggcagttgaatgacttgcccaagagcaaacagcaagtaagcagcagaattaggatgtggacctctcctgccctttctgccacactgtgttcctcgtgtcatggagtcctccctgcaggtcactcgggtaagagaccaaggctcacagatgggagctggcttgccagagctagggctcctcaggacccaggtgatgggcttgcttctctgacatgtggtccctgacctctgttttctcacctgtaagatggggatcatagcattattaatagtcatgttgttgagaggattaaaggcgattttgcaagggaaccctctgtgaacaacagatgctggcccattgatttccttgtgcatctagtcccactttctcaggcatttaggctctgccctgctctggctctctctctcttcagccttccaccgtatcaggagagtggagactctggaggaagacagatcttggtttggtttctaggtttgatgctgactgactgggtttgggaatgaacaaatgatctcacctcccttggtctggcttcctcatctgtaaaacagagataataattctcatctcacttttcatgtgggatctttgtgaggagtcaatacaaataatgtgcgagggagctctcatttaccagaaggcattagttaactggtcaagaatagttcaagagagtcttacctcccagtgaagtttaaggtttggcagtatctgagcactgggggaatcttttcctataccccccttgaagtgccatagggttttgagaatcagtcacacggcacacctgttaaatccctgtgttcttccatgattgctgcctttctttgccttatgattttttcccttattgtggcctagtccacggaggttggaaagaggagtgtgcccttcccttcccttccctttcctcagcaaggggctagtttctactcatagctcagggctcacccacagcatagcgctgtgtggaagcctggtgggggcactgggtgagtggtgctgcagcagaaaggcctcctgctgagacgctgaggtcagcattttcagcggcagggagccctgtgactgaaagcagaaagaccaagtacagtgtgaggactcgggttggtgtttgtggccacattgatggcttcatggaagtatgttcccctctgtgcaatgaactagtagggcctgtgtcttggggcctgcaccttttgattgcaggcaccaggcccagcattttttctgtgttgcctatctggacgacaagccatacggtagttactagcgtccccattttgcaggtgaggcagatgaagctaggaggcgttaacttaaatgactctttgctgagggaataaacccataagatgacaaatgaggtctgtggtcactttcttcactgttgcagtgctgtgcccagcactgagtgtgagggatgtcatggagagaatgctgaatttggagtccggtggcctggctttgagtccctgctctgtaactttacttcgttgtgaccctcactttcttcattggtcataaagcaggaggtaaaaatttaaatgagatctgtgtgaaagcgttttataatctacgaagctatatacacatgggcggcatcatccttatggctgtctgttgagagagggcctcgaggagaggacttggcttcatcttgccttctaatccctcactgcaaggccctgaatcctaatccctcactgcaaggccctgaatcctaattccactccatctctccatgatgccagtgccacatctgggacctacgcagaagagtcatacctgccagcacagctatggtgattgtgcttgggaagaagttgaagttgcagaaggaaggtggtagagagggactgaaagagccaaccaggccagagctcgacaggaccctccctccttccctacccttcagacaggagctgcatcaccattttcttttccttttctttctttctttttttttttttttagacagagtctcactctgtcacccaggctggagtgcagtggcagtatcttggctcactgcaacctctgcctcccaggttcaagcgattcttctgcctcagcctcctgagtagctggggctacaggcgtgcgccaccacacccagctaatttttgtatttttagtagagacggggtttcaccatattggccaggctggtctcaaactcctgaccttgtgatccacccatctcagcctcccaaagtgctgggattacaggcatgagccaccgtgcccggccatgcatcacgattttcaaaggccagcttcctgactgttccttgaactccttgagataggtatttactgtgcttgtgacatgcaaactgcaaataattcttgcctcataatggataggcctgtaacccagccagccctctaggcaagcaaatgttatttcctagttttaagtgtgagcttaatatgtgaattaatttcacatcttcatcctcttcctaaatctgtctttgttttgtctgatgaataactgaagtaatggatttggtcacaccactagctgggtagccacctgaggctggagttctgatatgtgggtcttgcctgctttctctgcactgtggctttgcacgtcgggtgctgaagctggggagctggaatcagctggtgtgttctctgtagaactgagaggactagcaccctggggtggaagcagccctgccttctgaaccacagacttgcttgtgtttgatcttatgctgttttcttactatttctgataagaatgtgaactccttgtgagcagggacccagtgtcccatttctcttaaatcctctacagctgctggcatgggatgtttggtaaataatagaccatttaatgaagcatcactctgtctgtaccaggcaccttgaagttgctttgattgctttgcctgttttcctaataggtgtccggtggtctctctttccaatgcaggaacagagtgctggaggtagagactgtgattgcttaatgaagatatcagaacttgcacaacccacacatagggctcccatcaaagcagtagttctagggctgcaacctcttcccaaagatgttgcaacacttgtcttcagagccagtttctgcttttcattttcctttgcttctggctaaaaatgggatcctgttgtcactgaccttactccccgtcttttctttaagaaactcttgagtatttgtaagaaaatcaaatctatcttcaaataaccaagttttcttatctttgagaatcttgagtgcaatgtgtcatgggctctgaaggtcttacgttgaggaatggcaatattatcagaattacgtgtccagcttcccaagcttactactttgaaggaacacatatttacacaattctgatgtgtttattaaacaaacagctttaccacttcgcagtcacgcttctctaagtctgcagtctcgtctggcctgactttctccttgtgccaagaattccttcaccttttctctttagcctttggccccaggaaaatgggaaagtaagatattttactcctggccaatgcctgatttttagaagccttcctcactccctggcaaggcacattttcctgttacctcagagtaaagagactcggttctggggttctgcatagtgatgctacatgcctgacccttgctagggtttgagggtccttgggaactgatgcaatcgtagaagtcacagctgtcattcaggttatttacagaagtagacagaattgcttcacttgccagcagggcgtcttgagcttgactcagaaggatatgtaagtttctgctttttttttcttgcctgtttcaaaaacgcatttttgataccaggaaagttagacaatttaatcttatctgtagcagagggagcttcatccttgctgtgtgaagctgtgcgagacgacaaagactgttgtagaaagaggcctcttgcttataattgaagcatctttgacctgagtcagtgttctgcagccaggatcagataatcagcactggtcactggcacctggcattgggacctggaggcaaagaataacagaattaattggtttccagtaagtagcagggatcatggcatgttcatactttttaaaagaagccttattgagattgagatataattcacacaccctatacttaactaatttaaatcatacaattcagtgttttttactatattcactgttaagcaaccatcatcaaaatcaactttagaacattttcatcacccaaagaaaccccatacctattagctgtcaccccattttccattctattccccctccctagccccagccctaggcaattgctaatctgctttctgtctgtggatttacctattctgaatatttcatataaacgggatcatacaatatgtgtcctttttgcctggcttagcataatgttttcaaggttgattcatactatcgtgtgtatcactacttcattcctttttatggtagaataatcgtccactaaagggacataccacatttatttatctcttcatcaactgatgaacatttgagtgttttcccctttttggctattatgaataatgttgctgtgaacattcatgtgcaagtattttgtgaacttaagttttcaattctcttggctatattcctgggagtggaattgctaggtcatatggtaactttcccattttgagggactgccaagctgcttgccaaagcagctgcgccattttacattaccaccagcaacatgtggaggttccaatttctgtacgtctttgctaacacttgttattgtctatctttttaattatagccatcatagtgcatatgaagtggtatctcattgtagttttgatttgcatttctctgatgactaataatagtgagcatcttttcatgtgcttattagccgtttgtatcaaatcctttgctcatttttaaattgaatttttaaaattattggtttgtggcagggcatggtggctcatgcctgtaatcccagcactttgggaggccaaggcgggtcggtcacctgaggccaggagttcgagaccagcctggccagcatggtgaaaccctgtctctactaaaaatacaaaaaatagtcagacatggtcacaggcatctgtagtcccagctacttgggaggttcaagccggagaatcgcttgaacccaggaggtggaggttgcagtgagcctagatcatgccactgcactccagcctgggcaacagagtgagactcaatctcaaaaaaaaaaaaattattggtttataagacttcttcatatattctgtataccagttcctttttggatttatgatttgcaaactcctttctttctttctttctttctttctttctttctttctttctttcttttcttttcttttcttttctttttctttcttttctttctttctcctttcctttcctcctgtcctttcctctctccctttctctttcttttccttttctttctttcttctttttttctttctttccttttttcctctctctctttccctatttctttctcttttcttcaggcttttgccctgctggccatactggagtacagtggtatcatcatagctcactgcaactttgaactcctgggctcaagcaatcctcctgcctcagcttcctgagtagctaggattacaggtgtgtgccacccaacctgtgctaatttttaaaaatttttgtagagatgggggtcctgctacgttgcccaaactggtcttgaaatcctggcctcaagcgattccctgcctcagcttcctaaagcattggtgttccaggcatgagctactcactgctggcctcttcaatttcttgatggtatccttcaagcacaaaagtttttacttttgatgacgcgtaatatacattgttagaaggccatagctggattgagtcttcaaggttgcctgttccaactcccttgtcggagtaacgggaggcactgtgatcagagaggaggggcctttctgagggtcacagacccacaaaaccaggactggagtataagtctctggactttcaccttgggacattctcagtttccaccccactgtttctgagggtcgaaaggtttgggtgtatatgtagggaaagataattggtaggctctgaagcacacagttcatttgtttttcaataaggaagagtcatgttagaaattttgtcctttcttccagaaggtacactatatagcctggagccacactgtccaaaatggtagtcactggccacatgtcattataagaacttaaactaattaaaattaaatgaaatttaagattctcagtcataaagctgtattttggctaagcattgtgacttatgcccataatcccagtattttgagaggctgaggcaggattgcttgaggccatgagttggagaacagcctggaaaacatagtgagaccccatctctaccaaaaaaaaaaaaaaaagaaattagccaggcatggtggtgtgtgcttgtagtcctagctagctacccaggaggctgaggtaggaggattgcttcagcccaggagttcaaagttgcagtgatttgtgatcatgccactgcactctagcctgagtgacagagcgagaagctgggggaaaaaaaaccacatttccattgttccttatttatatatggccaccgtattagacgacatatgggttgtttccatgattgcagccagtcctgttgggcagcactggctatacccactggcattctgtccactcctgacccagtggtgccctagacacccagctgtgatctgtcttctgtgggtccctcatctacctgctgctcaggcttcttctttatgtagttgcctctgggcttcctagcaagccccctacccagactagatggtctgtgggccctgcaggcagagacacttcttctgcatagtttttggatgtggttgccagtataaaggctagtgcctttcctcacctcagccaataggtgtgacttgcagaaatagagctgaaagatgcttgcaagaagtgtgttctttcttggagaggttagctcctaaaagtgaatgctgaatgagtggatgaattgatctactctttggactaggggaagatgttgaagaattttttatcgaaaattttattgatatgtaataattgtacatatgtatggggtacatgtgctattttgatacatgcctgtaaggtgtaatgatcatagtgggtaattagggtatccgccacctcaaacactatttctttgtgttgggaacatttcaaatcttctattttgaaatatacaataaattattaactattagtcaccctactgtgctatcaaacactagagcttatttcttccatctaactgtgtgtttgacccattaaccaacctctcttcatccccctccagcccctcttctcagcctctgataactattattctactccctgtctccatgagatcagcttttttagttcccacataagagtgagaacatgcgatatttttctttctgtgcctggcttatttcacttaccgtgatggaagttggagtactctcgagtttagttcttttggctgcattggttggtggtgttttgggtgggtacttcattttagaggcagtcagttccaagaatttgcaagatgctgagtgaagtggggcaagaggcaggagttggaacactgggtgttctgagacagtgacatgagggagatgggtgtagtcctgctgggtgccctgtgtagaggtttcctttatttcaggttcctgtaaccctgagggccatctgagccatcaatccaaggtcaacaggctatggaaaaaatctcaaaactgctctatgtaaaaggatgttttacccacatcttagtgatgggagatactgtagtttggaccaagctaggatattatagaccagaaatgagtctggggactatctcagacatgagaaaggattgaccaagaatcatagcaaattcacagtggcacaactgagactggcatccagggcctctggcgcttcgccataggcacattccaagtgccatggtgtatgtcttcatttacacaaggacaggtacttcatacacacaaacaagcaaagcaacttcttggagacattgcccaggcttagattttaatttatttaacccacgttaggcactcagtcctgccttcaggcccccctttgccactctcataattagaaggtattaagaaacctttcaattacggcaagatcaccagggttctcatttctttttcttatctccagcctatctctagaatctattttttgcagggaggactgtccttgactttaaagaaagcattcagaaacaaagagacttgttatttttgaggtcagcctcctccaccagactctgagagccttgagggcaaggacagtgttgtctcttatcactactcaaggactggtgcagagtgttcatttggtgaatatctgtgaaattctcatttttaggagaactcccttttgctgggcttctcaggtatgaggtcccttttccatatggtcctgaaactttatcaattccagtttagaagtagcgacctgaggaaatggaataattcttctgtccatggtgaggggaggatggggggaaggtgctcattttgcctttgaacttgataagagcagagaacagtcaggtttgtgctgagaatgtaagggttactttttcctgaattgggcagtgggtggatggagcccaacaggacatcctgggaaggattcccagagcagggagagggcaagcacagaattgtggaaggaattccgtgccataaacacagaatatcttatttaacagtggaacttttttgctgtcttctttagaggtggaaaacagttctttccaaagacaagcttaatgactgctgtgccaacacacaaaactacaagatacatttaagcatcagtttagcaccagaaatgcagtttacagaagatttgcatgaaaatcttaaaaacaggttgaaaatgtcctaggctcagctagtgcacttttaagttagtaggaacagggctctagggatgagatgatggagcagggatgtgacataggtcaggggtacatgtgtacctggcctttgaagcctcttttggggttcattttaattaatttcttgttcagcttttaccatgggcctaagtttctctggttggagcagagtaagttttcaggctgaatttcttggatcattgcctttgttttctttttcacatagcctgtggatgtctggccttttcagccaaggaaagaaaatggaaatggttttaaacactcactcacttgagccatgaatttcaaccatatattaattttgcttatttttggattttcaaatcttctgagaagcaatgaaatgacacaggggcaggccactagggtgctttggaggttctgcgtggcctggagcagtggggagaggctcgggagagtggaactgtgccctcccactcgtgctacccacacagcagcctcctccctcactctctccttcatgtatgtgtgtttgaggttctgcttagcactttatttggggaaaataagttttctgaaaacttattttgtaggcaatagaggagagattggtgtatgtcttatccttactcgagttggcaaggactctgggccgaatatttagggcttggctcttgctccctctacctaggtggattatgcagtgagatctcacttgcctttaactcatagttattgcttagctcttaggagcagtagaagtaaaaatcctggtatcgtaaatgagcacaatccctgtaataagtgatttctgtgtattattggtagcttgaaaaatattaagtgttacctccattttttaaatatgaaataaagggctagatcaggacatgaactcattcctgttgtcttccagagctattttactaaggaggagatgacccagtggtgaagagtaggtagcagcatgtcaaacctggtagctttgcagtaggggaggtgggcagtacagtgggaataagctagaactaataattcagtgatcatatggggccttgcaggtttttgttattttctgcttgggtgtaggttttgctttgcaaagtctgaaggtgacctatataattcccatatatttggagctctcaggatgtgccaaggatcagcccaattctctgaacgttaactgagggagtcaggagtccttcctgacctcaagaagctcacagttcagttggggatagatggccttgagcttgtgttttagagctctggtcccaggtagtgagctcaaacccagcacagactagattaagccaaagaggaatttattggctcacattgctggccagtccagggataaactggagtcagctcaggcgctcaaatgatgtcaccaggatctggtttctctctctccagcctggctccacttcctgtatgttgattccattctcaagaattctcagacacgacctccccttgtaattgcaggatggctgccaacagtttctaggcctacgcctttccaccttccagcaaaagagagtgtgagagtctttgtcccagtccttccagatggagtcttgtttcttcccattgtctcagattgggtcacgcgcacatccggaaccagttgcaaggccagggacgtgtgcagcactgctgacgtggggccaggtcatgtgcgtcacccctcgacctggggaggagccaactctaccctaagttcctgggctaagaatggaaagagagtcaagtattggttattggggaaaggtaatgatgtaggcttgaactctggcctgacccattgtcaggacagcctgaacttggggctgtattcccacctgacatagccttaagtcagaatttattccagtatgagtacagcatcttgttaccatgtggttttagctgcactgtggatttagacaccaaatcttgtcttccctgagaacattgtccttcctagaggtggggtggaaaacttatttcaggtaagcattcggaccttgaccctaaccttaatggtgattactgttcgaggtttttcaaacacatagtgaataaggacagctggtgcaatggcacgccctccaattggctacgttacacagataaacattcttaatctttctgaggttttgtatagaagagtggagaattgtaccaacttttctccccccggttgtacatcttcactttgtcaccaagcctggattcctcatctgtaaaatagtatcccctcagagttgctatgagaaataaatgaagtgatttgagtaaggcatggcacctggaacatagtacatcgtgcataagaagcagctattgttattatctcctaatttgtcaaatgagcagggcgtattgccagataagctctttaaagttttaatgttcacattctataaatctaggaaaatctttcctccactgcccacccacacttggattttgagaactgcatcttcattgagggtaacgtgttagaaagctctcaaacattatagccctcacagaatgtatagtacttcataattcaccaagtactttcgtgtccattctctcattcaatcctagaacaatctatgatgaaacaaagcaggtatcacaattcctgttttatagatcagaaaacttagggcttagagagatcaaatgacttacccaagggcatagtggctggaaggttgcagggcaaggcctattgccagaatcttctcagatatcccatgtctgttggagcattcttctactccagtgtggatttgcctttctgatggctttgactggagaactgtattgggtagttcatcaaaataagaagccttgagttcatatagtgaaaaataagatcaccttttccctttgttcattggcttgatttattaggattgtattctcaaacctttcctgctattaaaggaaatgaccttagtttgtgttgcatgaaatagcattaagtcaagtttacaacatttcaaagttatggtcagtagcattccaattagaacctaaaaagcttacctagctgaggtttaagtcgttgatcttggaaaaggtaaagacttctcagggaggttgggctgctgtgtatgacagctagaccctcagttcttggtctgttaacatgtggcccatttcttcctatccatgcccctccataaagctttgtgcgctggtagtatttacagtactggatgataattatggcattaattatttgagataaatggagtgtgcccagtagccaatagactattgttagagtattattagtatttttataggtcttttggatagcattctatttcaagacatttgaaaatgtagaccagattagtcaaaagcattgtacatgatctgtccatgagtgtaggctctcattagaacttctggaatcattctgaaatatacccagctagataatactaagtcataccaattaaaaggaaagacttgagtttgagttatagaatgttggagagaaatctagtttattacttttaatattgaagtcaaattttgatttttcttttatggttaatattacctgggtcctaagaaagattgcaaacatgttttcttaccttttttcttgtagaagctttatatgatgttagcttttgcatttaggtctgtggtccatttcaaattaatttcttttctatggtatgaggttggggttaagaggttaattccagccacctcccttgtgggtatccagttgctccagcaacatatgttgaaaatgctttcctgtcctcatttaattgctttggtacctttattgaaaatcaatggatcacataaatttggttctgtttctagggtctctgttctgttccattgacacatttgtctttatgctatctctgtactgttattattactgatgctttgttttaagtctaaacattggattatataagttcttccatttttgttctccacccctcactacaagattgtattggctattctaggtcctttgcatttctatctaaattttagaattaacttgtcaatttctataaaacagccttctggggttttgattgagatgacgtcgaatctataggtcaatttggggagaaggatagcttaagaacattgagtcttctaatcactgagtgtgatgtatctctttagatcttctctaatttttctcagcaatgttattagtatagaggtcttacatgtattttatttatccctaatttttatattatttttgattttattgcacatagaattttaaaaagaatcttctagttgtttattactagtatatggaaacatgcttgatttttgtatatgttgccttgtacatgccgccttgtcacatttacttattacttccagtagtttttgaagattctttagaattttctatgaacacaattattttgtgaataaagatagttttgtttcttccattctaatacttatttatgtatatatgtatgtatgtatttttcttgccttgtaacattggctaagaccttccatatggtatagaatagaaatggtaagagtgtagacattcttgccttcttcttgaactcagaaagtgtttattctttcatcactgagtacagtgttagttggaggttctgcataggtgtcctttattggttgaggaagtttccttctgtttctattttcctgagagtttttattatgaaaggatgttgaattttgtcaaatgtcttttctacatgtattgagataatcatatggtttttctcctttattttattgtggtaaattccattgaattttgcatgttaaaccaattttgcattcccaggacgcacctcacttggtcctgatatattatcctttttatatattgagggatttgattttctagtattttagcataggctttttacatgtatgttcttgagggatattgggtctgtacattttctttgtaatgtccctgtctggctttggtgtctgggttgtgctggactcataatgtgagaaatagtgtggtaccagttgctctgtcatgaccagcagcagaagtctagttttctttaagtgtgtagagtgatgactgttaggtaaagagttagaattattttaatgatcagccaagagtctctgctaagtaacatgaggtatctgtgaaatggcatacataactgttgtgtatgaagcagtgcatcagagaggctgggaaatactttaagtgggttgagcaactcataccattccttatgctaaaattgtacttatattttattagcaaaatttcttttatcactgagagaatgaattatctatctgattgccactcataatttatggagttatcagttaataaggttttattgtatgttaatatgagactcatttttttcctttctctcctctttgggttgtatttcttccaagtaagagcttaaattcatgggtcagctagtactgaccagcatctgttgagttattttgcataaatttggttacctggcctcagataagaatgtttttttaatctgtattggtggcattgttggttgctgatactgctgtagtttgttcttgcaagacttctgtttaaaagaagggttataaattcagtgtaactcagagcagaggtaaagtatagaatggaattagaagaaaacgaagcatcaatttcagtaaagtagaaatcgtttattaaataagcggtgggtgacagggaattgggagtaaccatcctggttcccatagtgatggtgcatccaggaaaaatacagggaaaaagggaatcattatggaagagttttgggtgtgtgttgtcatgctttaggaaacttgccaatttctacacctctgtcttcagattgtcgtgtttagacacacatcccacacaaagtgctcagcagtacttcttgtgctcgtctttatcccctggaatctagaggatggcacctctgggggagttattgtctcacatgatttagaaagacctccactattttctttccaagagtcgaaggaaggtgggtgagttggcctggcacctataagcagggacctacaacactgcttgaagcacctggtgacatctgcttgacaggcttcccctccccactgttgtcaccacttccatgggtggtgggtggtgttgcacggtgcccatggggtggtgtgcatgttctccaatgccacctgccctgcctcagtgctgcctcctgtaacagtctcatttgtttcgctggagtatccttatcgaaaaggtcttggggaccatttgcctaaaatgttccccagcatgaaatgtcccccacacttgctctgcacccgtgcacatcctccttttctttttttttttctgagacaaggtcttgctctgttgcccaggctggagtgcagtggcacaatcagtgctcactgcagccttgactcctgggctcaagcaatcctcctacctcagcctcccgagtagctgggactataagagtcccaccatgcccagctaattttaattttttttttttttttttgtagaggtgagggtctcagtatgttgcttaggctggtcttgaactcctggcctcaagcagtcctcttgcctcagcctcccactgggattataggcatgagccactgtgcccagcctcctcctcatttttgtagacatatcaagtctggcctccttcaggaagccttccctaactaactaatcaagctccccgtgtttctttcctttaggatctattttttggatgtgtatggtttaatatacccttaagaataatgcgtttggaattgtaattgagaagacaaggtttacgttagcagattatagtctaactctgatttttagaaaagtgatatagaatagagacttaaaaaaaatgacattctcacataggttttggatatttggagataggaggaaaaacatgtctttaaaccacacaatgggaagtgaagtgtttgcaacaaccagaacatttaggttataaagtgtcagagcagataatttaggctaaaagaaacaaagttaaatgatttggtgggggcttgatttctctggattgacccccctggactattggctgtttccttcacttccagactgtctggtaagatttttctacagaggtaccttcttattaatgaattcttcccatcacacccactctgtttgaatttctgaattaccttctccttttggtttctgtatctcaactttcttcttattgagtcttctctgacagtttctttgagggtattgctatcagagtcagacatgcccatgacaagattccaggctgtgtaatcttgagcaaatcaatcttgctggtctactttttttcttaaaagaacaaggaagcttgccttgcagggtggttagaatttgagacaatgtatgttgcatgcccagcaggtggcaggtagctaataacaggtgtgtgcttgctctacaccagggatcccctcggtctttggtctttgcatatcatagatactcagtaagcgctctcccaaaggattactgacttaacaggtagggtaatgtttatagccaaggggaggtgagtgtcatcaggcccaggtttgtatgcctatttctactgaattgtcgcaaagttatgtttcatcctatttaccaagttgtatttacagaagactagtcctgttataacaaagcccattgaaacaacacccaggaagtagaccacaagaagtcagtgggtatcttactctgtgtcctgcagggggatctggaaatgaataagggagagagaaaatgtggagtgcagaggatgctgcctggaggtgagactttaaccacatgattattctcagttatggagcaatggctttgttccaggcattgtctccaatagtcacaatcacaccatagggctgatgttttttctatcccactgaggtgtaaacagaggccccaagaggttgcatctggaggtgcgtgagcaaaatttggagagaagtaccaagtgggcacttcacaacaggtgaagagaatgaagagatggataaagataagtgttaagcactttttggtggtactggaactttatcatgtctcttgatttttaagaaaagtggcctattgactagaatttgagactttcattatattgttcagttggcttttgcatgtatattgcttttatgtttttgatgcgttttttcaaaaccctttaaattagttggattttatgttgttcttaagtttgatgaggtagacacttttttagctgggaggaatagagaggcagtgagtgtgttaacagaacacagcaacctcagactccagcccccgctctccttttatccagcggtgtgacgttgagcctgatgcatgacatcttggcagcagaggtgctggtgctctgtcaggctccgggacccctgactgaacatgcctagggtcatgaggaggtttttgttcctgtaacattggccacaactgcacagccagtgggtgaggatgctgagatacaaactgagaattttgcacttcgacctaggctctttgctagatcaaacttcttttgatgtcttagccatgatccctctgagatatctctctccaagttattaatatatctgtgtttcccatcatgtttccccttttgtcttggcttcaaagaagctcagagctaaatttattgcttgattatagttgctggattggccaaggtttaaaatttatgtttttaacttttttatgtgattccctccccattttcattttgatagtcttattgtttattgtatatcaccttaaatactttgagaagtagatcgggtctacgtttaaaaatcgcgtatgtgggaggagagggccattcggcaaatgggaaagagattggggtgactttggccaaaaaagtttgggatagatttttgtattctcttgtattatgttattccctatcagatggtctttgcagctcatttttctgtcttcttctgtgtggtcagaatcaggggagagtttttctttataaaaatgatttgttttcctgatagaacagtgctggtgggtaacattcagttctgaccttgtaggcagacctgggattcccagagggtgcagggaccgcagcactcactcttctttgtgacaggcctgaggcagcttccctggggtccccagcctgcctcctccacggctgctatggccgtgggcgctgagcacgtgcagctgctgcctgatgctcctggacagggaaggatagattttgggcatagttactaggtgtcactgtctccttttttcagcctggcttttacaagtagttgtaatttacttgacaaacacttatttggcatttccttcaatacgctgggtactgagatggttactgcatttttaggcatttaacggggataatagcatcatcgttaataattacaaatatgatcgatccatcatataggcaatacatttcagaagaatattattaaaaagactcatagtagtgggtgtatgcagctgtagtagaggagctgaagccactgagttaccccggggttcaagatggggagcagcattcccatctgtaggttgtgttcttgagtgggaaggcctccttggatacctctcgacagtaattccaggtacttgagctcacaaagaaagtgtctggggccctcagccctttggtgtggctcccagggacgcctgagttatttccagaagtggcgtggtgggtagagtgtgagggcaggcctcgcctccctgcccctctcccctgtgtggcttttcctttctgtaattcaactgattgcttttccttccaaattgctggcttaagctttatcttatctaattttatctcctccagccttgtacgtccagagcatcattagggcctgtgcccattctgtccctcccacttctcttggtctccctccacgtcctgaggggatagaaagacggagtctgcataacctccgcatcttcctgcctgggagggcggctagggtggtgcctgcagcctctggaacctctccattctgtgtgcccctcaacctcatggacatactggcgtttcaggacctggccctgctttctctgtccccgtctctctctgcccactggtttctgtgacccacgcccttcccaccccattctgccccttttcctcacttgcttttcttaccttctgtcacattcacatgctcactatttctttttactccaagcatctgttcctctaaatcatgaactgtagttggcataattaaatatgtaatgtgtttattttaatatcaatatgtcttttcatacacatattagtaagagacttggctgtcagcgccgggccagatcaccatttgcagatgtccactcacgccagctcccccacggaacgtttcttatgcacctcatcagttctctttctccttgtctctctttctgtctctgtgtctctttgttctgtgtacatctctctgtatgtccctggcttcctctctaacacaaattgctccaataggccggcaccttttcctctccgtaaaccccagtttgtaggtacacacaggcacccaggcaagggtagagaaaccaaagagcgcttgttcacacttgctcacacaaggaccagcagagacctagagctgcatgccacgtctttattatccttgctgctagctcctctggtacagcagcactgtgacagtttggaatttgagcctgggcactctcccctgagtgcatcggtgacgtaaaggcaggcaggcaggagcaatcacagcctcccgtcgcctgtgtgtcccaagtgagccccctccccaaagggatgtagggaagccagtccatctgcaaggtatctggagtggagtgacaggaagcagaggatccagtattattggaatagattacatggtatgtgcttgtcacttccgtttaaaggtaaatacaaatctgtctttggcttagaattctagcctcctgacctggggggtgaatattgactggcaggctttacctcccatgtagaaaagagttgcgtgccagggttataaattagagctctgcattggatggatcttcttaatgttttctgtggagtggaattagaacatgttgtttcttttgaggttgcaaaaagcaaacaaggatccctttcctcccagactagtgggaagtagactaattacttgaaatcctgttttatcagccataaaactgagatgaaagctggggcagttatgaagatcctgatatatcctagaccacaaatttctattccttttctggaagagaaaaactgcattttaggtttagataatttggtcaaattttttaggctatcaaatgcaaagattaagtttctagagtcttgaattttagcacagagatagcatcacttaaccttcccgagtgaaaattcctgccttctaggtggtggggaagatcaaacgagctgtggatgccagcatacttaatatgtgttcagtagatattagtgacagattcagtggatatgacggctgaaggcctgggtggctcttctgggcttgttggttggtttcattataatgtatatggttggacctaagataacccatgtttgtgcttctgtggacactggtgctttcagggtcttaactatattgttttcatggaaactttgaaaggactcatggctccaaaaggggctgaaaagttttgaatttccttttttctttctttgcaaaagattttacagcttaagtcatgtaattaataacaggggaggttaagagtcaaagatttttctcttaccctggtcattttcgaagctgcacttggcatgggttgaagcaaatttgtgtcttcttgaccatttacttttttttttaactgagaaaatagattctatctctaatgaagtaattgtaaacagccttgttaacatatggtactgattttttcacagaagcattgttgaaatgcatgggaactaccaggttaaaagacataaaaatagacaatctatatagtccagatggtatctccaaactaggggatccaagtggcatgagaaactgtctagagcaggagtggcaaacacggcccccgggccaacacggccttatgcctctttttgtatggcctgtgaactaagaatggtgttttacattttttaatgtttgaacaaatagctgaagaatagtaatatcttgtgacatataaaaatggtacaaaattcacatttcagttaccataagtaaagttttattggaacacagccccactcatccatttacgtattatctatgggtattttcctgctacaatggcagaaatgagtagttgcctaagatatttgctgtctggtcctttacagaaaaagtttgccaatctttggtctagatggtgaggaattttagttctcctatgtgttaactgatacatgatttcgttttgaagttcagcttttaactttcggttatttttctttctacttttattttttactaataaagacagaagaaaaccatggctggttagtctcactgctcagactatgccttctaatgtttttgataataaaagttaaaatgcacatgctaattttatttcaaacagtataagaaagcaaaatctctctcctacattgtcctttattccaattcctttacccagtgttaacatttaatagttaacattccaaaaaatgttttgtttatactagaatatatattcttttcaaaagcttttcttaagcttagtttactagtaaaaatactcttaaccttttactatgaaaaaaattcaaatatgtacagcacaagacagaaaagtgtaatgaaccctgtgtacccatcattcagctttcataactcttcgtcttatagccaatcttatttaatttgtggaatccatttcctgtattattttgaagcaaatctcaggtatatcatttttttctcaggtatatcagcaaatctcaggtatatcattttatctgtagatatttcagtatgtatctctaaaatataataacttttaaaaaacataaccacagtctgctaacacatgagaaaaaaataataattccttagtgtatatttgagcactgagtattacctataattgtctccccacacccacagttgtcttttaaatgtcatagtttattttactctctttgaattaggatacaggtaggtttcacacagtgtgacttggttgttgtcctttaagtctattttaatctgtctgttccctctgtacacactcttttatcctccttgctacttattttttaaagaaatgaggttacttgttagaggttttacatccccatagtattgtttaatatgttcctctctcctctgaatttcctgtgaatttggtagttggacctacaggctcataacattcaagttttgttttattttattactattttttagctaggctacttcactggtgacattgagtccttccaagaggaggcacttagtatctgattgtccttttttgtgatgttagtactcattgatgtttaatgtgtagatcaagtcattccttatgggttgtaaaatgctggatactcttagttctatgatttctgtgacatttattggcttaaatgtttgatttttctccatatttaccagtttttgaagttttttttttttttttttttttttttgacagagtctcgttctatctcccaggctggagtgcagtggggtgatcttggctcactgcaacctctgcctccacagttcaagcgtttctcgtgccttagcttactgagtacctgggactacaggcgcacgccaccatgcgtgccatgtctggctaatttttgtatttttaatagagatggggtttcactgtgttgcccaggctggtctcaaactcctcacctcaagtgatccgtccccatcggcctcccaaagtgctgggattacaggcgtgagccacagcgcctggcctgtttttgaagttttgacttaacttattagtaccctttaacagtgactggtttgttttttggtttttgtaatttttaaaagtatgatatattttagcatatttactgtgttctgctgaagttactgaccctcagatcatcccccttgtggtagtgtgaaccttctcacattggtccctgtgtctgtttggcatgacctagtagtctctgatagctttctctctttctggtacaacaagatgttttggattcatcttacacatttcttgccctggatctggaatcagccattttcttcaaggagtcagtcctgctgctttttagtgggagatagtatttcagaactaaattttgggttcagaggtacatatccataaacaaacagctttttatagtaaaaacacatagagaaaatgcatacagtacaacaccaatgtagcctcaaaaaagaacacagcagagcaccgcaggggatccctttctgaacacagtcttctcccacttccctcagtcaccactcagtgtttatggtaatgacttcctcgattttctttcctgtttgatcatttaagacaaaatacgtccctaagcagtatcacttggttttgtctgttttgaattttatttaaatggatcatgcttcctgaatttttttttttgttgttgttgttcgagacagagtcctgctctgtcgcccaggctggagtgcagtggcgtgatttcagctcactgcaacctccgcctcccgggttcaagcacttcttctgcctcagcctccctagtagctgggattacagatgcccaacaccatgcctgactaatttttgtatttttagtagagacaggttttcaccatgttagccaggctggccttgaactcctgacctcgtgatctgcccgcctccgcctcccaaagtgctgggattaccagcatgagccaccgtgccaagcctcctggattcttttatatcttgcttctttcattcaacatgagattcatttgttttcattttctttgcaatatgatactccattggatgagtagaccacaatctatccattctgctattgatgtacagtcaagttgtttctagttttgtgctgttaaagaattgctgctaaccttgtatctgtctctggttgcacatgtgcatatgtttttgaagggtatatacatagaagtcgaattgctgggttagatgctatgcatgtcttctttccaatgtgtcatgccagctgatatgctcaccaacagcgtgtgagcattcctgttgcttcacattcttgcccacacctggaattgtcagactttaacatttctgttagtttgttgatggaaagtgatatctgactgtgactttggtttggtgtttctctgattaccagtgaggttaaacacttctccatatgtttgagtattggacttttctcctttatgacatttctattcaagttgtttcagtaagtctttggttcattttcccattgagttatcttttattgattcataggcatttttatatgtattgggtacaggttttgattggttgggtgtgttgcgaatttcttcttccactctggcttatcttcactttctttatggtgtcttttgatgaacacattcttttttttttttttaaacacaaatgctatttatttgtttgtttgtttatttatttttgagacggagtctcactctgtcacccaggctagagtgcagtggcatgatctgagctcactgtaacctctacctcccaggttcaagcgattctcctgcctcagcctcctgagtagtggggattacagacatgtgccaccatgcccggctaatttttttttttttttctaatggtagagacagggtttcaccatgttggccagcctggtctcgaactcctgacctcaagcaatctgcccaccttggcctcccaaagtgctgggattacaggcgtgagccaccacgcctggccacaagtacttttaaaattttattgtaggacgtcttcctccactttgttgggatatgtggtatatagtaaagatttcaaatatagtaattattattatatactatttagtattatatgcaacttatatatgatcttttaaaaaaagtcttatatctttgcctttctatttaaatttcctttaaaaaaaattgacaccaaagaaataatagtgtcacattgtttgcaccttactttttcacatacaattttattctggagctctttctacattatccatatgccagtcggcttcattctttgtcatggtggcatgatatatgtatatatttttttgagatggagttttgcttttgtcacccatgctggagtgcaatggcgtgatctcggctcactgctacctccgcctcctgggttcaagcgattctctggcctcagcctcccaagtatttgggattacaagtgcacaccaccatgcctggctaatttgtgtatttttagtagagacagggtttcaccatgttggcccggctggtcttgaattcctgaccttagctgatccatttgcctcggcctcccaaagtgctgagattgcaggcgtgagccactgtgcgcggccggcatggtatttcattgacagaattaaggttgtttttcttgtttaaaattgtgctgcaaaaaactctggtacataatcttgacataattttgcgagtacatctataaagcaaattctaaacatgggaacttctgggtcaaacaatttgattgttttaaatattaatagacaatatttactcccagttaattcatgtaaaatagcagttcatacagcctaaattaggaggtctaactggccatattcagagaaattatctggatatgaagtaattttttgttaggtctaacctgtattaatgacaatatgattacagtattttcaaaagattgacacttagccattctccatgtttcaaaggaataaatgctaatttagccaaataatagtttggagcaaattttgtgggagagcctgcgcttgtgtggagcaaatcccctgtcgtgttgtgaaatgggcgcggagaagcctgttctagtgactgtcgatgctctttgtgacagctaacgtgagggctctccggctcctgagtcatcctcctccccaaatgggggactgaccagtcttttggatctctgattttgttaaagcggaaatgtttttctctcccattccagtaattctttgagtatatctgtttttcttcagatgtttcgtgagcacctgtgttctggggaatagtgaacaccgtgaggaaggtggagtgttgactatgccatccactgtttgtcttcaagcagattactgtcgcgtaggggagttgtgatgtagtgtatttgtataacggtcttttaccataagtgggtattactccctccaggacatcatttaagtcaaggcagctgagacaatcacaaaagaccacgtattttatgattccattaatatgaacatcccaaatagggaactctatagaggcagaaagtaagatcagtgattgtttcaggcaggagagagtggggtgatagggaggtgatagctaaaagatacagggtttctttttgaggtaatcaaaatgttctaagattgaccatggtgctggttgcatatatctgtgaatatattaaaagccattaaattgtgtacttaaatgaattgcatggtatgtgaattatgtttcaatgaagctattaaaaaacattaaaaacaagcaaaaaatgcaggttttttttttttctcagttgtctcagtgaagttttccctgtaggtttcatagttactttaattgaatggatggtaaagagttgtctggtctgggctagatgcagtggctcgtgcctgtaatcccagcactttgacaggccaaggaaggtggattgcttgagcccaggagtttgtgaccagcctgggcaacatatggagactttgtctctacaaaaataaaataattagcagagcatggtggtggtgtggctgtagcactagctactcaagaggctgaggtgggatgatcacttgagcccaggagttcaaggctgcagtgaggtttgactgtgccactacattccagcctgggcaacagagcaagaccctgttgcttaaataaataaataaataaataaacaaataaatattcaagaattctcaggtctggatgtagggttagatgcaagttagatataagtgaaatagccggtttacttaccaatagacaggaaagtagtcttttgtgattcccttctccactaaatacaaatcagtgctactcaggggctctttaaagaaggagttggccaggtgtggtgactcacgcctgtaatcttagcactttgggaggttgaggcgggtggatcacctgaggtcaggagttcgagaccattcctgaccaacatggagaaaccctgtctctaaaaatacaaaatcagctgggcgtggtggcgcatgcctgtaatcccagctacttgggaggctgaggcaggagaatcgcttgaacccgggaggcggaggttgtagtgagccgagattgtgccattgcactccagcctgggcaacaagagcgaaactccgactacatgtaccctaaaacttaaagtataataataataaaattaaaaaaaaaaaaaagaacagcagcagtaaaaaataaataaagaaagaaataaataaataaatgaagaagtcaatcggtaccataagaaaggacaaaaaccaaaacaaacccaaagcaaaaccaaaaactccccacaaaccagcctcccctaacccttttaactcaaagcttcgtaatgtctctgaatttataattacgattttaaagagcactgtttctcatgccccatcccccaacccatttcgggagtaaaccttttctgtcagggtgaggagaaagtgggtaaaggacttcagcatttacagttgagttagtatttgttgttctccaaatgtgcaggattcagggccctctctttggtaggtgtgtgggaatctattggtatttattgggttcttaatgcctgcctgtccttgtgtaagacactctggcagtacccaggaatacatcaaccagctgagacaaacatgaagaataattattgtcctaataatagctaacatttattgattgcttactatgtgctaagcctctaaattttaaagttgttgtaaaagcaggaacaaagcctgtgacatgtaccattgtcttatttagctctcagaatcacagtggtagaggcactctcattattttacaggtgaggaaactgagattcagagggcttagatatctcgtccagggtcacatggctggtaaatggtagattcatacccagatcagcctaacagatctgaactttttcttgttgggggagaggggcaatggaatttttaacattttcattgcacaaataatgcaaattaggcaagaaaagcacaaagaagaaaataagaatcatccatatttctacacacagatttgctcatctttaatgtttctgtgtgtttccttcgtttgtgtttttatgccttctgatttatttttatatccagtcaatctctgtcagcccatcagtgaaggccattgctaattcattaaagaccttgggactgaggacatacaaatcataatcaggatatttcatggactggggattgtgggtgggggaaggatgcagatctgacaaattcatgctgtggtctaactcagagagggtcatcttgtcccaaagtgtcccctcagtctttctctccttccccaattaagactgtcttgtgaaataattaaaaatatctataaaggggcaaattttgcagcacatataattatagaaattatatagtacaatatggacaaatgcagggctaacagtaattcttagggctttcacagatgggcaaggttgggggtagggaccggctggaggcaaagagaaggcttcctgagacagaggggactggggctggctcccacccagatgaaaacctgcaaatctcagggagaaagcttcatgcactatgaaaaggtcacaagaacctccagtcctgggatgatgcaggcaagggaaaaatcaaatgggactttccccattgagtcatcaatcatttgcctggtgattggtgggagtcacctgtgtgttgtgcctgttcccagtgggaggttagagcttcatctctgaattaatatcaaaagaagagctgtctttacaaatcaatatgcttctcacaaggggatggcatatttagatgcagaggttggcatggcgaatcggatggtttgagggtagtggggcatctgggttaaaggccctgatgttctacagacttgggtttgaatcttagctgtgctactctcaagcgctgtcacctggcaagttgcttcatccctcattcgaggaagtggggccactggagcgtctacctcataggcttacaggtggttgggaggattaaatgagatgagcacatgcagcatttagtacagtgcctggcatagaataagtgctccatagggattagctaatgttttataattctaaaggggaggaaagatggatattaaggttggagaactatggatccttcccattgtattcacaaagaaaaccatgccatgaggcttttttggcaagtcactttaactttttgggcctaggttttcttaacagtgagatgctgggtggttctaaatgatctttcaaattctgcccatgactataatcctatgattctgcagttttaaagagcatcttaatgaatacaaagtacttgccagaatattttcttttttgattctccccacaacagtaatgggccgatgatgattcctgccattttcccagaccaggcagcagagctggcagacatttaatgactctccctcacaaggccatggagctcgtgagagagcataaggccaggttccctttacacacatgtggtgtgtaaaacggatgtacctcgattgggcttttgcccttgtcatggaactgagcccgaaggaggttcttagaggagcggggtgaggatttcaggagaggtgattcccaggggagcttcaggccaggactgtcatagtagagcagtaatttatgggcttctgacagcttgaaaaggtcatggtgttcttctttacttataaatgaaaacaaagtaatttgggggtcagggaaagacgaaagggcttgtgcagactgacctcaaaatccctggtggttatcatgtaaaaattcgatttgtttgatgcaattagccaaacctggacactttcttctccttctcaaagcaattgggattcagggcacaggataaaacagagttggggcagggggcagggaggaggcgctctggcaacagtgggaagtccagattgtttctattgtgcgtgctgatgtaattctttttctgcaagccctctgtggtttatcactttgccttcatgcacccttcttataaagcaattacagaatcacgggaaaataggcagtagcagtgtgaatcagtgccttttggaatggagaactgatacaaactgggcttcagtttgcagagggttgaggaatgtctaaggctcgtggatgggggaaggagaagtgacaagggatcacagatattgtatattgggcctctttggccaggccctccagtccccgaggcccttctatgctgcttactggctgcatgagggctgtggctgtggccgtcgccgtgtcagctgagcttgtaatttagatgttaccactgctcaactatgaaaagtcaggatcagcagctttgtcctagtgctgggagggaggtgtgggccctgggggaaccggcagctggatttagagtgtgaccgattccaggaacccaacagagctgcactagggccctcctcacctctgtgggtctgaatttggggtagggttccccaaaccaaactgtccagacttttctgtattgacattgagtctatagtcattagtgatcagggttccgattaatctgtgtccttattttagagtagcttttggcttagggttctggtgaccaactggtcacaaccataatttagcttctgaaaggccataagagtcagaatttgtctaacaggaatctccacagagatcctgctgcatttataattgggcatttcctctgcatttacttttgccccttgtctcctactccaagccacccccatgtgcttgaatgttgaaagttttgggttgccaggctcaacttaccagcatggttccatttctgtgattattactaactgcattgcatcatacacagagcaagtggttggaaaatagacctgcgtcctagcagtgggcaagagactcgactctcctgaatctcagtgtttttacttttaccatgggagttgtaaaatatccagcccagtataacattggctggatgtaaaacagcctagtatacaacatgggctttgtaaagtgaggtgctgttggaaagttgtttgtagtaaattgtattattacatactatacttatatagtaccaaacattggcccaaagagttttattttgttacttctttttgatctcatcaaccatgccatgcaaaaaaagaggcattttagaaaagagggaaatggaggctcatgtatgttgagtgacgtgtccaggattatttgctgaataaatgtcaaaatcagcagtacaactaggtgtctggaatcttagtccagtgcacctgtcattgtgtgctgggtgcaaggcattaaggctcactggttgtggtcctaagtgctcccctgcctttgcctgcttgccccccattcatttgttcattggctattatgagagcagctgtaagccaggccctgtgttaggaatgctgctaacgagggcaacagggctcttgctctcttggagcctattgtctagtaggggagacagacttaaaaaaatattatggcgtcaattgattctctttattttctgcatcctgtgaatgcacaagggcccagagtggagagagacttggtcccctcatcttgggctttgtcttactttctctttccttctagaaagttgtgagtcagttctttagatgggtgcgtcagggttctgccttcctgtatttgaggctttgtgtacttggtagttggagatgatggacgttgcatttgtgtgggctgaagagaattaaggaagaaacgaggcagggaagtttctccgaggaggcacattttgaacccgctgttaacgattatggcagtggccctttggaggcagctgcctctcttgctgactgtcatgacccaaccatggcaattttcactgagactgcaccttctgtttgtgatgttttagttcaggtttacattatctgagtagaactgggaatgacaaggctatgaggtcctgcctatgcccctctaacatcgtttccccaccagaagttttctcctgaggatgtattaaatgccgactacttccttggaattgctggatagcctttccagcgtgagcaatggggacagctccagaagagtggcacatcaggccagggaggattatcccagattttacagctgggtaggtggaaggcaggtctggcttgtccccacttccatcaaggagtagaggtgatttgcaaatttctctgtggtttggtttacttctttctcttggtcctttgattctttccgccttcgtctttcctttttctttctctttgcacctttctcccctgaaagatcacttggcagaatggttagaaagtactacctttgtggcttagttgatggtgcacaaaataactgaagaagaaaacataccttggctttgcagattgtatccttctggagagctgaattttccagagtgctaaagctgaattgtatccattgtaagcaacaaagctttttttttttttttttttaaaaattatctttaaagaatccattttaaaaggaaattctctgaaaatacattacacatttaactaccttcagaagcagccggctgagaacttaacccgacattctctccatcatgccgggtcactgttaggaacatccaagattctgctgtgctcgagtgatggtgccttcaggttgcttgcccctgcaggtggtggctccagagtcttagacttctctggttcttctttcttttcctgtcccatctggatcccccaaaccctgacccctcagactgttaggtattatttctgcttgtattatctctccctttctgatttgtgtgttaagaaacaagacagcaatttatttagaaatataagaacagcatctgccatgtagtggttcttattgtagatactgcaatagtttgcataaacgttcccatttaacgtccacacagatctgtgaggtgagcagcattgtgatccttattttacagaggcagacgctgagtggtagagaagatgaccacatattctccttgcctggaatacaggaaatgaattcaacattcattcattggggacttctattgtacttgttagatatcattagttaaaaataattgatgttgggggtgttgagcagtaacagaagagttaaaaaatagaatattctcatagtctggttatgtacagggcttcacaaatctttgtgttgttttacagcacttagcgggccttaagaatgagagaaacagtctgcaaattaaatcacaatgcagatgccatcttctcactgctactgtggggtttagctctacagatcagaggatggctgagtatagtaggcattttctttttgtcacgtactgatgtcacaatactttgtgttcttttatgtggtctaattgcttcaaacttgaatgtgctttcatttaaatccatttatgttgcttttgtcaaatgggaatgatttccatatgaatttgaatttacatactcataggcccttgagaccgtgtggatatagtgaacccaactcttggtagacttgggctctatttttgcctcagccactgacttgttgacttgctgaagggccttgaacagaaatgattacttttctggacttaacactcctcagctgtaaaatgaggtaggaaatctgatgtgatttctagttggggacattctagaagattccatattgtatctcaaatgactgttcagagacacagtctttaggtgctcactctagagaggactgtgataagcataaagcataataatgtaaaccctaacttacaagtttctttaaaagttgactcttaagggtattacacttgctcatattttaaatatttaaaaacaattaaaatttttttccttcatattcaccattggcttttcaagcatgcacagaagtggtgtgcagatcgtttcagatcaatttatcataaaatctaagttgataggtgttctcttaatgatgttcttatactgcctgttcaccttgaccctttagctttgagtagattagagagtgtaggggaaagatctttttcccttcaaatactcaaaggatcatgtgttctcttgagcagttctgcaaatccatataggacaacaggagaataaggatttaaagtgaaagatttcagtcggctgctgagctgctgggaggaagagatggtgtgtggtgctgacctgtccctgattgcccctcatagaaagcgaattggctctccccacgttggctcccatggaaaggactgatgggagagagagtgaggagagctggggatgcccttccagaatgctgaccagggcacgtgggagcagtggtgctggctggccttcaagatccctttctgcacatgggagctgaaccagtgagatacagcacctggatcaggcagcgcagaggagcagtgtggttctcctctgtggtgtgaaattaccctggaaccaccaagcagggttcaacagcactgatccctcccatcaacccaggtctaggtctcactccctcagcaccatctcgcagcttctagcacccctggaggctctgtgaacctctcaccctgcattccttgactcttcatgaactgtcggccttcctgtgtaagtgggtcaggcaccatgtgacctgctcactgccagtttcttctttgaatagatgtttatttcatggatcattttgaagattctccgtgggtgtgcaacatggttttagaatgttgggtaatttctcatgtgttctttgagatggatggcttctcagtcgtctttgcagtcagccactgtagacttgagtttctctcttgctgtcttcattttattgctccatatctgaggaaaaccatgtgaaaaatccctagacacataggagccctgagaagtggtggcagggaatgcttgggggacaaaacagattttagagttacgggtattttaattaaaaaaagagagacccagaattgtttttcacttaaatgagcaattatatctttaacttggggatggaaatatgttgtgaaatttgtttagtcagctccctctgaaataaataaaattacagtgatgatatcattcttgtttaaaatgtttgaaaaggtatcaagacaaagtgattaaggcctaactgtttgccaaattttctttaaagctccatttttggggtatttctatgccaaaaaacatcttaaactgatgaacatatagttctccgcacttgtattggctggtttttaattagatgactgttttaatagtggaagaaatacatttaggttgggcctaagccccagggtgccagatttcaatcccagaaaaaaatgttctctctgtttagtgctaatgtgcacttaaatagcacaggtgtgagtgcttttccctggccacggtcacacatgactttcccaagggctgattggttatggggttggcaggtttaaggtcaggttccccggcttgccctccacccagaggagccaggactctcaggctccctgtaagggaagaagttacccagatcatgagcctgttttgtctgggtcagactgacttgagccacagggagtgggtacagaagcctgggttgctgccgggtatgacccgaccttcgtcttgtacccactgtctccttccttttgtgagtcaccagctcacacatctacatgcctgtaaatgaactatgaggtatcgagtatgtgctacctaccgtggtggatgctgggaaggatgaaccatgcattttcctaaacccacacttcgaggtttacaaagataaaatctcatggctctttgccatccccttctcaagaaccttcactggctctctttttagttaggaaagaaggtccaaagcaaaagaaaggaaacacagggtgtgaaggctggactcctacctaacacacctgtccattccaaacaaactggccgtgcctcctcctcgatctcccacttgtgtgggtggctgtgtcatttctgtgcagcagctgatggtgaggtctttcacttggctccatggtgaatggggaaattctcccaggcactcttcctgcctcatctgtgaccgtttgtcttcccctggggctatagtttgagtactaggtggtattttcagtcttgtctttgccctgaggatgcagaagtactctatggctatcccactcctgacctatgcccaggccccctcttccctctgggggtggatcccacttgtacgggcaactcagtgcagtaccctggaaaatggcagacctggggtatctctggtctctgccactgtctcccagtgtgtgtggaggggctgtatgcttgaggcattattttactgtggcttacctccttggtgttttctccaacttggagcttgggtgagaatgctcagggcttggttgacacctcttcattgtcccagaggtgtaagggctgggtcggaagctatgccaccagaagccatgctgccctttccaccagatacttctgtttctcttctcgacatagaccaattccctttctttctttttctttttttgagacagagtctcgctctgttgcccaggctggactgcaattgcacaatctcagctcactgcaacctctgccttccaggttcaggcaattctcctgcctcaacctcccaagtagctgggattaaagacatgcaccaccatgcctggctaatctttgtaattttagtagagacagggttttaccatgatggccaggctggtctcaaactcctgacctcaagtgatctgcccgcctcggcctcccaaagtgctggggttacaggacatttccctttcttgtttgatttctcctggtatcttctttctttctctttggactttctttcctatctcatatttattttgcttggcattgtagtagaaagataacatgttaccactttaccctccagtctgaacttggaactgctgccatacactaaaaggatttactattcttaaggatttccttccatcctaaactacaaactttttcaggtcaggaactacattttattttgtgtattcccactgtaccttcacctgctgagtgcttaataaacccaggacagaattgaaggcaggctgagcctgtataggagagcagttgctttcaagttatgttaaaaactcctgggcgggagcattcaaaaattactcatagataacaaatccagctacctgcacgtgcatgaaagcagggaactagagccactttcagacagtgacttcagcttaggaaacaaaaggttactttaaagtaatgctgttttacttatgtttaaccaattctagttgacacacttattcagaatggccttactgccaattagtggagcatgttagtgaagtttgtaataaagtcctaatttccgtgactaatgaagctttacttgtgttcaacacaatccctgctctcagttatgaagttataaaaaaatgtgtttatgctgttgctgccgctgcccgtctgtctgcctccctgcctgcctgcacagtctttaagagcactgttgctctcctcctgttcctcacgcatttcaagcacaaatccctaccattcatcaaaggcatttgctggtggtggcaggggaaatgtcacagcactgctgccaccactgccaggtatctttttaaaatgtaatgtgtgtgtatgggtatgtgtgtgtgtatgacttccaccatttctacgggaatgttttttgattagaaaaagaaatagttgttacatttgcaatttgtaaccagaaccattttctttccaatgcagttgtaacagtgtaatgataagtagggtctttatccaaccctatgacaagtcacatgtacacacgccagacataggctccagattctgtaatatttagccctatacagtcaacagatttgattccctggcagtcagtctttgcattggaagagagagtaaaaattaggactggtgagttcaaaggttcttctaaggcctaagcctttgcagtaggagctttccatactagatatgttacctagagacttgtgttaaagtggaaaatcatgggctgggcatggtggctcacacctgtaatctcagcactttgggaggccaaggcgggcagatcatgaggtcaggagatggagaccatcctggctaacacagtgaaaccctgtctctactaaaaatacaaaaaattagctgggcgtggtggtgggtgcctatagtcccagctacttgggaggctgagggaggagaatggcgtgaacccgggaggcggagcttgcagtgagccaagatggcaccattgcactccagcctgggcaacagagtgagactctgtctcaaaaaaaaaaaaaaggtggaaaattatcatacaaatcatatttgtgtcaatctttgtgagggtgtcctaaactgtaagtgtgcctatatgtgtgttttaaaaccagaatgtctagtattgtaccacagaaaaaagacgttacaaaaatagaaattgtgtcagtaatttgcttttactgctatgaacaatcatatgcaattcctacaagtcatgctgtgtctagcctcacagccccctcactctccaggcctttctgccaaactcagcttctctgtgagcatgccctgatgagttcaaggggctcccttcttcgtgccaccacctttgagtccacaacaggatggctgttgaattgaacatgcacttagatttcgttaccgtttcctaggtctttttcaaatacattccgcttctctctttagttactttttagtctccctcaagggtagggattagattcttctttgttccctctcccatagcacagtttatgtggcttttgctgcgtgaggttaaagcacattggtggcttacatcttatccatttgtaaccacccagggaccagcacatggccttgtacccagtaaacaatcaatattttgttgattaatgatgcctaaagctggttaagttcttggactcaacattcttctgagctcaatgactatttgcattctagtcataaacaggaaaaggttctgttggcagccagggagatagtaaatacccctgactctcatacattgacttaatcagaaacaacaacttccccttttcaaatttgcattgtgaatgataatatcattttcaaatatgtaggattatgacattttaaagagaatataatgaaatagaatgaaggtgaaaacttgtaattatattagagcaaaactatgtttcccatagcttatatcctactatttctatgtagtgtatctggcgtggtcccatgaggatgccataaccaaatgattgaactagaaactgagaaagacttatcaaacatttagtgtcacgggcttgtgagatgaatcaatgctgggatttccagctatgttttttatggccctgtattttacaaagctgtggaaaatattgagcatttgaacaaggctctcagtcacagtcgtataacaagatgcaggatagggctttgcccgtggagttcagtgtgaaagtggctgtggttggtggaccttctgccctttcccctattgctctctggctgctttttctggtgggtgtgtgtgtgtgtgtgtgtgtgttttttttttttttttttttttctgaggtacttcccagggaacagagaaataagttgacaaaaggcacatataaaagagagatctaggactttctaaacctgaggcccacagccctttcatttaatgctatattggcacatgtcttttttctcttcaaatcattctcaatcatggtccatttctcaccaccccctcctcccaacttgttatcagttgcgcctgaccttttgggaaggaagaatctttaaaccctgtttgcatctcagcagacgggaatgcctgcctacttctcatctagggctcctttctctgcctttagaaattcttttttattcttgatacacactgctcagattatttattaatttaaaaattaacatacagtaaaaatcggggtgtgtgcacgtgtatacagttctgtgagctttaacatataaattgttgtatctcttaccacaattaagataacagaacagttttgtcccccgcaaaacttatcctgcctcttgtagtcctattcttcctttaccccagcccatggcaaccactgatctgttctctattgctatagttttgtcatttccagaatgtcatgtaaatggaatcactcagcataatgcctttgatattcatccatgtttaggagtgtggagaaatcgttcttttttattgctgagtaatattacatttatggatatagtacagtttatccatttatctgttgaaggaaatttgggttatttccagtttctggtgattataaaaaggtgctagaaacgtacaggtttttgtatgaatatagatgttcactagcgtaaatacctaggagtggaattgtatatttaacattataagaagctaactgctttctaaaatggctgtaccattttgtattcccaccagaagtgtatgagagctatagttgcttcacattcttgccaacacttaatcgtgtcagtactttttattttagcttctgtaataggtgcgtagtagtatctcattttggttttaatttttatttcctaatggataataatgttatgttatttcatgcgcttatttgccacctgtttattattattttggtgacttggtgaagtgactatttctgtcttttgggtttctttttactgttcaatttgaaaagtgccccatatatcctggatccaggtcttttatcagatatgtgatttgcaaatattttctctcagtctatagcttgtctttctattatctctcttgctctcttttttttttttaatttttttttgagacagagtcttgctctgttgccaggctggagtgcagcgatgtgatcttggctcactgcaacttctgcctcctgggttcaagtgattctcctgcctcagcctcctgagtagctggggctacaggcatgtaccaccatgtctggctaatttttgtatttttagtagagatggggttttaccatgttggccaagctggtcttgaactcctgaccttaagtgatcagctcaccttggcctcccaaagtgctgggattacaggcatgagccaccatgcccagctgtctttctgttctctaagtgtgttttgcagagcaaaagttttaaattttgatgacatccagttacttggtttttccttttatgagttatacttttgatgtcgtatctaagaaatcttcgcccaactacagatcataaagattttctccagtttttttcctagaagttttatagttttacattaagatctgtggtctatggccaggcgtggtggctcaccgctgtaatcccagcacttgggagtccgaggagggcgggtcacctgaggtcgggagtttgagaccagcctgaccaacatggagaaaccccatctctacaaaaaatacaaaattagccgggtgtggtggtgcatgcttgtaatcccagctacttgggaggctggggcaggagaattgcttgaacccgggaggtggaggttgcagtgagccgagattgcgccattgcactccagcctgggcgacaagagcgaaactctgtctcaaaaaaaaagaaaaaaagaaagatctgtgttctacttagatttaatttttgtagaaaaagtatgaagtttaggttgaagtgcgttttcttttgcatatgaatgttcagtgtttcaactctatttgttgaaaagcctatcctttctcaactgaattatctgtacatttgtcaaaaatcacttggccatacttgactctatttccagactctattctgttggtctttgtgtctgtcccttcaccagcactatactgttttgattactacagatttattgtaagtcataaagcggggtgacttgaattctccagtttcttatttctcaaatttttgtcgttcattttaattcctttgtcttttcacataaatttcagattcagcttgctgacttctaccaaaaaagcctgctgtgattttgattgcactgaatctatagatcgatttggggagaattgatatttcaatcatattgttttctaattcctgaacatgatatccttctctatttattaaggtcagcttctgttgagttgatcatgtgcttttgacctttattctattaatatgatgtattacactgatttttgtttgaacacaatctcacgttcttcatataaatcccacttagtcatggtcaaaatgtttatatgtttatatactgcattcagtttgctagcattttgttgatgatttttatgtctatattcataagagatgttggtatgtagttttctttgtgatatctttgtgtggtttttggtatcaggtaatactggccttatagtattccctcctctcctggtttttgtagaagtgtttatgaaggattgatgtgaattctttttttgaacatttggtagaattcaccagttaagccatatgggtttggccttttctttgtgagaagttttttgattactaattcaatctcttcagttattataggcctgttccaattttccatttcttctagagtcagtttcagtagtagttatttatttatttttcctgagaacttgtccatttcatgtaggctatctaatttgttgactgcatttcttttagaatgaattctcttagttttcatccctctgagattgttctttcacctgcatttcaaaaggatgcttcttgctaggtaaaggattatagattgacagctcttttctttcagcactttatcagaattgttcctcttctttctgacctccatggtttcttctgagaaatctgtaataattcaaatcattcttctctatgctgtatgttgttttcctctggctattttcaagatttttttcattgtctttagtttttagcaatttgtttatgatctttctaggtattgatttctttgagataatcctgctggcagtctgctgagcttcttgcagtggtaagtttaggtcttttgctaaatataggaagttttcagccagtatttcttcaagtatttttcctacacaacaccgtttcttctcttcttctggaactctagttccagtattttagtattttctttttagtattttcttacagatccctgagcctctgcttatttttataatctttttttctcttcatgttttacattagataatctctattaatctaaattcacattcactcactattcctgctattacctccagtctgcaattgaagctatccagtgacattttaagttttattgtatctttattttcaaaatttttgtttttgctatcattccatttattttaagagtatttagccttacttcttggagcatggttaaaataggtactttaaattatttgtttgataattctggtatctatgctatcttggggttggtgtcttttgattgtctttttccttgcaaattgagagttttccagtttttcgtatgttgagtaattttggagtatgttctagacatcttgaatatttttattctgagtcttatttattatggagactgtttatttccttaagcagataatcgacctggttgcaaattctgacctgacttctctgggctatgtttctgactttggttcagttttcaaagcctttacagtgtcattttagtctgtttcttttgtgtgcaatctattgttcagtctgggacctgggcaatgatatcctaaagtgaaaatctgaaggccactggcatacttttagggtcggatccacaacgaagagcttaaatgtgagcccacatgttaatatgcccctttgtgatgtaactctcttgagcttccttggttccctgatgtcctctttttgctgtcctccagctagaaagcgaggaatttagttcctctgttctcctgcattactttacgtgactgtgtccaaggccaagcgcttgaaggtcagggagaaaaagaagcaatggaaattcgccccttattctgggactacaactcttgtgagaatcattcttctttctcagagttttaggtacctgctccgcctgtgctgctgcttcttggtactgagggattgtctgggggctggggtgggagggattggaaaaaaacaaagcaatacagataatttctctgaacattaggagttccttttttttttttttttttttcctttgttggccagaaaatgagggttctcttcaggttatttctgtccatacccagctagcacttttggatggtgagctgcctttgaatccagactgggtgatactggagggggaaaacagtggaaaattctctgctggtttggtgatactctgagttctagtctcatttctcaatctatttgttgttatttacttttcagagtcctctgattcttcatgttttctgtctagcttatatatttgcatttggtaggaaagatagggtgggagttcttactccatcttgcctggaactggagcctctatattagtctgtttatttattaatcaaatcctgcatagagtgggatttaccaagcctggtttcttgagatcctaggatgtattcataatatgtatcatggaattctcaaataatgcttatgataaaataagcttaaattttccttactttaaagcagaggctggcaaatgttttctgcacaggaccaaatagtaaatattttagtcttgtggtctcatagtctctgtcataacttcttaactctgctgtcatagtgtaaaagcaaccacgaacaatacataactagtaaagatagctatggtccaattaaactattgattgacactgaaatttgaatttcttatacttttcatgtgtcatgaattattatttttttgatttcttacaaccgtttagtaggtagtgggccagatttcgcccatgggccaaaatttactgaccactaatttatgtcatggatggctctatggccctgatcaacaactcctcttgattgaaattttctgtctgttctggagaaacaaagataggaaagcaagagaagttctagaaatcctatggaatgcttatggatacaacctgtaagccaaagtagcttctcagtcttcttttgaactccttaggtagggcacagagagagctcatagatgttttatcttaattcatctccatattactttgtaaggtaaatgctttcatcttcattttatggatcaagaaactgaggcacagagaggactgctagcatgtctcaagtcatgactaaactgggatttgtatccaggcctgtccagcaccaaagctgttgctcttcacactctaggatggcacaaatctcctttttttctgttttatcttgtctctgtacaaaaaagccatgtcaataatggtataggtcattgaaagccttatactttaagactgctgcgctctggtctggacttactcatgaattattgcataactctgggcaaacctcttcatttctcaaggtcttagtctccatgcctataaaataggggattggatccctattttacgtttatttctctgtcatggtagctgtgagagttttgtcagtgagcatcctaatcacagacagcgactttggaaagagatggtacaccttgtcattggagggctgtggggagttgtagagaacaagcttcatcctgggaccatgtgtgatggctgttgacatagagctttgtagctgtcaaggaaaatagagtaaacacactacttccttttgatcttcagtttttcgcagtatgctcctagatcatacttctcttgatttagtgatagccttataaattattgccactttctttgaacccttattggtataagtcggtgataaatgcttgagaaactgggccttgatgaagtactggtatacctcgtttggaatttgttctgaaaatggtaaagcatttcttaaaggctttgttataatatgaaaatgttcattgctttttttgttcattctataatttttttatcccttttacattgcatgtcttgattacatagttgatttgatattctctgaaatgtgatggaaaagaaaatgtaaacacaaaattaaaaagcagaggaatgaagacacattttgtgtgctgcttcgtgccagatagttttgtacatatccttgtacaaagtagtggtctcatttttaccacagtgagtaagcccctggtctctacctttaaggaacttagagtttgataggcttagtggttctcaactggcattaccctctcttgagagtatttagaaatctgtggagcagctgcaattgtcacaaatattgagggatgctgttggaatttagtgtgtgggattttatcacaatgaagaattatcccaccaaaaatgtttatagatctccttttgggaaacactgtgctgagtaaaatagtagtaatgataataaaaacacttgcatattgagcactgccattgtgttcagagaactctacagatacagtccatattctctgatatgtagctctaaattcagaaatctctaaaattgaagtgggttttttattaatccatttggtaaaatgtgacctgaattgatgtgagaacttttatttttttaaagctgagaactgtattttttatagctgtattgaagtatagtttacatatcaaaaaattcacctgttttaagtgtacaatttggtgatttttagtaaatttaaaaagctatatgtaactcttaccacaatccagttttataacattttcataaatgcctccccccccaaattctcttgaacctgtgtgagatgatttccagatgtttcactgaagaaatatggaagtgtttgattatggagtgctgctccagatccttcctgaatgctaggtattcattcattttgaattccaaatatacccggctgcagaagtttcttgtaagagattgtggactgtatgaacacatcccatccccacaataaccctggaaagtagatgctattattgttccttgttttgcagttcaggaaactgaggcatagcctttatacaaggctgaatggaatgtcacaagaaagtccagtgggggtccagaagagaaaatctgtgaccacttggcctgtaaccgaatttgcctatatttaaagatggaggaaataatctttttgttttgttttgtttttttagttgatactaaaggatatgcataaagtatttaaagtttaactcaagatccagtggatatgtgtggaccctcactacctagtctataactcaccacacctttcactcctttgggtgtccatccttatcctctgtccccctcccacagggatgaccactgtctaaaatttgtgcttatcaggccaggcacggtggctcacacccgtaatgccagcactgtgggaggccaaggcggatggatcacctgaggtcaggagttcaagaccaacctggctgacatgatgaaaccccatctctactaaaaatacagaaagtaaccaggcgtggtcgtgggcgcctgtagtcccagctacttgggaggctgaggcaggagaatcacttgaacccgggaggcagaggttgaagtgagctgagattgcaccactgcactccagcctgggtgacagcctgggtgagggcgagactctgtctcaaaaaaaaaaaaaaaaaaaaagtgcttatctttctttgattctctttagttttaccacatatgttttaattcctcagcaacactttaattttgcatatttttgaagtttatataaatggaattatactgagtatattcttctgtaacttagttttccctcaataatacttcttagatttatcggtaattcattagttttcattgttcttttgtagaatataccatgatctatctatactttgactgttggtggacatttgtgatgttttctttttttctaaaaagagataattcaaatggtgctatattgaatagtcctcctgaatttttcttgatacatatgtgctaaggattatgtaggcatgaaatttcagggtcctattgtgggtacatcttcagctttattggatgatgcctagttgttttccaaggggttatataaatttatactccctccaataatttatagatgctaaaatttttccaatctaatggttctaaaatgatatatcattctgacttgaatatgtatttctgtgatgactaatgagattgagcatcttttaatatagccatttagttttccctttttgtgaagtgtccgttgagtcttatgtccatttttctactggtttgtctttttttttgagacagtcttgctctgttgccgaggctggagtgcaatggcataatctcagctcatttcaaccactgcctcctgggttcaaatgattctcctgcctcagcctcctgagtagctgggattacaggtagttgccaccatacctggctaatttttgtatttttagtagatacagggtttccccatgttggccaggctggtctcgaactcctgacctcaagtgatctgcccaccccggcctcccaaagtgctgggatttgctgggttgtcttttgaatactcatttattaaacttctttatgtgctctggatactgatcctttgttgtttatacatgatagaaatgttttttccttctttgtggcttgtccttttgatctctttttggtgtctttggataaacagaagttcttaattttaatgtagctaatttatcattttccattaggagtttttttctttagtttttaaattagcgtttatggagtactttgtatatcctagacacctttctaagcaccttataaatatccattaatccttataacattagaggcaagtactgttgctatttccattttataggtaaggaaactgaggcacagaatgttaagtgactttttcaaggtcactcaggtagtaaatggtagagccaggacttgaaccaaagctgtttaaggaattcttaagaaaaccttttctaccatgataagatgtgcagatattcttatatgtcctctgaaacttttttgtttgtttgtttttgttttttgcctttagcatgtaggtcttcagttgctctctaatagatttttgtgtgtggtatgaggtaggggcccagtttaatttttttccatgtggattatcagtgtttcagcacagattacttaaagtctaaccctttccccacctctataatacatgccttataacaaatcaaatttccttatatgctcatatctatttctgggttcattgttttagtggtgaatttgtctctgtgtcagcactgtactgtattaattagtatgcctttataataattcttgatatcagtaagtcaagtccttccatcttgttctactttatcagcagattcttggaaagtttcctactctttaaaagcaagattgcaggataatttttgactgtaacacacacacacacacacgtacacacatgcatacacacattggggctttggaagatgatttgtcattgctattgtattgacttgtttcctgaaaatttagcagatataatttcatttgagtggcttgagctctatttatctgcatggccaaaatctcaaacacacatgatgtagtggcttgtagaaagcttttgattcttgttaaatggagaggagggagaaaggaaaggaaaatcagtctggtagattactagtgtcttctgtttaagttcagttgcgctgataattccagaaaatatactgaggaacttcaaaaggcatgtggaaccttgtgtagtatgatttatactaatcatagtatgtgtgtatgattgtataaggtgaaaaacaagataatgcatcttctatgattaagttgccttatttatcaagtaagaggtaactgtaccccgttggtcttaaatagctgatatgtggtttggtacttaatactgtctattggaggaattgaaatagaatacccagagatacccagagtctccactgggaatacttctgctccccaaatgtgatatcagagtaatatcaagtagaatgtggagtacacccacctattgaggcacaaactgccctctcccatgaccctttctctgtagaaagtattacttatactgtaaatagcagtcaaatttcaagtaacatcagttctctacatcttagccttttccaatctgggtggccaaagtgaagaatgattaggtactgaaaatttataaatgccgtgtctgagaatttctagacaatgggaagacacctccctaaggaaacctgtcagtctgaagtcttcccagctttcagagcatagcaagttcttaccatagcctggagaatatgtgatctgccagtgcctgctgccccttcacctcttactgacatcccccttctctctgcaagagtgactgccttgctgttcttcagaatgccaggcaccctttcaccccaagcatttgctctcctcttccttctgcctgtatgtgcttccctggatgggtgtttggtttactcctgattacctgggtctctgctcgaatgtcatcttctcagagaggtcctccctgaccaccctctcccataatagcacccacattcatctctgccagccctccctgagttcctacatggcacctgacacatattcactgtctgccctccctcgcttcccctccccacacactaggaagtcacttcctagaggaccagggactttgtctttttaactgctgtttcttccacacatgtgccacagcgtggcacatgggagccgcttgagagctgtttgctgagtgaaggaagctgttggctgaaaggagggcagagagggcctctggagcaggcccgtgccccaccagccctccccgagagctcctgcggcagcttgcttgcctctctgtcggaaacttgcaccatttaggcagctcttccatgagtattcttccattacatgctaagcaccttgagacaaaggtctgtcttaagttctttccctactgtcacccctgctgttttccttcagggctcggactgagcctggcacgctatttgctcatgctatttgtcttcagctatctgttaagaaggcatgcgggtagcagtcatcctccccaaggggagcagcagattaggcagcactgtaattccttaagcaaactcctggcccaactagcatttccattctgaattcctctatgtactgtctttgagtcttatggagacgataatcttggtgagaaaagggaccagccatattcactgcaggatctcccgtggatgcatagcatggtgccagaggcatggtaccccaactcagcacacactcactaataattcatcgctaaagttcactttggcctatgtgaaatttattattgttgatgtccaacattacactaaaattataagaatttatgtacaatctctgtacaggatctgtagggagcacacagtttttcattatgaaagaggcttcgttgctcatctcagctcctgtgctgttgaacaaaaggtgttagacacacacccattccctacttggggtattcacaaatgtcagacctcaaagtctcttctgagtaaattactgcctttgcttcatttaaaggtgcccttgtgaccttaaagaattcagccacctttcaaaatagagctgtatttctactcccacctcaccagagggtgagcctcaagtgtttgattacagaggagcgagaacttactctctaggattaatgtaataagagatgaagagcagacaacatagccactcaccgaaaaccatgtattcataaaaaataagccaagcccaaagtctggatttcagaatattttcattaataaatactttattgcaatgaacagcttaattgcttaatctctgtgtagttatggacatgtcttgtatacactgcctgggctgtatacactgtgtacactgctggctggatgggcttaggcagaagcaagggtcaaggcttttgccagtcttgcaaggcaggcttgcatcaggaattcctagagactgaggagttctcattgtaggtttctttctgactgaaagaagcatggtgcgggcagagcactaggctgcgggggttagaagaccttgcctcacgactctaaataagtcgtttaacctaattgagcctcagggtcctcccctaatggagacggacacatcaaggggctgtttggatcaaatgagatcatgtgactgtttgtggataatgaagttctgtggaaagaagatgggagggtagcattgcatactgtcttggtaagacctcagacttgcttagctgcagctcttcaccctcttacggacctgcagctgagcagctaagcgtgattggaaatgtcattcagctacgatgactggtattctttaaaatgaccactgacttcaagcaagaacttcacaccactggcattgatgctacattcaggaccattctttctcatttctagacagtgatttcatatattttcctctctcccgaaacctccagcaccttccagcctcactctcggccgatggctttacttcccatttccctgagaaaattcaagccgccaggagagaacttctcaaaagcgcccactgccacatccccctgcctactcttctgtccacagatactgctgcctcccctgttagcatgggtgaccatacacactccttgctaaggccagcttctttactcgcacaccaggttgcatccagccttgcctgttgaagtccatggcagtgccgttctcctgcctctctcctgctgtcagctttttcttctagactggatcttcccagtcaatacacacaaacatactcttgttaatatctcccacttagataaccctttattgattccttttcagtcattagctactaccccatttctcttttcctgtatggctaaatactttaaattattttccatattccctgctgcctattcctcctctcatattcctcttgaaactcatcgtcatcaggcttttgctccctccagcctaccaaatctgctgtcatcaagatcacaactggtcttcctgctgttaaatccagtggtcagtttccatccctcactgtacttgattccacatctagcatcctccctcgttaatgcactttcttctcatcttctcatggctcccaggataccacactttcctggtgttccccccacctcactgttgcttcctttcagtcttctttcctgattcttcctggccatttgttgtcttgttggagtgcctggaggagtctttaggccttctcctcctatttctatcagcactcgctccctcaatgatcttacccagtctggagtttcaaatccatccagaagctaacatctcatgcatctccagttgaggcctcccttccacactgcaagttctcacatccctctgcccttggagaggcacgccctgtcctacttaccctcccaagtgcttaccactgctcactggcttaggcgtacgtgttggccaggggttgtcatctctgtgctctccactagaatgtgggctccacaatggaggactccgtttactgttgtatccatagcacttagaagagtgcctggcacatagtaggtacttattcaatattttgttaaaggagtgaatgtgttaggtctccatatacagtggagattctagtaattcgctgtctcaggtcctgtctcaactctccctactagtattagggtgccctagcctttcagagatggtctttgtcttggaactcttactaaatctatttgataaaatatgattgtttctctagaactctgttgaattgataccaggcattcaactatgcagtattaaatgtattctttatcattgatttggggaggctatttgggatagtagaaagatctttgactttagagccagatacttctgagtttaaattcttgctctgctgctaaatagctacagagccttagtggaaacatacagtcttaggccttagttttctcatttgtaaagtgaaagatttggttcatagggctcttgggagaaattacatgctgaatatatgaaatgcatctagcataatctctggcatataacaggcattctatagtggtaactatgatgattatggtccttagctatacggataatcttaggattgcttgcaattcaaaactttttggaaaaaaaaatgtaattattccttttaaatactggccgttggtctttggttcagaacataattgtctaatttaacattgtttctgtggtaaaagttagatttgatttacatttcaacttacagagcctttttcaggaatttattctgcttcaaagatcaaggacttcctttcagtgaaacttaacgacagtgcttaggaatggaatgctctggaaggattgtcttctaattaatgagaaaggagcttattttgtgggggaggttctaaaatgcctttatatgtgcactgagcataattccaaagttatacagtaaacactccatgaatacttggttacttgtttttgctccagagatacttaactgaactcctctattgattgccctgaggtatagctatggaaagtagaggtgatgctactaaatacaaattcaacataggcttacaaatatcttagaggagcttttctggctttgaactgtaaacgtcaacggagctatattcatgataattatatcttgattgtatcttcttagggaaaggattgtcaatggtcctagctcaaaggaaattgaacaaagaagttaagatagcacatgcaaacatacacatccgtgtgtgcccaaacatacggactctctcacactgttaaataatgcatgagcaaaatattaagtgcaaggtacagtctaacgcatatcactctgcagtatgtggtaagtgccaaatgaacaggataaatttaagtactgtaatttcaaagaacgagtcattagcaaaggctaaaaatggtcaaggaaggcttcctggaaaaagtgagcttggagctgggcattgacagatgagtcacactgtgcctcatgatgcagtgtgcagaactggtccagccagggtcaagtggatggctctcaggccagtccacaccctcctctgggggaactagggcaagtctgctggctgcctcagtccttccctgtgaatgcagcccattattcctgaatcacatccttgtctgccattggtgattttgggtgcttcgtgggctttgggtcaaggcagggggttcttaagtggggagggcaggaaagggagtttaggatcacgtttgttgtggggaagtatctgaatgattcatttgctgtgcgtgtctgaatctttctttggagatgagttgatgagggcaagctttggctgtggatttctctctggtgatgtgatttgatttgatggataattatggaagagaaggaaaaggagattcaggattcagacacagaaaaacctgacaaacgattcacaaacacttttctccacccacagaaacccaaatacttagactgtgccttgtggcaggggcagtagggtggctggagagagctgtcacatgcactcacttgcccagctccatggattgtttacttggcagccatagctgtcgatagttggttatacgaatggggtgtgtttggccaggatcccgtagtctcacttaggcctttcataatagtcatgacaggttctctgtggtcagggaggctgggatagaggtgggggagctggaaaaggatgggccacctctgtcctgtccatagggtgacagccacagttctccataggaaccaaacctgcaggtgtgtcagttaaccatgaaccctaagcaggaaaataatatcgccttttttagacctccgcaatttgtgtctctgcataagacaatgagttttattgcaaaggcctagttacaaaaaagcgtgtcctgtgtgacgatgactgtgactgtcccaagctgttctgcttcggtaggacagtccaaaccagaaccaggaccaggcttgcttgacaaatcctctctaaaggaacaggtggtaggaaacttctgaccctcagcgattggactcaaaacattctctggaagtgccttagacattaccctggttttacaaatgagaaaactaccactctgtccatggactgatttgtttgaggttaccaaactcttcttgcctgtctctttctctctttacatgctgttaatttgttgtggactgccagatttacatctcttcccctgacctgttgctattctagacttgtatgtttcaaaagcatctcaagcttgccatgtgcaaaatggaatccagctctttctccaagcctggccactcccagcccttccagtcccagtggatggtgtcaagtccacctagggtgctgaccccacaagttgagcctgagaatgtcttggatttctttttatccctctaccatcgaaatcatcaacttttttggccctctctgcctctggtttgtttgtttgtttgtttatttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaatttttgtattttttatagagacaaggcttcaccgtgttgcccaggctggtctcgaactcataagctgaagtgatccacccgcattggcctctcaaagtgctgggattacaggcgtgagccacagtgcccagccttctggatttattttgaacctctccacttatttctctttgtctctgctaccacctccctgatctaaaccaccaccatcctttgtgcctccagtctcttctccacacagtctccagagtggccttttaaaaacaaagctgagcatgttccccgtctcaacacccgtttatagaccatctttatatgaacagaactcaggctttgtgctggcgtccacaggctgtgtgtggtccctgtctctctcctgcaaccctgtccatcttccctcttgcccatggcacactggccatatcagcatcatttcagtgtcctttgaatgataaatatttgttgccacagagctttcaaacatagttttccacctgaaaacttctttttatccattagtttgtagcttagatgtcgcctctgttaggccttcatggattcctccatctaaaaagtcctcccatatttttctctatcattatggccagcttgttttcttgacagcatcatttatgattgtttattaattgatctggttattctctgtgccaactgctggcaggaaagggctgacatttgttttgcacccccgtaggagcgtccttttattcccagctggcttcctattactgtaccttcccctcactcctccacacttgtctccttgctgttcctcagccgtgccaggcttgctgtgccctggggcctttgtacttgctcggccttcttttaagaactttttttaaatactggtatctatgtggctgactctcattttctttagatctttactcagagtcaccttttcagtgacgctagctctggtcccagtgtctaaaactgcacctgcccctgacactccatactgaacttcttggctttatttttctcctttgtgcttctccctatccaccatatggcacattttacttatgccatttattgtctgtctccccagctagaatgacatctccatgagggcaaggagtttcttctgttctttcactgttgtatgtccagtatctcgaatagctctgggcacacaggcactctatacatggttgaatgaatgaatgaatgaatgatttcatgaacaaagtgtgtccagtcactggcacatagtgggctctccttatcctttttattgtggtgagatacagtgtatcattttaacaaattttaagagcacagttcaatgacattacatttgtattgttgtgtaaccatcaccactgtctgctccctacacttttctgaaatgaaggagtcgaggaataagcaagtaattgagtgagggactcttggcaaagcagttgtacagtgtcgatctcttgacttggaggcccagggggtcctttccattgcactgtgctctggaggaggaagggcaagaagatgagtctgagccccatctcagggtgctcgatgcatgcagcaaggaagctcagtgtttccacacgtttcaggttgcctctgttctaaatgacgagggtgctgccctgtctccccttccttctgccgtgcacacacctgctcacacaggcaccatgtgtacacatcccttcctctgcactggaggaagcacctttgcaatatttccagctcatgggatggtgtgaaagggatatgctcattctcctttgaacccttctcaccggatctccatcatgaggggactctctctgcctcccttggtgttctcatcagcacctcgtcaggtgagtattccattgatggcagggaagtgtttatttttaattctaaagtaaatcagattacatagaacacaaaatgttgtgttggatcaaaaccattgactatgaaattctcccagatggatgaaaggcgggggcttgttttcagcccttaaccacttcttctcacaagctggttaaattctacgagaagtccatccttgcgagcacttcgccatcacaggcccttcccttggggagctgtggcatctcccccacccccagcacactcacaccccccagcagacgggaacattctcatgctcactgtcactcacgtgtgtgctgtcccacgtgttctcactcatatgcactaattacacacacacacccaacctgcaggtttgcttttgacacgccaggaattacatgggagcagccagagagcccaaagtaagccttgagatgactttaacccctgtgaagcccacagggtaagacccctgctcagaccaacgtgacaggctcctgctcatcacgtgagttgccctggattcctcgatgacgttgcaatggtgtcttctcaacaaaacctcattgaggtcttgagacaggggcgcaggccaggcacatctaagtgttcgaggtcttctttgttgaattccacagcattatgtgtgcctccaggatgtgcctggcacatggttggcctggggtgtttggagaggactgggtgtaggccggaccctagaggagcttataggacagtgctggcggcagaggtgcccatacctgcgtcctgcatgatgttgcgagcgtgatacccgatctgtgcacaggaagctgcgggagcttggaggaaaagagaaccttgctctgtgggatgagaatgcaggtcaaggtcaggggagagttcagagaggcacttgccaacctgaaggtgtggagatgctgccgtgcatgggcaggaaggggagtggtggggcagagaagtcagggtgtggggtgggggcatggttccaggaagcttcctattttgtcttgtcagcagtagataggaactggattgaatcgggattatgctcacttctattgttagctctgatcatttgttgtttgacttcctgctttcccactagagatacgagtacatggcaagagatttctgaattcccacaccacaggtgtggccatggtgcacaacattgcaaggtccagggtcagtcgtcattttgctggtaaggaaggcataaactaacagcccagtagacaaatagcagtgtcccttcatgcggttgttactttgtgagagtaaagacatacaccaattggtttaatgtattcgggtagattttctactagtcgtgtccgtttaaaaaaatcaccagtcagttctctttatcggaaaaggtattagacacctgtagttgagcatgtgctgagatctggtgttttgttaattgcagtatttgatgatactggcaaaagtcactaagagaatcctcaaaacatcttgttagaaatgggaagaatattccttgactggcaaattttttttctgttcttaaaattaagcttataaatggctggaaaaattagttattttttccaggctttagttgggaagagatttttgtgtctggtgggaacgttccctctctccgttgatgcttgagaaagctacaagacgctgatggtgttggtggcagctttgccttatcggctgtcctggatgtcttggcctcagataagacacttaacccacagtgggagcatgctgctgcttttcaactgggaaacgttaccgtctgtttccatcacagtggcccatgacgaagttgaaagatgcctctgacatttgttatattataaaaatgccaagaatctcctaaagtttgactcataggtcagtttgctttcttaaaacaaaatggcaaccaatgaaagttttctggtgagtgttatcctccgaaattttaagtggatttaaataaagttcagtccgtggatgagaggattctcagtgaaattttcagtgtgcagaattactcgaggccattgagcagagtcattgctttctgtaatgttttcccataagaacacaagaatctccatcctccatcagactaatagtttttccagtccagcattttgccactgagaatggaattaagggagttgctgtgggaagaccccataacccttccagccatcacctcaaaaacgtaggagtgtgctttaaatatgtgtaactccccttaataagctattatggagcccttattcatatgattcttgaatttgtctaaattgcatttgcagcagtttttattttgggctgttaccatctggtggaacgtggcgggcagtctgaacagcagccagtcaggatttaccccatatccccaccaaaggatctcattcctttatccattcaattttcatgctgattcatttgattcactaagtagaattgataaatgcctacattgttcacctatgtgttgatttttggctctttgtaagggcattgctttaaatcatgttaccagtcagttcttattcttcctcttaatatgtaagaagtgcagcttcttcatattggttccaaaggcacaactcaccatattttctctttcattttctacaggggcaatcggagctgtagagcctctggttggtaacacccattgtagaatagtggggtgtgggcctcagagagactgagattatcgctggccccattgtttactggccatgtggtctggagtgctttgctgcatctccctgggcttggcttcctcatctgcgaggtgggggtaataggtggcttctcataaaattggactcactcagactccctcagttgcaagtgatagcccaatttcagtggacttctgtgaaaggtgcagctgacctcaggtggtgctcgattccagggggtgctggggaggagctgtctctttcttcatctctcagcaggggttgtctctgtttggctttctcctaggatgtggtggcgaaatagccactggcagccctggatttatatcttaccagtgtggcaacccagccaaaagagacagcatttttctaatagaaaaattagagaaatcccatggaggtatctaagtgcttggcatggggcacagtctgttctttcctgttgcggccaagggaggagagttttctggccctgcagtggccagaagatggagtcacttttacccaaaccacatggggaaaggattccccacagaaacggaggttctcaccaggggaagtggagggaggcatttacaacagtgtgagattacaacagtggccgccctggagatgtgagggctgtgaggcaatgcaggcagagctcctcaggcagaattctgtcatgcagaattcccagtagatggaatccagcctcttttttccttccctttactgcttaaggaatgcagcttctttagattgcttctaaaggcacttccttcaaacattaagttgattctacctttaatacttttataaacttttaattctatgtcctctcaacctggatgtgttttggaaagatttattttaagaggggggttggtatggcagggggaaatttcacttaatctgctttttgtcattcagtcaaaaattacgtatggagcctctgctgcatacagaacaccccaaagtctgtgggggatggaaaggaaccatgagaagcccctttcctggggtgtctgtggcccgttggaatgtgtggtgggtcaagtgtgtagattctgtggtataaggtggaatatgggcaagtgctgttagggaggtgggaagctggagggagcccagagtggagcagagccccatccagctgggacaatacaggaggactagatggagggggtggtatctgagccaggcctgaggaggggtgtggttttataggcatagctgttgggggcagagtggggtggaaggaggagtggcccagcagaggtgagggagagggagctgacagcttcattcttgatgctcactttatgccaggctctgggcatttggacaagtaacagttcattgctctattcaaggaagaaccccatcaagtcatgggtgcccagccgaaagtctttaaggggtcgagtgagggcgtggaggaggcagccttcatctttcctgaaaggcacagagatgggatggtgaggatgaatctgtgaaatgatgatgattcctgggtttctggaggcggaggtctacaaggagggtggtgcaatggagccaggtggtggaagaccttgaatgccagagtaaggagtttggtggagattgttgaggcactagttcttcagggaaggcctcatgggtgtgtgttctgtgcagttgcccagggccccatgctcagcttaatgctatggtattgtcttcttgaaattcttaatacttttgaaacaaggggtcctgcattttcattttgcactggacttgcaaatcaaagcatgcttgggggatgatgtactttagaacagagctgtgctttagagaagaggttgggccatagttgggaggctgtttgcatccttttgaggaagggggagtaaagggcccagacgaggatgggtatgctggggatggagggaattcctctgacagcctgtggccaggcccgagcagcaggcggaggaggagccgccatcagctcttgactgggggacattcttggagctgtcctctaagtcaggcctgcaggtgacttccagggatagcgttggtgttccaaacggcaattgagaagactgtcttaatatttttactctcaacagtaagctaaagctgacattggcagtctcattcaacgaatgtgaaataaccagaaaagacattccaaggcgttctggaatcaaacagatggacggagcaaacatgttaaaaacagtaaatcacaacttgaacttcagctaatcataattgcatttctctttccttatttaattttgaaacatcttcctaagtagttttttattttggttgcttttacttaagagaccttgttattatagggcaccccagttaaagatgcctcatatatgacatctgaaccaaaaaaccttatcatttaggacatgatatcctttctgaggtttgagaagtggctattttgtctcttacaaagatttgtagggaatttactgagggaattgttgagggactagtgagcaattcttgttcacatagaaatgaacaaaactgcatttacccagtgattttcaaaaacatactcccagtaaatcaaggttgctctgaactgaacttagggtctcaaccagctgcagaccagttacatcttagcaagcagggctttgagtggtgcagtgggcagagtgtgtggctctgacctatcaggtgtgatcccctcctactgtgcactgtttcctgtctggcacagacacaggcaaagcacttttgctgaaaggacagaaagactcaaggtgaaggcagtgccatgcaggccccggatgctgtgctgagtgtcttggaactgaggaagccgctgatggccagtggggccagggcagggcttgcgaaaagattcaaggcttcattccagtcacatggacagactggtactgcttttcacattcttatcaaaaagggctgcaggcaggtacaaagaccactgcagcctttcctgtcctcatggcattgccctacaactggccacctaaaatgaccttctctgctcctgcatccttttaggaatgggtaacttggtaccattcagatgtgccatgctgaaaaaatgagagtgctttcttttgagggagttgtggaggaatacatgatgtcctatatgggaggcccataaggttagtgaggtaaaaaaaagaatcaagagtttttcttgctctgctcattcacccatagtgatggagagatttgatttcatctggatgctcgtgttccactgacagtgagtactgctcagccagtgctcgccgccaggtagttaggtgtgtcttttacaatgtttagcacagcgaatagagaaagtgcctggcagatgcttggccatctcctctgcatctcccatcgtaccaagtatcttgccttgtgcacagtaggtgcttgtctgtggggcaaatagatacatttgcagttgaagtaatcctgtttctctgcctgaagtaagagacattcaccatctgtagagtgggaattgtgacttcctctagatgcagggacagttttgtaataaagcatcctcataacctcacttggccctttttggcacaaagacctgtgaaggcggagaccatgacctattttgctcagcatttatttcccagtgcaaatactcagtatttgttgaatgaataaacaaatgggatacacctgtctttcttaaattgcagaagttcattgcttaaagtagccatgtatgtcttcatcaaagtttcttcagttctcaaaatcttctcatatatgtctgtgcatacacacactcactcaacccagcagttggcatacaatggccatttggtatttgttttgcaaaagaagttagtaagtggcagtaggtaaagaaaagggcactgactgggaggtgaaagatctggacccaagtccaggtttggccacctaagcaatctggagaccttgttaaggggctgggtatcctgtctcgcccagtcagaatcttgctgtctaaatggggctaatcactgcatatcttgaaggtggtttatccagctcacaagaaagaattgatgtgcagcgcttgtcaaagttaagccttgtacatgtgtgaggactttgttcttgtcaccgatatatgctcggatccccatgtttgatgtgtggctaatgtgtatgcaccttctccctagtccaccctgagagctgagggtgtcattttacctaaataaagaaatacattgttaatgtagaaaatttagaattcacagaaaattgtaagtaacaacaattacctgcagactgtagcccagagataaccactgttaatcttgtgggatgtttctttttgtacctctcctaggcaggtacattcacatcacacacacacaaagacacggtattacttcagtcacataaccattatttttgtatcaaatttacccaagtagataacccattccaggaaaagaaagagacttaactttgttgttctgttactttctcagggcctagtgcactatgagaccgagcaggtatttgttaaatacttaatggctttctggaacatcagggctgacaagattctgagttataatctaatgttctcagctgaagtgcaggagaatgaaggcctatggagagaagcaggcccagggtcctagggctggatgtagctgagctagaactcagaaatgtgctgttgtcttgcccacgtctactctctactaataagttaagaggcacatgcaagaaggcccatctggttggtgcttctagcagagaagctgattcatgcttaattttgaccacatctctaggtttgtggttactgctcagaatcaggatagcatctgggtatctcgaagctgctgtctccagtggaggctttggactgatctcacaaagttatgctgatttctacatcagcctacatctggggtccttctcctggttatcattgtttgtactgtatgcacagatcccacgcccttacttaataatccagccttggtggaagtatattctcctgtgtttttgttggaatataccaaccctgtattgccctgccctgcctttcgagcatcgtgaaaagaagtccttctttctcttggtggttcttgcctcatgctctcaccctccctttttgtggtgtcttactgagccagttgttcattccccagcaaacatttcatgtttacagtcctcaactaggctatactgtggaagattcagcagatgtgcaagcccagcctttcaggatctgagtcgagagagagaggggacattatatagagaaattatagctcagtttataaagtggccagtgacccaggagagcggcagagcacaggctgtggatcctgggtggcaggaggcctttgtcatggttattgggggtatagggagctgggcaggcagggatttgaaaagaggggcattagagcttgacttggaaagggggactgggatgtgaacatttggagattgcaggagaaagcattcctggcagagcaacaagtagtagatgagaagggtcacaggtggatccctaggtgggggtagctaaggattctcaggatctggttgctcaatagcagcaagttgagttctgcacctctgcaggccatgacctgggaaaacatcacctcccaagccccccactgcctttacttgtccaatgctattggtgcaagtagcctggcaagttgatacaaccagttttcctttgggacaagggacttggtgaggggatctgtggactcctaagagccttccagtggattccaggtgatttgggaacttcctaaaattgcacagatgattttgtgtacatgtgcacctttcccccacaactttcaaagatctctgttacccttgaaagtgtaggaggaagagggtcggcatgtggattaattttaaaaccatatttaaaaaactctcaaatcatgtgaagtttgtagtggaaagctccattcagtttgaaagccttcaccattctcaggcacagctcactgatctccttagtctgtgcacccctgatgggcaagattatgtctcatccctgcccagaacttggcctcagaatcttatttgtgatgtttgttcagggaataaaatagctttgatgtggatataaatttgcatgtgtgctgacttgcaatagagtggattttttttttaattgctacctctaggatcctaaggctgactttatgtggaggagacatttccaatgtccgtcttcctgcctggtccctacctgaccctccttattaagcacagggataagccttggcatgtcctgccagcaagctgagggctggggctgtctggcctgtacttgccaaatgtagtctgagctgtcttctctctaaaggactcttcagccccatgacccccaagtatagagccagacccaaatgtgcctcttcacatgttccaaggtgggcatgcttgggaacctcatccagcccctccttgacctgaggggtctgcagcagcagcccatgctcatcttaggcagtataaggactcctgtggctgcagaaccacgaggtgggactctcctcaggggctgcttcttggtgaatctgcactctatttataatcaaaagctctgccagatggacgtgaggtgcccagcagagggtaggaacactggcagctgccttggcattttgttaagtaggtatgcaagttgctggcccatcagagagctgtaaggtgctggaatgacagagccatttgttttcccttgtgacatggtctgttttataacgtggtgggtgagatcaagggagaagagtgggccccttcatagtttttcaaagtccttttttccttttttagaaaagttcaaagaggacattgactttctacagtcacaagcatcagcctgtcttggagagacagcagctgtggcatgtagtattttaaggtgatgagccaagtcagacaagtcctgatataggtggggtctggacatcctgagtgatcattctcatctaccactcctctatctgggccattctcattcattcagtagctcatggattgtctctctatctgggccgttctctttcattcagtagctcatggattgtctgtctatctgggccattctcattcattcagtagctgatggattgtctaatatgtgctgaggagagagggaatagatgcacatggatcctaccctcagcaagctttctgaacaggaggcagtggacacaaacagctgtaattagcacaaggtagcatgaagcattgtaagaaacttggagatgtgcgctggcatggggctggggtcagaggtggttggattgatgttcctgattcctcccttctgggatgctcgtgttttatttattttatctaaaacctgcagaacctttaccacttgtttctacctttaacatcttattgcatttatagcctctctgttcatctgtctgtccatccatccctccatccattcaccatctaacatttaccatcctaagacaggatgcagaaggaaggaagactcagtgcctgctctcagggagctcacctttgattgcttccttatggtcccatttgtgttgggggttttgttccccagcttaactgtaagttccttgaaggtcaaagactgtcttcttcagtgttcttggaagttgaaaaatctgtttggtcagtggattgctgcagctgtcgtcttgggtgtatgtgcttaacaaaaggcttaagagtgtgtgtctgcagggcacaccagccttgctgtttgcagtgctgcacagatgactctattagagtcttttggttctgatttggaaatctagagtggtgggagggtgggaagggaggtggggaaaaatacaatgtctcaatagaccaagttcccaaaagtgtatctgcacttgaggctttcctgaagaatgaaaagcttaattcgtgccttttctttatgctacttgttcttttgtctttttttttttttttaaggaaaagatgtgtcaatttcagttgcctaattcatttttaatatgggtcagagctgccatattcacacgctttgtctcatcacacctaggcttctgttgaaatgcttgcttcacaaatgaagtttaattaatagaaatagggaagtgaacacagggctgatgaatctggggagacatgacttggtgcctgcccagagaggtccctgggtcagattcctcccgagcctgttgtcagaggcagattcttacttagggagccaggatactgggagtcaggctggggcattcatcaacaatgcatagcatagatttgcttcttagcagatgtggctggcctatttacagttagaagaattgtcattgttttagaaaactttttttgaccaaaaaataaaataaccaccaacaaaaaacccagactcttgagttgaggccaggtttgaatctcaaagcaggttgacctattttcattacagcattatcaaaacttgtgattctacctccctaacatgcttttcctggtgtcacatgaattgaacacctgattcaagcaggagagagagagtgaagaccttgtccttgtctggggcggccctgtttcccactgtgctgtggtctgaacctctttgagtaatgcctcccagagctcacctgctaatgactgtgctccacctggggaggggctattgggaggggctggtccacgcagacagggctgtacctttcacgaagtgctttcacatcccctgtttgaccttgacaacttcccagtaagggaggcagtgcctgcagtgttatccttggtccacaggggaggaaactgaagctcacacaggcaggcagggggaaggcctgggagagaactttcaacactggcataccacggggatttgtgagagcacctgcctggagtccctgcctccgagaacttcgacttctttccagatcttctgctctcttatttgatttaagtagatccaaatatggttcaggaacaaagcaggccccaaactgtgtataggatatgtgggtaatgggccagaaagctcactcctctggaaaatgttggaaagtgacctctcctgagcatcccagtgacatggctggatgccctgttgagatatgagagaaggggctgggggacaaacccatggcaagggcactagctgaaggaattcatgcagaggagaggagagggcttttccactgacgtttccttgcctctattctgtgtgtgtgtgtgtgtgtgtgtgtgtgtgtgtgtgtgtgtgtgcattcctccttggaagatgagagcttctggtctcaaggggccatgccctgtttctcagcagcctcctcatctactctcttggttttcctcattctcttcgaggtaacaagtcctcacctatttttttttttgtggcaccctacagtgtctgcagtgataagagcaggtatctttaaaaaatcaaagccaaattaatctactttggttttttaaagtccccatggtccacaaaaatatttacagggactggagattatctgctagtattctaaaactaacagtaacaacgattctttacatttttatagagagcttcaaacattttagactatctttacttctgttttcctgttattcctagtacctctccagattagacaagatgatattaaatatttccatcttacagatgagcaaattcagacttagagacgataaggtactagccccctggaaaacaactgcactgaacctaggtcctttatttctgaacaagacaggcatcgtgttgaacttcatgaagaagataatctaataattgaaaatacatcaaatacaaggacaaataagagacgctgggggggtaatgtgggagaaacctaaccttgtctgagggtaaaggcagtgtgtaggtgagacatggatgctgagttggcctttgctgggtgaagagagtcaggaagattgtccagggcgtgatgtgttcctggaaccgtggggccccatctcagtgggccttgcaagccaggatgagtgctttggtttgtttttaaagctgtgagaagccactaaagggttttaagcagaggactgatgtgggttttagaaagactgctgtggctattaggcagaaacatgtggggaggggcaagaacaaaactggagagccagagcaggcagctgttagagttattcagggaaatgttcgtgctgtagactctggggtgactgaagtgggaagattcgagaactattggggtgtagaagggacagcagctagggattatttggttgtggtagaggacaacaggtaatagagactcaggattttggcctggatgtaatggggccattttctgagttaggtaactttttacattacagggtcttctctgggacctgcgggggcctgttttgggcaggagggcaggagcatggactcattttgggacatgctgagtttgaaatgcttttaaagtatgttatgtggaaacttcaggcaggaatggggacaggtggttctggagctccaaagagagaagtgggctggaggtgcaaattccagattcattgccacaaagtgaataactggaatagtggacaggaattagaccaccaaattctgtgattctttcgtctttcccgtacttcttgaggggatttataaactcaagctcaaaataggaacctgagctttaagagagatatagccacgtttggagttggtttaacaaaggctgttctgcgggtcccagagaagaccctgtaatgtaaaaggagaatctggtaggtaattggaaccaacaaatatacttaatgttatatcccagtgatggtgatctcagaactcacggttggttgtacgaatgctggttcctggtctctgtagaattgcttccttatggctgcacattccatcaagtggttctgcccaaatttactcaattagatcttggtggtgcatttcacaataagaaataattctgaaatacactcataatggtttcaaattttagatgaattctttggattaagacctaggggtatttccttggttgtagagaacacacacttttatgactccttgttatgaaggcaacagactgtgtaaaagaactctggagttgttggggcaagagctatgtggtgtttctccctgaagccctcagagggttgtcctcctcggatttcaagggacccgctctgtgaggcacactggagtctcaggggcaagctctttttcactgactcactcaccagtgtttgctgagtgtgtctcatgccttctttcttgcttgcccctggaacatgcacaggactcagacccagccctgcttgtggcctggggctggtagatctcatgcaggtaatcacggctgaggatgagctctgctttgtgtgagttctggatgaagtctgggggagtttggagacgggagatgctccttctgcctgggggagtagagaaatgcttcccagaggttatggaaggaaattggatttgtggaggtgactgacagatctgtgccccttgtgtcagtgtctctagctgcgacagacacatgggtcagcaggcgacccttgttttccctgagagcagcaaaggccctggtgaggatgtgtccagcactacaggactggctagctgctttcttttttacctttcagttttcaaggtatgaatttttaaccagatactttctaaccttaaagtgatttggtactcccaaggaatcattctgaaagttaggaaatttatttgtgattcattgagttgaactatcaataactgtaacagattccgatctcctttgtggaaaaaaaaagtaactgtcttctcaagtacaagaatgagagaaagggtcttgattaccattttgtcctgttcaccttttttggagaacacctttaatttcttggccacaccgtgctcgtcttcattttgcacagcaccactgttgtaactcctaaaacttacgcatcacggcagatgtgtgattctttcattctttagatctgtagttttcccttatacagaagttagtgtcttctcttccaatgtatttaaacctttaatgaatatttcatcaaatgaacttcatgtcttgtatttcattattaatgttgtttatgagaccctatcctcattagcataacttacaaactaagaggaagaatgatattttaggacagtggttggtgagagaatagttgcgcatccttctacacgtgtcaaatgtgggcctttagcgagcctgcaggaaaagctgggatgctgagtatgtgtctcgcctggggtgacagatggggtgttcatgttctgtgagctctcagccgtcccgagtgtgtggctgtccctgcagcatttggacgaactcccgccaagaggaagcctgggcatgggggtgctgtgaggcaggactgagtgtatgaatcaaggtcggccttgtcctagctgggtgacataagccaaaccccttgccgactcttcagggtcattttgatcttcccgccacccagatgtcccctggttcactgatgaccccgataactaatgtgtcattttcctctatgtgcttttcttttagagacaacgtctccttctgttgcccaggctggagtgcagtggtgcagtcatggcttactgcagccttgaactcctggcctcgagtgatcctcccttctcaacctcccaaagcactgggattacaggcatgtgccattgtgcctggccttgttttggcaaaaccatatggatgtcccatctaacactccagcctctcatttcaagggcccttttcccctttggccatccacttccacttgcataccctgggcctcatggtttgggtggctgtttcagctcctgaacctctaacttagtgtgctcctcaccagccttgcccttctctctggcctgcctgctcagcatcacccagggcctgttttccctgcagacctgggctctcctccttggccaacttagatgctagacctttcacctcacctcctcaaatccctttggtccttttcatcacttctgtgcaggacatcccagccctggatggatccagctagtggtcctggccctgcctggccatccagcctcagctcatgccactgcccctgcatccactactgttctgcttcatgagctgccttctgttgctctaaggagtcaactccttcccaccttggagcttctagaccgtgtcctctccccagatggctcctccctcacttcgtctattactttaagctccacatcatcatttgtttcctaggggagcctcctctgactgcctggttgaggtcaggcttgtcgtccagcctatacttaggattgtcacttactgtttgtgtgcttatctgttcaacacctggcccagggttgtatagggcagacctagtttcagaccttctgttccttcatgcccatgaaatgtcccagaaatcctattgccttggcatccaaatgccattgcccagactgtctcctatagtcagaaacagctcagaaagcttttatcagcatgagtgtcctagtttttggttcacaaaacaactgtggtcatcacagttctaattcctgttggttggttggagagtcagtacagagtattagctttgggccagattccttgagttaaatccttgccacttataactaggtgagcctgggcggccgggcaccctctcgtttcctcatgtagaaggtgatcatggtgcccacatcctggcattgccgagaggatcgagtgagcgggcataggtacttctctacactgagaagcactgagcacttggtgagcatccggaaacatctgctgctgttagtgtgggctgagctctgtccgctgtgggctacagaaggccctactgcctgtcctgcatttttctcttatgtatgggctttcagtaaacatgtttggattgaaatacacatttgaggaggcactggacccagacctttgagcctgtgattccaaaccctttcctcctgtgcagttgcagctcacttcccacatcactcagtcctgcctctaagcgacactacactgtcaccttccttcatcatcactgttggcgctttcacataagcaagggccccatgtatttttctcttattctctctgtctggaatactctaattctttccttgaatccaatgttctgttcacctcctcctttatatttttaattttttgttttatttatttatttagttttgagacagagtctcactctgttgccaaggctggaatgcagtggcatgaccttggctcactgtgacctccgcctcctgggttcaagtgattctcctgcttcagcctcccgagtagctgggactacaggcatgcaccaccacgccccgctaattttttgaatttttagtagagacggagttttgccatgttgcccaggctggtcttgaactcctgagctcaggcaattcgcccaccttggtgtcccaaagtgctgggattacaggggtgagccaccacacccagcccacctcctcttttaataccagcttcacaaacatccttcaggatatgtctccggactctgagcctgtgtgttgctctctgtccactcaatgctgtgtcgatttgccctagtaattggcaattataattctaagattataaactacagtatcaaaggtaagagcaatgtttcctctcccaggaactacacaaagcgtagaagaactcagtatttcctaggccttcaggaaaagcttgttgactaaaagaaataaccagttgacctggttttggtgtccgtttatttttgcgtggatatgaggtgtaccctgggatccttgttaaatctcatgttactcagcttgttttgtcaccagtgttgggcaaaactgggtgacaggctctccaccttctctgcccctttcttttctttccctgcttttccaggaacaccttgattcttctgtacgctagggtgtcatttctctcgttccttcagcagttcaatgagagttcctgagcactgcctacagtgtgacaggtgctcatctgagcgtgaggagcagcagtgaaccaaataggcagggctcctgttctggtggagctatgttctagtgggaagagaggtgataaaggaatatgtccacgacataggtggtgcttcgattctagcagggaagacttatgttgattggccaggaaagacgtctttaatgaggtgccatgtaggcagggatctgaaagaagtgaagggagcaagctgtgaggatagccagggcagaggggatgggcacccagcctggctgagagtgtgtgtgtgtgggggaaggagatgtttttaattggaatggagtaggggtgaaaggaggagctggaggcatcagaacatagaaggccttctaggaaccccctaaaagggccttggatgttactccgaattagatggagagctgtttgaaggtttttgggagcaggggacattatctgatttgtctaatgtcaccttaggtctctcatgagcttaaggaaatattaactcattcataggaggagggaagtaacttctgttttaaggagggacacttgcctaattcctctttgagtaaggcctaatctgtcagagtcgtggttggactgtgttctgaactgtagcatcccagggcctgaccctagttctgtttttttttttttagatggagttttgctcttgttgcccaggctggagtgcaatggcacaacctcagctcactgcaacctccgcctcctgggttcaagcgattctcctgcctcagcctcccaggtgcctgccaccacgcccagctaattttttgtatttttagtagagacggggttttgccatgttggcccggttggtcttgaactcctgacctcaggtgatctgtccgcctcagcctctcaaagtgctgggattacaggtgtgagccactgcgcctggccaatcctagttcttttactctcttgcttttgctcagcctgtaagtaggagtaggaagtttcaaaagttacaataattaacatattcacgcctttttcacggtctgggggagctaaagcaggtgcaggataaatgaaggaactgaaccagctaggaccaaaatcagtaatttgaaccaaacttgatagctactgttttgaaactgtcattcctacctataggtagataagggcaagagattataaaatctgatggccacgaatctaattttatgagacagtgtaatgataaaaggaatgagggaggctgataaatacagatctgtatgtcttccagttttagccagcttgtcttgtttctgagtttcttgagtttcttccctgggaattgttttaggcccaaatggtaagcaaaaggaatatggtgtaagtggaattaaataactccccccagcacctcctactttctctcctcagatgtgtgagtggtaaatactttggaagaaatacaccccaagcctggtgtgttcactctgctcccaaaggtgcttgggcagttggtggtgatgggagtgttggttgattgtagctctgtatatgagggtgtctgaggattgtaaaattatcaggaaatccctcttggtgttgaagtcatgagcaggtgcaggagaggtgaaaggaaagggcagtgggtattcttccccctcaaagtgtgggaagagcagtgctccaaggccacccaaggagctgggattttttccttctaagctggttttccctttctccccactcccaactagcacgtgggcagaaggaagtgctttatctgcctgctacagggctgggaaatgtggcccgtgtactgcctcagtgcttgggtcaccagcggagatggctgcagtcccagccagctctgcaggagcttcagtcagaaacgctgatgttaggatgcattcttcagggagctgcagcttttcttagaaggtggaaaaagagaaagaagtgagtaaggtgaagtcttagaagaaggaacaacagaaaccaagttcagtgacagcccaccaggcctggcagagtctgacaaggagtctgtgaggtagggagtgtgcacgtgtgtccgtgtgtgtaaaggctaatggaatgggagacgcccttgaacagaaaggctttcacccataagtgtgaagtctggttcgtcttagcgacaaaagttagaaaaccactttcagacaataattgtattattttacagcattcgaagcaacctgagttggtctcaaaggtggctccctcaggccttacctgaggatggggacagagttgctcaaatgctttgggattactgagactagagtcaggataagctcgatcccaggttcctcaggccatgcttttccactagccaattcagtcccttcagcaagtgtttgtcgagcacttactagatagcaggtactgctcttggcactagagatatttggtgaaaaggtcagcctggagcttccattctactcaggagacaaatgagtaaatacaggaggtgatttagagagcacctgcctcctgtaggaaagaaagggaggttatgcaacagcacctggtaagggtggtcagggaaggccatgtggggctctgggacagaattttccaggcggaaggaagatacagaggcttcaaggcagaaagaaacatcattgtggagtaatggcaggtggctgatcccactctctgcatgcagaaaagagcagcagccttcttgaagccttcttacctttctcacgttagtacaattccacacccttgtgtgtatgtggcagccactgtcataggcatcagggatcctgcttttcttccccttgaccaagatgtgaagatttgtgatcagagcatcagaaataaagtcccttgagacttgcagattgaggaaaaaatgacaggagtcacccagatatgaaaatcagatcttgaattcgtctattgatcaggcattaggcatggtgggagttcagtccgtttcagctttaatgtcctgttgttttgctattgatttctttcctcaggtttcaattggtattttttccatgttgtctatacattggtcatctattttagtgatgctaattgtttagctattaaaatggtgcattagtcccacacaactcttataaacagctgtgtagtaaggagtataatctttgtatctgtagtcccccttagggttaataattaggtttttgacagccagctcagccggcttgttttcacagtgccctgtttcccactggagaatgcaaggatgcagtcacgggaggaccaggtggacagcatttggaggatttgggtggatctaagaatattttcatttggaagaacaggatggacaccagaggccaaaccaaggagtagaggaaaacatggcacctttcccccatcccacccctggaactttcacccacagtatagggttgccttgaagctctggattaccatggagctttcaatgagtaggaggagacatccatttgtcctctgtctccagctggccccgggaactattcaacatctgggattgcttcctgcggtgccccctgacccaactcaccagagtctaccgactctagacccactgttgtcctgggcccctgcctgactcttttacccactccaggatgaccctggtttctactgacacctgcctgacctaactcggtttgtctagaatgcagttgaagttgcagcaagggagatgaggaagggtaagaattggtgaaaaaaattacaaaggtttttcatggttcctaccctcgatgagtttacagtctagtcttcatgaggacatgtgctcatttgatcataaggcattttgtgacatgtgcctggaggtgattcagacagatgggcagggcaggagggaatgctggggtgtgtatagcaaaatgtgttattaaattatggcatctgttgtcaacaaccggtttagaccttcttgatctcctggggtttcttttcagttacagaattctgtcatcattacagaaacaaggcttagccacttactgctttaaataccaaaaagagatggcgaataagattgggatccatggggctttgagaacctagtagcgtgtgtgctgtatcacagttctcttctggctgatactggagagggccatgcaatgctggggacggacagctgtactagggagtctggattcgaattctggacatccctaggctcactgtgtgaccttcatcccccctccccccactccctgtaccctttgagtgcccctgccttcttactctgcatgtgtgtgcatgtgcatgtgtacccatgagtgtgaggaaggataactccagtgttgggggagagtctgccaggagataggtgccctgagtagtggtcttctcttgggcacttaccgactgtgtcattttggaaaatggccccccccaaaagatttccacatcctaatctcttgaacctgtgagtatgttaccttacatggcaaaagggatgttgcagatgtgattaacttcagaatcttgagatggaaagattactctggatttagatgggcctacccaatccttacaagagggaggcaagagttagccggagaaggagctgcagtgatggaagcgcagaagtcaagagtgatgtaaccacgagccaaggaatgtgggcagccttagaagctggaaaaggcaaggaaacaggttcagccctagagcctccagaggagcacagtcctgctgacatcctaattttagttcagcaagacccatttctgccatctgaccttcagaactgtaagatactaagtttgtgttgttttaagctactaaattatagtaacttgttatagaagcaatgggaaacatacatcaattattcctctggatattagttgcttcagctctaaaatggggacacaaaatgttttctgcctgaaggctgagaactggaccatgtgacttttggcattccttcaagttctagatttcatgagagagaaaatcgacctgaaaatgcattaaatgtttaaaaacatagggaagaaagaaatatacaattatttaatgtctgtgtatgtcatttaattcttacaaccacctgagagagattttataattattattttcttttagtcattcaagtatttgagtgcctatatgtgccagatggtgttctaggtgttagaaataaagcagtgaacaagaccaataaaaatctcctgtctttttgaagcttatctttagggagacagatgagaaaccataagcataattgctaagtgaatcatcagctaggttggcaattgatagctgggatggaagaaaattagagcaggttgatgggagcatgttactgactaggattgcaggagctcagagggtgagcagtttgctcaagaccacagcaccaggaggtagtggagtggggatgaaacccaaaatctgttggaatccagaggcctggtctgatccttttctcaggctagtagaaggctctgcctgactttgcctatttggattcccccactttactgagggagaggagtccccactgccagctgttgttaggacaattgctatcatcctgggtttcatatttttagctcctttcccatctctctaataagtaaatgccagagggctagggctaggctgatgctgggaatgagacgaggaacacagacggcacaggtcgcttcatgagttccagaggcttgtacaggagacacatgggccggccactgtttcctgtctctctgagggagctgcaactccagcctttcatctcacaactcaagttgcttttgctgcagctgaggcctgaatgtgcatttgtaactctggggaaaagggtgttcagttatcaacaattactattaggttggtgcaaaagtaactgcagattttgccactacaagtaactgtaaaaactgcaattacttttgcgcctacctgatatttttatgttgcatggccttttcctggcagtttgatgtttatcatttcctgtcattgaggaatgtgtttttctaggacagtatgaaggctttcaggatctttagagggaagctctaaaatgtgcttctctctccattaggttggctcatcagtcagattctgatttgaaaatgaagggtgcttggcagtaagaatagtggaagtaaattttcaatattatacattaacaagtcataactaataacttttatgggttcttcccatctcagatttcagagaatatttttgggttgtgttctattgatgagggcttaaagaaatgccttgttctggctgggcatggtggctcaggcttgtaatcccagcactttaggaggcccaggagggcagatcacttgaggccaggagcttgagaccagcctaaccaacatggcacaacaccgtctctactaaaaaaaaaaaaacccaaaaattagtttgggcatggtggctcatgcctgaaatcccagctactcgggaggctgaggcaggagaatcgcttgaacccaggaggcagaggtcgtagtgaactgagattgcaccactgcactccaacctgggcaacagagtgagaatctcatctccagaaaaaaaaaaaaaaagaaaaccaaagcaaagccttgtcctgttgtgcttggtttgaaactgccattccctttagtttctgcttactgctacttctacacaaggtcaagagaaagcctggcttcagaagaattacatagtcaacccctggggctagctagctgcagaagaacttgaacttttggttaattaatggaggctgggccatagctggcaaagcgggatgtgcccatgcctgggtgttgagagactgggtcttgacatggctctgcaactgtccatgtcatcttggaagatctttctgagttgggacagctgagaaacttcatgccatttgacagttttcttgaggtcatgagcaaattaaccagtcaaggaagtaaataagtaagttttggtggaacaagtttgtatgttattggtgtgccttttttttttttaataccataggtgtgttcctgatgaaaagggtgtgaataaatggaatttaaaatagttttccaatgaacggaatctttcacatgttaatatatcagggtcttctgcagtgacagctttgcctgaatttcatttttcacattagcttaaaaatattttaaagtaaaacatgttaattttgaaacatataggaaccagataaaggcaatatgttttttataaaatggaatcatatcctatcattggacttttggctgttttcctcttttaaccactataaaccatgttgcattgagcatcttggggtagcaaaatcacagattcctgattatttctttagaataaactcttagccttgaaattgctgcattgaagcatatacaggattttttttatatgagtcgcaaagttatttgctttgcttttgctttttgaaagagataaaagcttagacatcttgacattaaaaaaaacaaaagggttaatagcccagactttaaagtcagacatacctgaatttgagtcctggctccaccataacaagctgtgagaccctgacaatttacttcccatctctaagcctcagttttctcatttataaaatgggcataatatccttaaactcactgtgagcattaattgaatgacacgatataagtaaaacaccataccgtacatgaattctctatatgggaattcttactaatttgtacctgaacctctccttattcactagaagagtgtgaaaacttagtttcctctctgctccacccacggctttctagcagtcactgtaggcccaaggaaacccaccaccgtcttggtgcactgtaaccagggttgaggtgtctgtcctaattttgaaagcctgccttcagacatttatatgttcagacaaactaatcaggctgaaatttctcatgcttatttgcagctagatgaagcaatccatttagttgctttggaattacccaagcatggaagaaattggtttctcagccttgagatattctgcagatactgaagtacagatggcaccagggccagcttggtaaaaccagaaacaaggggcctgagtttggccctttgtcagggcctctgtccttgggaactggtggttccacctgggccccaacataagcctcagcttttcatttggccagcatgtatcatgaagttacttcttatttcaccctttgggggactctcagctgctcagagcttttgtgttttctcttttcagcttcctcctcaattgatacggatgaagtatttgctgaatctgtttctctttcctgaatcagaggcccagaggcattcatatagttgctttctggtaaaaccttgctgatctggtatttgggctgtcattagactgtagtgcaaaaagacgaggtgaattttgggactccagatttcagagtgtataatatctcttgtagttaatattcacaacccatgagataggaacagacagggaaactgagataccaaaagtaatgtgcccaaagacgtgcagctagtaaatggcagaactgggatttgaattcttgctgactatggttccatttcaactattactcaataccaccttttaatctgcttattataatgtatttcataactttctatgctgtggtattgatcattcattcatcagttacacaattattgcatggaaggatacaaagagaaaaagatatggcaatgtggtccttgttcttagggaattttcataaggtattaacaggagaagcaacaagataactatagatcataatataaaaatacctcccctctttgttagatagctttaacccccctgttcgctgaaggacttggttctgaatgattgaaacagataatcctccgtgattcccgtacatgtcctctgtgcccacctcccactccagcggtgagtccattgtgtttttcctttattggcaaccctaacgtgttggggcaccctctctaactccacagtacgttgtaagtttggtgttaggagagaaatgatctcaggcctgcacagcacactctttttctgttccctgccttttaaggtcatgccctcttgtcatgaatataagaatgcctgtgcccccttcggagaccggtgccactttcaggctgtgtgcatgctcactgcccctccatcctccttgagaaccatcgatgtgcacagagggttgtactgtttctctgtacatcccatcagcatggcttactcaagctttgcttcctgtcatatgtactaaggttttcaatgtgaaaatatgaaattacattctcatactaaataggctcctttaatccacactcctctctgagaaccaatccactttaccaagatctacccctcttggggctgtgctccctggttaagaacagctggtttagtagcaagggagaaggcaggagatgatttaaaacagaccctgggattctaaaagtcctgggattttataattcctgggattctaaaattagctgggaagattttgagtagcggaaaagagcctgccaactttagccatcctggataataccattctgttttagcttgatcactaatttttctgaccccatgtagaaaacgtatgtaaatcatggtggtggtagcagcagtagtagtaacaacaataatgataataatcatggcagtagctcccctttttttattttttattttttgagacggagtctcactctgtcacccaggctagagtgcagaggcacgatctcagcttgtcttggctcactgcaacctccacctcctgggtccaagcgattcccctgcctcagcttctagagtagctgggattacaggtgcccgctaccatgtctggctagtttttgtatttttagtagggacggggtttcaccaggttggccaggctggtcttgaactcctgacctcaggtaatcggcccgcctcagcctcccaaagtgctgggattacaggcacgagccaccacacccagcctgtgttagattagtgttagagtcaccttattgatctgtcaacactaggtcttatttcttcaatctatttgtacccattaagaagcctttcctcattctcccctctcctcacccttcctggtctctgataactaccattctactctctatcttcatgagagccacttttttagctcctacatataagtgagaatgtgatatttgtcattctgtgcttggcttatttcagttaacataatgaccctggttccatccaagtggctgcaagtgacagggtttcattctttttatggcagcataatattccattgtgtatatatgccacactttcattatctcttcatccattgatgggcacttaacttgattctgtatttgactcttgtgaataatgctgcaataaacatgggaatttagatatctctttgatatattgatttcctttctgttggctgtatactcagttgtggaattgctggatcatatgatagttctatttttagttttttggggaacccccatacagttttccatagtgctgtattaatttatatgcccactaacagtgtgtgagggttcccctttctccatatccttaccagcatctgttattccctgtatttttgataaaagtcattttaactggggtgaggtggtatctcatggttttgatttgcatttctctgatgattagtgatgctgagcatttcttcatataacctgttggccgtttgtcttcttttgagaaacatctatacagatcttttgcccattttttaaattgggcttttttttccccctattgagttgtctgagctccttatatattctggttattaatcccttgtcagatggatactttgcaaatgttttctcccattctgtgcattacctattcactttgttgactgtttcctttgccgtgcagtggtgcagctttgctgagctatttctctccagcggacgaagttgtccctcttggagagtgagatgcagttgcgtcacaggatgttgtcatatgctgggcatgtggcacaggtgaggtccctagagccgtgaaggccaggagggctggttgggaagcatagacctacatagcatgaaactgtgctcttcattttggttttgcatctgcggctttctgagagacctgagctgacacatggaacagatatggttctcccttgagaaattgttccaaatattttgatgtacttcagccagtcactgaaactctttagagtgggaataatgctcatgcttgccttgaacagcagtggcacagagtgattgaaagcctgagctttgaagccagactgctggggtttgaatcgcacctcggatattaactgctttaccttgggcaagttttgtaacctctttgtgcctcggatttctcatctgtaaaatgagacataataagaaatgtaccccttggggttgttgtgagaatgaaatgactttctacctttaaagcacgtagaacagttcctgggacctagtatatatagatggtattacactgtgaaatcatttgattctctaaatcaaatgagaatgcttcataaattgcaaaataccactcagtactcttagcgacagagggagaaaaaatggaatattgtgttggaagctatagtttataatcccacttcatgtggcagcaataaaactggcaagttattgatggggagcccacaaacatgacaggctccccagaacaatgatgcctcatctgtgcatgaatacccctggggaacttcaaaatccatatcctatggttgatttccagattcactgaattagaattttgcagggatacggggtactcaggaaggttttgtttattttttacagaaagatttccaggtaatcctaatgcagctgatgtatggactggtgtttggtaacttctgacctggatgctctaacagttggttatatttaatgggatgcaggaagatttagtagagggcctgacagcaggtatctacatttacataaattttcattaggtaatgcggatggagcaacacaggcagatttgtctggaggaaattctagacatctaaagacacctaaatcctggggctgagagtatggctctatttcttattgaggtcagttttcactggctgactgattcccttaccatgaagcacaaggttgatgggtactcttaattgtgtgaaaagtgggaagtgggaatagttgcaaagggagttggaagtaggcagttttgaatcctggcttgcctgctgcatactggatggaagctgcagatggaggaaacagtgcagaagactcactgagcaggcatttggatgactggccagcagatggggagtggagctcagtagatagccattctgcactcttcaggagagaagaacaacctggggccatgtgttcaataaagagatggggctggcacattgttgaggaggagaaggaggatttcaaatggagggctttttgaagaaggcattgaacacctccccacccacccctgccctgcacttctccctgtagctcagaaaccttttaatagccatgggaccaacatctagcagctggcttggttttgctggtccttgctttaaaatggggatacatatccctgctttacagacctgctgtggagttggatgaaatggtggatatgaaagtgccttaactgtaaagtgctgtacatacttacagaagcattggctaccatgtggagatggcgtgccccttggtattagtaggaggggacagactctgaccctctaccaggggtaaagccccaaatctaaagatctagaaacattagcaccttcatttcaaggtctgatatgtaagaggatggacattcctaagatttattgtgggcagagtagcatgctcacccctgatggtgacagtatccgtagtgggttctcactgtgggctgttgcatttaggccactggttatgcctgcttcccagagctcacatgtaactccattcctttctcctctactcaagaaggtgcacttatgtgtgtatgaaacagggacattattaaaaaggtaacctgaatctacctaattaaaagcacaataaattcaataggttattcagatttccatactgtactgttagaaataaatgacattcacacactgcatagcagttgtgaaggtgagaaccgcgactgtgggtagggagatcctccagacatcagcaattcccatgtagtgtgagaccaccgtggagggctcctttgtgtgtctggcaccgtgggaagttcttagggggacaaatgaggtatcattttctggcccctcaaagtactttcatctttccaggaatgtgtaattatgtgcccaaatgagtggaaggctcctaggttctgtagttgttcagagaaagaagggactcgaactaattgaagtgattgaatgagcagcacactgaaagctagctgtcaaatctgtaattataacttctgtgcagtgcatttgacattttacagcatttctataaggataatgaattctgatgccttcagaagccagataggtaacaaaaatcagggaagcagttaggaagactacacttggatggttagtattgtggtgaaccagaatgcgtgtggcccacctttaagacatggcgatccaaaatttaaaacagaagcatagcacagcacttctgattttcaaagaacttttacgaatgtcctgtttcatgttcacagcatcctatgatgcaggtctgttctccccttccagagataagaacacttaccaagatcagtaaaggtggagatagcatgtgacctggagactgcaatgccagtgctcagagctgtgagatgctttccctagaggccctgggtcccaggaccaagcccttggggaaagaaggtatcatgctttcctgaagtgtctgccctctccccagagcttccctagttattctctgagcacagctctggggagatgggcctctggacctgtttgtttctactgttaccccgtgacttaaatgggcccaggaggcaaagactaggaaacaccaagaaggctggtgtgggaattgaagaaaaccatcaactgtgtcaacagactggacccaataataggaacaaagtgctgaaatcagctttgcagtcacatttagttggctgacctgtgatttctcaactgtctcttttttatcttttaaccatccatgtcatttttcactgaaagaaaaagagaaatgcagagatccagatggagtcccttgaacccttgagccaaagtacagaaacccctgcactgtggctggatgcccctgaaggagggaggccatgtcagttacgattaatgtgagcagcttctctcattccagaaatgtgacctctggttacagcaaatgtgacaacatgaattaccttcaattatggtgaactacgtttaactacatgattgcctccacaccttggtgggaactggctgctttgatagccttgaccatggaagaaaaagacagtagaaaagacttggaaatgacaggcacctagaatctgagtcaagggtacagtggcaggccaagggctgtgggctttctgtattatcagtaaatgtgatatgtggtttgggctttgattcccaccagtgcttgagaaagggatagttacccactttattgagctaaaatttacttaaaacatatgcctttaagtatatattttacagatggatgttttgataagtatatacactctgtaactaccaacccactcaagatgcagaacactgctatcaccataagggtcccttgtgccctatctagtcagtcctcacccccaattcctgacccaggcaaacactgatctgctttttactactatagattagattcatctttttactattacaagttatattcacgtttcataagtgaaatgatatagaatgtaatcttctgtgtgcatcacaagtttgtcctttttatggctgtatagtagtccattgtatggatataccacaatttgtttatccctgtacctgctgttggacattagagtctaaacattggaaacattgttttggctatgaaaaataaccaggttttggctattacaaataaagtggctatgaacattttatataggtgtttgtgtacacacatatatgcttttattacccttgggaaaaatagcaaagactgcagttgctgggccatattgtatgtaggtggggttttggccctcattatttttgatgctccctggtgatacacctgtgaacgtattatgttacagggcaaaagggactgactgtgcagatggaattaagcttgctgatcaactgactttaagataggaaaattaccctggaagtgggcaagcccagggttatcacatggacccttaaaatcagaaagggagggcataagccaatcagagagacatggtagaaggagaggtcagacttaaagagtgagaactcaacctgctgactttgaagacagggaaaggaggccatgagccaggcattgctgatgtcttctagaaggtgagaaggacccccagctgtgacagcaagagtggggacctgtcttatgtaactaaattctgccagcaacccgaattagtctgaaagtggattctcccccagagaataagagtccagacttatagttttagcttttgcatgtagctctatgattcattttgagataattttatataaggtatctgtgaagtaagagttgaagttcactccttaacctgaatatccagttgttctagcatcatttgttgaaaaactatgcttgttgaataactttggctcctttgtgaaataaattatgtatgtgtgtttatttcggaactttctattctttcctattggactgtatgtctcttcatacaccaatcccactatgtcttgattaatgtagctttatggtgtatctggaaatcaggtagtataagttctccagttttacattaggttctttgtatttccatataaatttaataattggcttgtcaatttctataaaaatagccctgtttagattttgattgggattacactgaatctatatctcaatgtagggagaattgacattttaatatcaagtcttctgtccatgaacatgtatatttctcataatttatttagatttgatttaatttttttcaataatgttttgtggttttcagtttcaaatgttttgcataattttctaaatgcatccctatatcatttgtttctgatgttattgtaaatggtatttatttcaattttcatttgtttattgctaggatatagaattaaaagcagcttttgtatattgactctgtatcccataaccttgtaaactcatttcttagttactttttcggtgaattcattaggattttagacatatagatcatgtcatttgtgaacaaagatagttttccttctcccgttataatcggtaagcctttaatttctttttcctgccttattacattatttgaaacctctattacgatgtggaataggagtagtgacaatggaatccttgtcttgtttgtgatcttaggggaaagcactcatttcttcaccgttaagtatgatgctagctgtgggtttgttgctgatgtcctttattaggttgaagaagtttctttctatttctatttctcaggagcttttaccatgagtagttatggaattttataacactcttttaacgtatctattagaatggtcatatggttttcttttttattccactaatatagtaaatagcattaattgatttttaaatgctaaaaccaccttgctttcttaggataaacatcacttgattgtggtgatggtgccttatccttttgatatattattgaatttaatttgctgttattttgtaagaatttttatgtctgtgtacatgagggatattggtttatagttttctttctttaaatgtctggtattgttggcttcataaaataagctgaaaagtgtgccttcttcctctgctttctaagagactttgtgtaggattagtattatcccttaaatgtttgacagaatttaccagtgaaatggagtctggagttctctttgtggaaagatttcaagttaagaattcaagttattaggccgggcgctgtggctcacgcctgtaatcccaacactttgggaggccaaggcaggcagatcatgaggtcaggagataaagaccatcctggctaacatggtgaaaccccatctctactaaaaatacaaaaaattagctgggcacggtggtgggcacctgtagtcccagctacttgggagactgaggcagaagaatggcgtgatcctgggaggcagagcttgcagtgagccgagattgcgccactgcactccagcctggatgacagagcaagactctacctcaaaaaaaaaaaaaaaaaaaaaaaacttcaagttattaaatagatataggactactcagattttctgtttctcttcatctgagctttggtagcttgtatcttggaaggaattttccaatttcatctaaggcatcaaatttattggcataaaattattcataatatttcctgattatattttcaaagtctataggtattctagtaattgtctttcttttatttctgataccagtaattcatttcctccttttctgcgatcagtctagctggaaatttctaagagtcgttgatgttgaaaaaaccacctttttcttcccttgatttttctctattgtttgcctattttcagtttcatttacttttgcgcttgccgttgttttttccttctttctactattttggatttaatttggtaatcttttctgtggtagaaggttgcacaattgattctagatcttttctaatatcggaatattggctatacatttccctctaagtactgagttacctatgctcagtttttttggtatgttgcatattatttcactcaaatgttgaaaatattttatttatcttctttgacccttggattatttagaaatgtgtttgtaaatttctacatatttgggttttgaccaacatcaaaaggtcaatcattgacttttaattccattatgatcagggaatgttctttgtattcttttaaacattttcaatgtattaatgcttgttttgtggcccagcatattgtctatcttggtagatattccatattaactggaaaatcatgtttattgggctgttaatgggtagaatgttttataaatgccaggttctataaatttaaccaagctgattgatagtgctattcttttgtatacatactgattttctttctacttgttttatcagttatgagagaggaatgttgaagttcccaactatacttgtggattgatttatcttttcagttgtgtcagtttttgcctcatatattttgaagctttgctcctggatgaattcacatttagggttgttatgtttccttgatgaactgatgactttatcattatgaaatgttcctctttctccctgttgatgttctttgttctgaaatttattttgtccaatattaaggtacacctaccttggaaagaccagttttagttgggctttattgttcactatgacaactctgtcttccagttgaagtgtttgtgtcatttatgtttgggttttaagtctaccatcttggtacttattttctattttttccatctatttgttgttccttttcccctttttctgccttcttttagtataattgaatattctttgacattccattttatttctactcttgccacataagctatatctattttatatgtgtcttctctgtatacgtgtatttaccatttatagggctcttcatttctttgcatagattcacatttccatttggtgtcattttccttccatttgaggactttgctttaacttttctgtagtgtatttctgttggcagtgaatcctctcagcttttgtttgttgaataaacttcattttactctcatttgggaagatattttcactggatatagaattttggattgacagtttttcttgcagcactttaaagatgccattctatcgtcttctggcttgcaaagtcagaactttcttttggccaggaactgtggctcatgcctgcaatcccagcactttaggaggctgaggtaggaggattgcttgaggctaggagctcaagaccagcctagcacaggcaacgtagcaagaccccatctcaacaaaaagtttaaaaaattggctggggatggtggcatgtgcctgtaataccagatgctctggaggctgaagcaggaggattgcttaagtccaggagttggaggctgcagttgagtcatgattgcaccactgcactccagcctgggcaacagagattgagaccttgtctcaaaacaaaacaaaacttttctttgattctgtgtacataatgtacacataaggtttttttcttcatttgatttcaagattttttcttgatatcagtttttgggtacttgattttagtgagaggttttctttgtttattcacctctggatttattgagcttcttggttatgtgggttatagtctttatatttattaatttttcaatcattattattttttgcttctacccctctgcccagaacttcgattacatgtattaacccagttgatcttgttcataagtcattgagtttctgttcatcattttaaaaaccaatctttaattaattttggataatgtaaatgtagccatgttcattaatcttttcttctgtagtgtctagttcaaggataagcaaatttttttctataaaagatcagatagtaaatattttatgctttgtggaccagatggtctgttacaatcacacaactctcctaatgtatcacaaacacatgcatagacaatacaccaaaaaatgagtgtgccagtaaaactttatttatgacaacaagctacggtctgggattaggtctatcggccatagtttgctgaactctggtctagtccactgttaattccatcacatgtgaatttttaattttaaacatcttcatttctagaaatttcatttgatttaaaaaaatatttgatatttcctctttcattatgcatgtttttaaaaatacttgaataaaattatgatagctgattgaaaatccttgattgctaattctattacctcctcatttctaagtctgtttctgtttagtaattttccaaaaactgcttatgggtcctattttcctttttcatgacaattctagtaatttttgattgaatgctgggtattgtaaaaattatattgtggagcatctgaattttcttcctttaaagaatgtgtaatttgttacggttgacagtcaagttacttgttgctcatagtgatcctttcaaagactgtctttaagcgttgttagggtgggtttaggatcaccttttagggtctctgcctaaaccccaagggatcaacaacatcttttgactctgatagttggaaaatcaaatgaatgctaaccctatgcgaatgctgggatctgttcagctcacagtttcagagttgctttttgcttagcctcatggagttttgtcctcacatctatgacttagtattcagcaaagactggagggtttccctcttcagatttctggattctttgccctgcagtgtctagccacctcagactccctacattccagactgtttcctcagctcagtgagacctttgtgttctgcttggcgcccccactctctgcttcacgtttcagaatgaacctccaggcagaaagctggggcagtcgtgaagctcacttggtttgagagaagggagcccatctctcaggcattacagtcttcactgtctgtcgttgaatactagaaatatttgttttatatttttccccagttttcaagttgtttaaggcaggaggataaatttggtccattttatttcatcattgccagaagtagaaggcagtcgtcacctttttaaaggtgatcatttataaacaggccgaaaaatgcagttctgtaggattaaagggaaatttcagtttgagtttttaaaagtgagacagttaataggttatgtaggtaagagggcactttgcttctgtgcaaacaccacagagtatgctgctgagttgctctgattaaccctaaatttgtgaatttaagcttataaattaaattctctataatgtatttatcaagtgccaggacagagctattatggtttttctatgctttgcattggcttctgcaaattaagtttcatttcccttttgaccacaaagaagatggccctattcaagacttcctcgttcataatgcctcagtttgttatccctccctcttccctcttcttcctgtacttcctgcttctcagtaatgatagttgttcttgtgatctagtagagtggaaagagcgtagtatctgaataagaaaccagacgttgtaattctggagccacatctgactctgtgacttgggatgagacactccagccctcagcatctgcttcatattccttatttatataattggcacggccatctgtgtgtgtgtgtgtgtgtgtatggattcaaatattttaaaaaggatgtgagaactctttggaaaccataatacatgctgtgagtgtaaggtgtttttgaggtcactgtgaatttcctcactgagactcaacctaacaatggaaatgtcttcttgtcccactaaacgctcctgcagaaatacccagcttctgcttggattgagaactgtcactttctgacacttcttccttatattgtattgatacaaggtttcgggcagtttctgctttttgtgatagctgtgctgttggatctcacacttgctctatcaatctgtatctgtaaccaggagacagaaatcacgtagtaatttgaataactaaagttcaatataagaaattattaaccatagtggaattggagtaatgaaggattggctagtaagaagtagaactctaaagaagataggaatagataataagatacagctaggtgtgctggcgcatacctgtagtgccagctactaggaggccaaggtgggagggtcacttgagcctaggagttcaagaccagcctaggcaacatagtgaagcccccaactcaaaaaaaaaaaaaaaaagagagacaagaaagtacccttagggctgagatagagcacttgaggaagacatcgtcccggggctgagatccagatcttgttgcacagagcttgactgtggttcactgaatggcatagaaattgtttttgtgtcatgaggatggtggggaagtctctctggtcctgtgctggtagaacttgctggaaacctatcctctggaatttgccagaaatccgccctctagggtgccaagggaagatgtgggagatatctcactggaggcgctccatttagaaactccccgaggtgtaggaggtggggatgctggagaaagtgctggccagtgggtgctgttgtccacaggcactgtaggagctggccctggagaaggcaggtacactgcaggagtgtgctgagtgagcacagtacaaccaggaacaaaatgctttcttcctgttaaagcgtcacactttgccagttgacaaaggaagaatatttataaggcccacattcgtttcacagaacaagcaaacagggtgtacttggaatggagaggtaatcagtgtataactggtacacctcatggctactcagcttccatacgtcccttttgtgtgaactcctgtgtgtcataacaactgtctctacctagcaagatgcagctaacttggttacaagtgaagaagttatcaccattccccaaaatgaggagacacacagtgccaagagtcaccatactccttgctggctatcttaattactcctcaaattcatcacactcctgtggaatagtctgttatctacacactaaattgtacttcagtaagttaactatgttaatttcccacaacttgtgtagaagatcaaaatgggaaggagagagaagaaaatgactaacacatttaaataagatgcaaagataacaggcaaatagaaaatatgcaaagttgctgcagccttcattttttaaattggtcaccagaccatcattgacatccgtggcttcattttttccactatctattttatgtgtcccctgctctcagccccatcacctgctgttcaggcttcttcacctggtagagggacccaaaccttccttcctcaggggttcaaatcttcagttctcctgcctggttttggttgctgtaattctctattaacctttactagaagccatggaaataataagagatgcaccagaggatcacccgggttccagacctggcctctttgcctagattgggtagaagcaacccggttgccctgtgctaatcataagcaatcacaacagacagtagattaacccaccctttcctgcctgttggtttggtgacataatgggaccaaagtgtccaggtgctcatcccgtgtttaaattcggtggaaccactgctttatagcctggtggaagaatccccatttcctcccttggggaccaagatctccaaaccagtgggcttaaagttgctgagacaggaatgaaatattctgtgcattgtttattagcgagaggagccaccctcactttcaccctttgaattctggacccacatattgtagctgtgagagaggctgcaccatatatgggtttctggtccaaagcatatgctgcattctatgaaacagaattctactcttcaggttattttgttccaactggcgctgtaacttgggtcttttggaagcctttctacttttcagttagggcagccacttctgggtgacaaggaaatgtcaaactcctccttggcagttcttttttgacactgtatcgatagcaggtttgctgcagtttctgtatttttgttacagctggcctgtcagttctcatacttacctgctttccagtatgacttgatgtgtgacatcaggtaaatcctttcctctctgtggacctttgagtctccacggaagagtgggaggtttagacttgatgatccttgggaaactttccccttctaaagcattcttgctccagtgaccctgcagggtgagggtgagctcagttgggatggtgcaggtgaagtgaattgtgaatgctaagggctgtgcacgtagcagggttgaggtatgatgtgttcttctcactatcagtggttgtgatcagcgttcgactttgaacctacctggagctgaagaaagggtaccggccccccggttcatatcatcatgtctctgtttcaggacccctagaggcagtgctcattctgtggaggtgggggaagggacaacattgtggagagaaggctagaaaaggaatgaggaagaggttgacattcccagtctgtgtcttcctgtcccctctttctctgctctccctcacagaggctcacacgcacattctgtctctctgccatccaaacagatgcagctgctctggagtcaaccagacttaacgaggagacaactcttctgctttcttccgtcttcttcctacccaccccctgacctaatgctgtgcttgcctgttacagcaggcctaggaggaaatgcactatgccttccctgtttttgttttgtgtgtgttttgagatgcagacctaaaaatattctgctgtataatcggttatccaatcagccatgcgaataatcactgtgccagagcctataggaaatgaggcaggagcctgaaactcagaagcatgccagctttgccttgcctttttttctttttttttttaaatgtgctcccttgggatctgggtttgagggttgagataggaggatatgctgggtgggtttccatggaggcaggtgcaggacactgatggtatgtctccctggtgggttgaggggaaagaatggttggtgtcacagtaggagttttgcacgtagttgaggcagtttgacttatgcctcttgaacctctattccctcctctgggccttgcttccagatgctgcctccctcccccagcacacctgcctggaatgttctctctcctcctctctgcttttccaagtcctgccgatcccctgaggtctagccctctatgttgtcagcaggaccaaccattcatagcggctgttgtctcacgatactcactgttgatagcagaagcatccagctcccatacctctgtgtagggcttgtgtttccagagtcactgtgtgctctcctctccactgtctcccccaattctctccaaagccctccgatgtcagtgggtggggtggaggtagtgaggggaggcaggaggaggtaggtagtttagtgtttaggctaagagcacaggtcttggagtgacagatttgctacttccatgtaacctctgttaaattctttaccttctaagcctcagtttcctcatctgtgaagcactgaaagtagtattttcagtttcataaaccctagggtttaggggtgttatgacaattaagtgacgcattgcctgtaaagtacttagcataatgactggctcctaggcaatgctcaacaaacatgaggtatgacattgtaattatcaccatcccactttacagctgaggaaaaggaagtgtggggagcatgggcgacttagttcacttgtacagtaattgactacccagcaaggactatgggtggtcaactaacaggattattcagggctggctctaagcccaaccaagtgctagatgctgtactggaacagtgactcaggcactcagctagggacgcagctggggaggtagatatttacatgtgagcctcaaatgtactgggggagatggaatggaggcatgtgtgcagtggaaagagccctggacttggagaccaaacagaagccctgtaaggagagtcacttgtctatcatttccacccttttgtccccagcacccaggccaagcccaggtatgttttaggtgctccatcagtctctgctgaaggaatgaagaggagccccgagccacagctctggctgggcctctgacctggggaaccttgaacagctctttgcatccaccaagtcacagggacctcctcagtacagggaggggttggacctgtagggacccgccagctcttgtggtcccacttggtagactcgacagctcctagcagctgcacagtacccagtgtgtgtctttacctcagttgtgcttttggagaagcagttggagaggtgagggcatgaagggctgggctgacgggcaccaaggtcgcccaggtgctggcagtgctgcagacagcatgtagctgtcctcagatggcccaggtctggctgggctctgcaggaacacttcagctcatgggcagcctggatttgtgctgatgcggagacttccctggcagccacagttgctgctgttgctgctgcctggtcagagttgagggctctgacaacagccaccacagctcgcggtctgtccactgctcagaaacctcacacaagaaaacttctgagactgcctctgaggccctttagatcctgagagccccacactcacactgcagcctccccaaatacagccagaacccacccgcttctggttttccatgtggaccatttattgcacctgcccctcctctaggcatagcactgcactttgggctccacccggtcctgctcagatgttgtgctccttaaggaatctctgctcgttggtcagactgactgttttcctccaagagtgcactagagtgtacttgcttctgtctggcgctttatcatctgtaaggcagggcactacagtagttgacgggctggctttgctgttgcacagactgagattgaaattctggccctgctgctccctagctgtgtgacctcgggcaagtcacttcacctctttgacctcaatatcattattggtgaaatggggttaataactcttaggtcctagggttttgtgggatgatgcacttgtacccctttgcaggcagcccttacccggcagcccccactgccaacgtctctgttgtgttcaagtctgtttcatgagccagtgtaacctccctccatgcagaaacaacgctgtaaagtattagcataacagtaggtccattgggcagaaaccacaccaataaaacgggcacaccccacagtggctctgatttccacacccttcccaaccccgcactcccaagccttgcccagggctttccatggactgagcctcagtagaaagaggttgaattagattttgaattttctcatgcctcctgtctcctggccctcagaaaattaaaatccagcattggaattagtcatggaaaaatccccattttctttcctttcattcctctgtgaagatcataggttcaggttatttctttgaattaattggctaagcctcagtgaaacatgggtaatttacctggcactgtgaggtgctggaaattataaccagtgctcctaaatggatatgcagcaaccaagcaccttcatggtgctgatgggtttgtcctcacagtgctgggagatggctaagcgggtgctgtggctattaccatccttactttagaggactgggactcaagccctcatcttgtggctctaaggtgaatgtcctttccctaacatgtctgaccttctccttcctcggcattgggaccctgggtaggagggccagtagaagatccctcagcagaacttaactggccaccagtccagagtggaaggctgctgcttgtttaaaattttaatccctttctttaagtgtgaagaatactgggcaagtgtaaaagaagggaagacatggtctcttccaaccagaaatgtataaactcgctgcagtgcctaggacacatgcgtctttattgaacaaatagttattgaatgtccgcttggtgcctggccctgtgctaagcattggtaatatggtggcaaaatagaaaagatacctcttaggcttctggccatgggcacagacagttaacaaggataatcaagttacagattgttacaagtgctatgaagaaaatttatgaaaaattaaatagcaatgtaagtaggacacactaaaataatacactaagtatcatgtatcagctctggctgcctccctctctttaaagcagagaagtccaggctctcaggggtgcgacagagccaggacaggtgtctagtgagcggcctttccatgggcagtgtgtatggaggggcctggaggtgtgggagtggccattttagaagggtgttgagattaatttctaccgttagaacccagttctcgtccatctctcttttcttcttctttgtttttgagacagggtcttactctgtccaggctggagtgcagtggtgtgatcatagcttattgcagccttgaattcctgggctcaagtaatcctcctgcctcagcctgcccagtagctaggactacaggcacaccaacacacctggctatatattttttctgtttttgtagagatggggtctcacagtgttgcccagactggtctcaaactcttgcgctcaaaggatttcccctcttggcttcccaaagtgctgggattacaggcgtgagccatgattccccacctggtccctctgttaaagcagaactcacagaagaaagcccaaaggaacaaaatttgtactttcatgatgtgggaacatctcttccagttgagaactctctaaagcatttgcaatcatagatttgtgtaagaacttgatttgcaccctaaattttgggatgtatttattacataagcagatatacctggatttgcataacagaaaggactattttggggtgacttatgacagatctgctatgtgaaagcctccaggaacttttagcatcagttgagacctgggggaaacagagaggaaggagcgtgcaggcactgaggccagaggaagaagggatgtgcctgtcctcagtggctagccatgacactgccagaggagcactgagaagggagcaagaagagcacttcctaagtggcgagaatacccagctgcaaacaaaacctcagacacagcctgaagctctgtgtccttttgtgcagccccttccttaccccattgagtagcagcttggagaagagctttttattacagatgacacctatgaatgcaagtgagggaaaagaaccgactaagccagagctgtgaattcccagaaatcaatatggacgggactggggatgcagctccctcagcttctctctccatggcccctatttgaggctgaatctaggaggccctgtgtttttgatacagtgtctcactctttttctgaggcacttttcaaaatttctgtcccagtgctaagcctgggcgagctccacagagctaacctgtgtgtccagagccagccctggctgtttttccagcttttccttatgccaatagtaagattagggctggggacagtggtggcgagagagtcaagtgtgtgtttctcaaaagttgccttgggagaggagtgaggtgaaaggaatcaaggcaataagtgtaacataggcttaaacatacttgcatgaagaaaacaaaggacttaggtataaacaaatgtttctaagacagggcacaaaaagcaatcatcataaaagtctgatacagtaacttcatcaaaatcaaaacttgtgttcatcaaaagatgctgttaagaaaaagtaagtaagccactaattgggagaaaatatttgcaaaacatctatctgatgaaacatttgtacgcaggacaaataaagcatccatgcaacacaataataaacaagcgagcgatttttttaaatgggcagaaaatttaacagatatttttaatagaagatataatggccaagaggctcataaaaagatgttcaacattattgttttcagaaaaatgcaagttaaaaccataggacatgctactacacacctaccaaagtgactaaaatgaaaaagctaataaaactaatgttggtgaggatgtagaacaactggagactcttaacgcatcatcggaggggctgtacaatggtccagacactttgggtaaactttttttttttttctttttttgagacagagtctcactctgtcacccaggctggagtgcagtgacacgataatctcagctcacggcaacctctatctcctgggttcaggtgaatctcctgcctcagcctcagcagtagctgggatcacaggcgtaagccaccatgcctaactaatttatgtatttttaatagagacagggtttcaccatgttggccaggctgatcttgaactcctgacctcaaatgatatgcccgttaggcagtttcttataaggcctgtgacccagcaattttattcgtaggtatttgcccaagggaaataaaaacatgtccacaaaaatatttatacacaaattattatagcaactttattcataataagaaaaataatgcggccattaaaaagaacaagatcatgccctttgcagggacatggatggagctagaggccattatccttagcaaactaacccaggaacagaaaaccaaatactgcatgttctcacttataagtgggagctaaatgatgagaacacatggacacagagggcaacaacacacactgggtccttttggaggttggagggtagggggcgggagaggatcaggaaaaacaactaatgtgtactaggcttgatacctgggtgatgaaataatctgtacaagtttacctgtaacaaatctgcactcgtacccctgaacttaaaaaaaggtagaaacagcatagatgtccgtcgggagaatggataaacaaattatgatatattcatacaatggaatgctactcagcaagaaaaaggcatgaactgtgatagagggaggtaacataattatgttcaatgaaagaagcctttttttttttttgagacggagtcttgctctgtcacccaggctgcagtgcaatggctcgatctccgctcactgcaagctctctgcctcccgggttcaagccattctcctgcctcagcctcctgcatagctggcactacaggcgctcgccaacacgtttggctaattttttgtatttttactagggacggggtttcaccgtgttaaccaggatggtctggatctgacctcgtgatcagccggtcttggccttccgaagtgctgggattacaggcgtgagccaccgcgcccggccgaaagaagccttaaaagagaaagcgcggtgtatcaaaactcactaaatgccacatctaagatttatgcatttctcaatgtgtatattttactttaaaatactcataaccaaatattaaactctagatggtgatatacatgtgtcagggtttaggggttgagtgtacagaggtctgcaccttcttttgaaatgtatctaaaaataagatagattgatggatgggttgagggatgacaaggtgtgtgataaagctaggaaaatcctagttgcacaatttaggtagtggaattgtgggtattcactgtacaattcttgtagcttctctgtgtatttgaagatgtttgtaatacaggttggaataaatatgctcaagtggaggatgcaagttgcagtagcatgaagggaagataattatgatttatcaccctttgttacacagtgctattttgtttatcttctttaaaattccattaaaacccaccacaggagcctttgcaatgtagctgatttatcaaattcagaagaatacttccagcgtctctgactcatttgatcacctggatacctttgagttaatcttccagccacagctctgattctccccttttgactgtgatcatcctgaaggtgtttccctcaatgctgagtgcttggagccgctttagaattgctttcactctctgttaatttggagaacaaagaatcaataagtagaaggagattgggaaattagtgatcggggacggtgcagagttcataaataatttaaaatatacagagttctggcttttcaacagagattttaataaaagatgaacaaggtcatcttcttccttctgatgaaagttacccatctgtagtgccatggcggatgctgtgtacaagagctgaaatggtggttcctgttaactttgagagctttggacaaaaatgccagatacatccttctagatagcaatatcaggcgagcctttgagtggggaggggaagttataaaccactgtagagaatcacagagtgaaccgaggacagagattggatcaacactccattccttttctgttttcttggaatgaagtcagagcaacattgttttcatttttgtttgcagtgaacctaatttttgaactgatctatgtagtaataagcacaggaaaggaaaagtggaagaaaggagattcagcacattagctagtgaggtcttgcgtgataacgaagacaacacaagcctgagccctcctggctagtgaggttggctctgcctgcctttgcccatcccaccaccttctcccgtgctgagcctttcccagccagacagtgttttgaggggcctttactacccctctccctgccagccccagcctagctgtaatcacccatctggaaggcgtgttttcctggcatttacctcccattatatggcacttcacttgggaagtgctccaacagaggcactctgctgtatcccaagaagccctcaatggcattaccgtaattctgtttatatgacgcacccccaaattcttgagctgtggctgtgacagaatcagtaattggaaatagaatttctgtgatagtcactgagttcccccaagtattaggcctgggagtggacttgtccaggtggtatccgtgggattgtgtaggggcaaacagcgatggataccctgttgatatactgagagatgctaagaaatccaaagcattccagtgacagcgaacattgcattgatagaatagggatgtaagaaggctgattaattgccacatttgataaagggttggagaggggatgaagggggaagaacgtgtgtgtgtgcatgcacgctaaggagtaccacgatagtttgtgtgtttcttccattgttttcagccctggataaagagggcccacctgtctccaaatccctggtagcaggcagagctcagtacagtaggctatattgggtatagggcatctatgaggcaaagaccatatctcactcacatccgggtcttgaggtcctgacattgagagtgtgccctggaaagagcaccgaaggttagtgagggcagctgcgtctgagcactggtgctgatgctggtgggatggactacagagtctgtccccactacctttggaagagctacccaattaaaactgagttggtggaggtattcccactgtgtctcccacaccttctctcgagggttcagatatgtcgcgttctgacttcccagcagcctgcatcatgcctcttgtctccagcacttccctcactgtgttcttgctctactgagtactctcagctgtgtggttgctttaggacccaagcggtgctgttccctcccctaggaagatgtgctcttctgggatttgggagcattcatgacatcgttctctgtaccaccctacaagcatccctttccctaccaggtttgtaatatagtcaacttttagggagggggacatgtgttcatttattgttttattaattattaagtgcccttgctgtgttgggaatagacaaggaatttgccgaaactataatccataaccacccagatttctattagaccttcatgttcatttacagataggacttaattttcttaatcagttaccaattgttgggtgactggttccctgttaatgtatggttgggtgagtgggccagctgggtatacagaggttcagggtattcaatgcagaaaggacctgaagatccatggaggtcatgtggtccaactttctgccttcagaggaggagtgtgtgtggggtgcacatctgagaaaatttacagactaggctggggtggggataaaggagagtcttatctgtaggtctgctgctttgggtttctttagattagcttagaagctggaaactggccaacgaaatgcacagaattgctggaattctggagaagagtttgcaccttactctgtactttctaattaaaagggggacccctcagaggtgattccgattctggactcccactggtgtagtgtggcaggttgagtttgccgccccgggcacatcccctcatggtcagagggatgaagaggagggggtgaatgtcaggttccagaaaagcctgctctaaagtcatttcctggtcatgctgatctggaaatagctgagaactgtgattgagacccaagttttgcccccaaagctagctttatatatggttgtagcagtcaggacctaccagatggaggggacctgtgggatagggataacaggtgccgtgtgcattggcacacaggagggcaagaggggagagagggaaaggctgcgaggggaaatggagagagaaaggaggctcttaggaaaatccctggaggagggaagacttctaacctgagccgaggccctgagccagttcctctgattttttttttaaagtcaaacatggataaagtcacactcaggtgtcactgtgaggggaaaggtggagaaaagtgactgtggtttcagtttcagctttagccaccatcttggcttatgatgttagatcagttcttgcctctctctgagcctcaatttacctatctatattttattagttgaggaatcctgaattgtaacatgaaatggttgtatgtttccaatctctgcttttacctgtgccttgttggatctccctctccccttcctagatgacctcttgggcagacttcccattttcagttaacgaaacgtcagtgttttcatctgatttaagactccttcttgctcctgccttgccactgtagtaagggggcgtgggctgctctccctacctctcagctctgactcctccattagtgagaaggaggcagagggataggagcaagtacctttatgcttaactgggcacaagagatgttttcttcctggttggtttttgcagcttctctagctgaaactggccaggcagcagcacccttggtctgacaggcatctacgtgcagattcctgctgaaattctgtggagacctctccacctcacaggtcccaatagggatttgtggctctggttcagccactctgatccctgctgcacagcctctggttgctagagtaaccttgcatggtggccagttcccctgggtgagatcccagagagagctcaagcctagccaccctgtggggcccacttaacttgcaggaagctcatgggtctctgccaggtcaaaaggtagcatggcgactgtcctagcacaggcgagcggagcagcggttcaggactgtagccaaagctgagagttccctggggtctgaggtgctagtttatccatcttgcaaacgtgattgtcttgatgattctcttaagtccccgtttcttagatctaggaaggggacctccctctagctgttatcctcttccacaaggctgccaacatgctgatgctgtgttccctctcaagcctcactagcctgtggctgtggatgggtggggggtgggggatggtggaaaagggatggttgattataaagggctggcttagtgagccctgggctggggagatgtctagttccatctgttggtttcttagaaaatgaggtattcaggccgggtgtggtgactcatgtctgtaatcccagcactttgggaggccgaggtgggcagatcacctgaggtcaggagttcgagaccagcctggccaacatggtgaaaccccatctctactaaaaatacaaaaattagcccagtgtggtggtaggcatctgtaatcccagctactcaggaggcagaggctgaggtaggagaatcgcttgaacctgggaggcggaggttgtggtggccctgagatcacaccattgcattccagcctgggtgacagagcgagactccatctcaaaaaaaataaataaataaaataaaataaaatgaggtattcagttcttgttttcagcagggagccctgtcttctctaatacctgggtaacaggaagcagtcacccaactctcctttatgtacagaatgaagaattttatcataacccacactactataccttagatacacacataagcacaagtgtcagatgcagaccctgtgccttttatttgtgttgtctttctgtgcttttgctgttctctctgtggttatttgtcaaagtatgagggtaacttcttgtggaaggacagatgttaagtattctttaaggccattgtaagctccccatcttccaaaccttagagagtcaacacacactgttctgagtctgctgtgtgcttacatcagtgctgacagaccaaattatagtactccctaacccaattctaaaggatgaatgccatggcacttaaagtattttgcagaaactattattttaacttattttcacagtggctatgggttttttatagtcttgtaggaactttggttaaatacagagtaaaaactgaagctgctatgggaataatgagggatcaggtccttcaaggtcttaaaaaaaatctctaagtagcagtttcttttgtgcctgcaattctgaattgcagtgtgtccctccagacaaagctgagcgccatatgtgactgtgcctgtttgtgttttcgaaagcctcagcggtcactgccatttcagtgcctgcaagtcttgacaggaagcagtggtaaaagactgtcagaacctgtttgtaaaaatgtttgtgtttgcaaagatttttgctagtattccatgcatatcttagctattaagcaaaaatattataccattcatcttagaagaaggaacaaggctaggtaatcactagcattctcttttctttttctggcagagaactgaaagccaagagcattctatctcatgagcactacaggtctagggcaggggtgagcaaaccttttctgtaaagaattgaatagtaaatattctaggctttgtgggccgtgtggtttctgtcacggctactcaggtctgctgccacagagcaaaagcagccttagacaagaaaacaaacgagcgtggttgtgtggcagtaaagctttatttacgaaaacctggctggtggaccagaggccataatttgccaacccctggtttagtgaaaagaacaagtttcgagttgtcaccgatggttgaatttagcccaagatggtagctttgcttgtctgattaccttcatgccaacccacattttctctggctgacactaaccaggacagaagcctaggctggtcttccattttctcttaagaaagtgatcagtttatgggattgtatgcactttacctcacccacagcagatgttcaggaactgagtatccaacataggataaaatacagaatgaaagcatcctttaacattgagatgaggttgtggtgaaggggaggagttagcagtctgtcactggggtgactttctggggagctctaatcagtcatgtgtttctgctagcagcagcatcccctcctcattcctcatgtggcatacattgcaggtcttcctggcgcagatgctttctttgctcacacacattccctcccttctttcgtttttctccccccagcacacaatgctgctgctgccacacaccatttcaccccatgctggcccacaaagaagacagaggttgatgacatagcatgcaacttcagaaagttcaccactttgagccccgatgtataaatggtagcagttggtactaactctgccagtgcgttcaaaagtcatcataaggacaatgtgatatttatttaaatacatattgcattgctgactgacagtgtatttgcagtcattatccatttctagagacaagttcatggcaagcatggtaaaaagctggacctcaggagggaactgaggacaaagtaagccctgatgactctcactggcctcctgctgcacctgtccttatatttgacctgttaggttggttactttaaaaagccagttacggggaggctcatttaaaaagacataacacctgtgaaagattattttaacgtggaatatatgactggacaattatttgccaatctgatgaagtagggccacaggttttgttttcattattctgtatctactgatcagcatatccacttgcttgcacaggctacacctataatgtccacaacttccagttgcctcttatgtaacaatagaacaagaacataaagatacagaggaaagctgagagcaattctaaatgtctatggttttttctttatctcttgttgttatacatccatatctgattcaacaataaaacatgtaacattgcttatccagtacttccaatggattcagcctggtgttttggaagaaacaactctttcttttgcactcgtatctcattatttgagacagtacttaattaatttaggtagttactaatccaactgacataaacttgggaaccaaccaccaactcctgataagcaaacagctcaactcttggggaacaaaaacgtgtaagctctttagaaattaacaagtcatgagagttcagtatggcttgggcgttagtcattaccttttagccagagggaacaaagaatgccagttcaaatgacaagttggttaaaaggaaatctgacagcttctagagtgttggaaaagaggtcaagacctgagcttctaccctcaatggctcaaacaggcataccttggagatatggttggtttggttccagactaccacaataaagcaaatatttgcagtaaagtgagtcacacaaatgtttttgtttcccggtgcatatgaaagttatgtctatactatactgtagtctgttaagtgtccaatagcattatgtctaaaaaatgcacataccttaattaaaaatactttattactaaaaatgctaatgatcatctgagccttcagcaggtcataatctttttggtggtgaggggctttgccttgatgttgatggctgctgaccgatcacagtagtggttgccgaagaaggctggggtggccgtggcaatttcttaaaacaaggaagtttgccacatgatagattcttcctttcatgaaagatttctctgtagcatgggatgctgtttgaccgcattttacccacagtagaacttctctcaaaattggagtcaatcctctcaaaccctgccactgctttatcaactatgtttatgtgatattctaaaccctctgtttcatttcaacagtgttcaccaggagtagattccatatcaggaaaccactttctttgctcatccataagaagcaacccctcatttattcaagttttatcttgagattgcagcaattcagttctaccttcaatcttcacttctaatacttattctttgctatttccaccatgtctacagttgcttcctctactgaggtcttgaacccctcaaagtcatccatgagggttggaatcaacttcttccaaactcctgttaatgttgaaatgttgactttctttaatgaatcacaaatgttcttaatgacatccagaatggtgaattcctcccagaggttttcaatttactttgcccagatctgtaagaggaattgctatctatgggagctggagacttatgaaatatatttattaaatcataaggcttttcagagtcaaaattactctttgattcatgggctgcagaatggatattagcaggcatgaaaaccttcatctccttgtgcatctccatcagatcaggtgcattgttagtgagcagtaatattttgaaaggagcttttttctgagcagtaggtctcaacagtgggcttgaaatattcagtcagctgtgctataaacagatgtgctgtcactcaggctttgttttccatttatagagcatagagtagattgagcatcattcttaagggccctgggattttcagaatgataaaggagcattggcttcaacttagtcaccagctgcattagcccctaacaagagagtcagcctgtcctttgaagctttgaagccaggcattcccctctctagctagaaaaatcgtcgatgggatctccttacaatagaaggctgttttgtctacatgaaaatctgtttagtgtcaccaccttcatcagtgatcttagatcgtctggagaacttgctgcagcatcctcatcagcacttactgcttcaccttgtacttttatgttatggagatggctgcttttcttaaaacttatgaactaagccctgctagcttccaactttctctgcagcttcttcagcctttatagaatttaagagagttagggccttgctctggattagactttggcacaagagaatgggctggtttgatcttctgtccagacccttaaaacattttctgtatcagcaataagggtgtttcactttcttatcatcatttgttcattggagtaacacttctaatttccttcaagaacttttgctttgcattcacaacttggctaatggtttggtacgaaaggcctggctttcagcctgtctctgctttgaacatgcctccctcactaagcttaatcatttctagcttgtgatttaaagtgagacatatgagtcttcctttcacttgaatactgagaggctgttgtagggttattaattggtctaatttcaatgttattgcgtctcagggaatatggaagcccaaggacagagagagagagatggagaacagctggttggtggagcagtcagaacacacacatttatcaattttgttcacagtcttctatgggcgcagtttgtgatgtctccaaacaattacaatagtaacatcgaggataagtgatcatagatcaccgtaccagatacgataaaaatgaaacagtttgaaatatcacaagaattaccaaaatgtgacacagagacacaaagtgagcacttaactgctggaaaaatggtaccaatagacccgcttgttgcagcattgccacggatgttcagtttacaaaaaattgcattgtctgtgaagctcaataaagtgtgaagtacaataaaatgagatattcctgtataataataactattgtgtgcatactatgtgctgaccattgcacattatctcatgtactccttttaaccgtgctttcactgattagaaaaccaaggcaagggctgggtgtggtggctcacgcctgtgatcccaacactttgggaggctaaggtgggcagattgctttgagctcaggagttcaagaccagcctaggcaatgtggcgtaaccacatttcttaaaaaaatattagcctgtgtggtggcatgtacttacggtcccggctgctcgggaggcggaggttgtaatgagctgagattgcaccattacactccaccctggggaacagagactctgtcttaaaaaacaaaaacaaaaaggctgagttagagaagagcaaagtgcttgcccaaggttatatagcttagaccgagtggggattttgaactcagactgcttgactccatatttactgtgctctccagcttagggcaaactggtagccgggaagtcatccagctcaatttcagcttgcctcctcctgatttcctggatgtctggtttttaaaaagttaatagcaaactagtatagtgttggctccacagacgtgcttttcagaacccacctatttgccctttactggtaatcaggggtaatcctgtcccatatctgtaccctgatatgtctgggttgtaaaaagtgtaagactggatggtacagttaagctatttgttctggatttgggttttttaagtttggcatttgagcagaatcacaagttgtagaaagtagtaatttccagacatttgagatctgattcaccaacattactgtaattaaagaaaaacctatatttgtttgctccgttttgtctcactaggatgttttataaataataaacctagacatttagaaaatagcatctattcagctggttaagctttcgtggcccttcatgttcagatgtctcaaggtgatatgagtgtgcctcaatttatagggagtgactatggatggtgaactatattgacatataaaggcagctttaaaatacagactacagaaatcaagtggcttgacaattcccttagaacatatgtttatgaagtatagagctcaaatgtaatgatttcagttggttacagagtattaatgaattttgaattgaggcaattgtgatcaagcttgttgccttttctaacatgaatcattattaaaatgatgattgtcctccatagttatgaaagcattaaaaaagcatctacctatgcctgaattaacgggacagatgtggttttcagctttcacctggccaacaggacttccatggttgtgatttcaaggtgcttgtttatgtatatggttttgctggtattttctgagtcttcaataccatttcttgtaatagggtgtgaatgggtgtgtgtgtgcttgctagtatgtccccttggtccttagcattgtgggaatgtaaagtgaagctgagtaggatgtctcaatgtcctagaatcctccagcctttggtttttaagaggtacccctgtgcgagagctcgtggaggcccttctgtgtaacattcacaacacaaccaccacattcagtgacagcaggtgctgagtgcaaaccgtgtgccaggcatttcccaccatcagtatcaatcctcaattccagaaagttggtactgttgtgaccattgagaggatgaggagaccgttgcttggagactttcagtgccttgcctagggccacacgatggaaaagagcagaaccaggaattggactgctcttcaccatcctcatggctgcctggagggcaggcagtcttgggcttccttaaaagatttttgttttgggagggctcttcactgtctcaagaaagctgagggaagaattcgtctcatttagtggatgaggatacaaaaacatatgttaaaaattacagcctcgggctctgtggaccctgttcaggtgccagagggcttttctcctatattgagcacctttgccacaaagaagctagaggaggaaccctcccccgatttcaccttgtgagttacaggtgtctgacagccctgttcttagctaagaagtgtgtgtgcacctgactgcaaacagccgccatgcctgctggaggacacatgtgacacacagtttctggggaccctcctgggcctacagactgcagtctcgggtgggtacccatggcccaggacttcacattcctcacactgccctgccctgcttctcttctgtctgacctgatgccccaggcttagggtggggaggggatgctggtgggtgggttgtcattttcctgtcccagtcaggtattttgtattgtttctcaatgagccatttcccatctggatttgggggggatcagggaagatgggtgggttatgagttagtttgctgggcatcttcccttttttctctgtccagctcccaggtgtttgaggctttttcctgcctccaggtgctccaaatgtgggggctgccctttctctatctgggtttcagcctctccagctcctgcaagacagtgctgttggatctctgtagtgcctcttggtttggccactctgggatttgtgagtcatagtcttcagtttggtgctttttcctactccatcctgccttctgctattcatgccccattgcaagaacaggcattcttccttcccgtataaacttgcaacctggttccacccattctcctctcttcttctccagatagtcgtagagatcgctgcctcccaaaatagccccatttgattccttaggacaggcaggaaactcgctgcccgaccctgcctgagtctccgtttccttagctggagagactgtccttgctctagaaaccaaccaccggaaattcacctccatccctatcacttcctggggtagttctttctgaccattgggtttgcttcttgggtgtctggctctgcatacagttagaagctctttaaataccttttaacttcagggtttttgtggatgtgtatatggtggagggagagagtgtataccagtgagcatgagagcaagagttactatttatcacaactggtgtccaggggtggctaaagattatcgacttctagagttgtgtttttcaactttttttttaaatcttagtgagcagtaataaatacattgtaactctcaagcacacataaatgtcatctgaaacacgtttgaaaaatatatgcgatttatttgttttttgagatggagtcttgtgctgtcacccagggtgcagtgcagtggtgcaatctcggctcactgcaaccacggcctcctgggttcaaacaattctcctgcctcagcctcctgagtagttgggactacaggtgtgcgccaccacgcccggctaatttttttgtatttttagtagagaaggggtttcaccctgttggccaagctggtctcaaactcctgacctcaagcagtccggcctgccttggcccccacgaagtgctgggattacaggcattagccactgcgcctggccgaaaactatatactcttatattctgatatttcctgtgcaatgtgatattttccatacaattttatttcatttttcaaaaattgctggatacaaagcactgaattaatttcatatgtattttatttaaacaatcctctctcctccattacagtatacatttcatggagacaggaattccatgttattctacttcctataattgatgcttaatacctattgtcaactgattcttttctctgtgcagatcctctggagaaatattttgttctgtgccaagaaacagtttcattcaacggttaaggtgacttgtgtcactgatctgatttccttcttttacattaactatcaaaaatctcagacttattaataaagacatgtcttcacaggatacatctttacaatggtcttatttttattttattttcctcgctctttttttttcattttaccttattcttctgtcctaaatatttaaagtttcagctgattttaaagtaaaagatgctcaatgggaaaagctcacacaaatcagagctacctaaaagtagagttggaaagtcccaaggatctttttctctgaggcaagcctctttgcttctgggtgcttgccctgcagactggcttatgaagaggtcaccatcttttcagattccaggggcctgtaatgttcataccactgcagtattcgtattacacactgtaataatctggaataataagatcgtaggcactctttcttgccctcacatgtggatctgccttctccttttaaacagccatgtaacgttccctttctcacctactttgaatttttatattcttgctgctctaaggttttttttttggagcaaggaaagcaatttaaaacataaaatttactttcaaaagaagagtagagataattaaccagcccttgccacctaactcaatataatcccctagtaactcctcttggagccaccaggttccctgggagtggaattgcctgtggaaaggcctgtgtgggttctgagcttgggaaatggtgacggagccctctctctagcctctgggaggtgtcaaataatggatgagagtgaccttggactggcaagagcaggtcagtgcaagtgacatgggtttcttagatactcctcagctcagtgtgggtctcccgagactcagttctgcctgctgacttgctcattcatttccattgcagggctgcagttgggtcatgcctggttttttggcctcccaatgtctcttaattaacttaatattacttggtaatactaaagcaatgatgaattatgtgcatggagtcattaatcttctgtgtaaatatctcaaacgctgtgtcttaattatagactccatacttaaaatattttaaagcttctattcatatatttacttagaaaggtatgatccgtgtttctatggtgtcggcacactcagtgggaaaatggtgtccatacattggagacgttcgtatgaaagagtagtttctctgatgagatgagtgctgcctgttctccactgacccacagacattcttagccttagcaatgaatggagttggggtaagattgggcctggggatctgggccctctttcaccttctgactgttctgtctatagcaaaccatagagagtttttctggacagtccaggaaggtgtaagagcagctttagatgaggcagctgtctccctcatagcagagccagccctaagccagggcagggcctcctccgggaagaattgtgcacctccttcagggtcatcagtgagttaggtacattgtgagtatactaacttagtatttagcagttactctgcaccgggcaccatgctgttcctgggtggtggctggtggctggggcagggcagtgagtgttacatagactagacacagcagtaatagccaatgttccatgagaacttgccatggggtttgccacacgaagacactggctcttgtttacataggctgcctcatttgcacttaccaacaaacctgggtagcttctggtgtctgtattctcattttacagtgaagaagctgcagtgaggaggggtaaagtcacttgcccaagtctgcatagctaataagtggcagagccagaacctgagcccactgtccaaggtgaaggtgcttcctagcatggtggccacctctaggtaggagctcagctgtgccacccactgggacagatacactcccaacagctgtgattgggtagggtggctccacctcccagatgggtcctcggtttgctgagtgttggttggataacttgactaactttctcagcagtcctttgagcagctgaggtcatacttagatgtgacttacgtgagacaacagaggagtccaggtgagagctggcaggcatgggaccagggtggagttgtagttttccccaccaggtgggtggagccaggtctcttcaaaccagagggcacaattgctgtttgtattgttcacgttgactgtagcaaaaataactcagtgcctgtgaacctcatctgtgaaatgtaaataaccccttctctgcctatttgttttttgagacggagtcttgctctgttgtgtaggccagagttcaagaccagcctgaccaacatggtgaaaccctgtctctactaaaaatacaaaaattctccacctatcttactctgtagcttgggaaatcaccgagataagaggttggaaagtgataactgtccaggcatgcaagtagtatgtttataggaacatgactgagcaacagggaaatgagatttctctctctctctctttttttttttttggagatggagtctcgctctgtcaaccaggctacagtgcagtggcacaatctcggctcactgcaacttccgcctcctgggttcaagtgattctcctgtgtcagcctcctgagtagatgggactacaggtgcatgccaccatgcccagctaattttttgtatttttagtagagatggggtttcaccatgttagctaggatggcctccatctcctgacctcatgatccacccacctcagcctcccaaagtgctgggattacaggtgtgagccaccgcgcccggctgagatttcatttttaactcagacgtcaatcaacgtagccatatacagatttgaaaagcttttctttatctctgttaatggagaaaaagaatgactgctttcttgtcaaaatgaaagtgttcagttttaaacttaaccagttcctgccattttgaaatgttcactcatttcttacttttttttttttttttttttttgacacagagtctcgctctcacccaggttggagtgcagcagtgctatctcggctcactgcaacctctgcctcccgggttcaaacaattctcatgcctcagcctcccaagtagctgggattacagactcgtgccaccatactcagctaatttttgtatttttagtagagataggtttcaccgtgtttggccaggctggtcttgaactcatgatctcaggtgatccacctgcttcggcctcccaaagtgctgggtttacagccgtgagccactgtgcccagccaccatttcttactttttggcaaaggaagtagacatattggagggttgacctgaactccatagattcccagggagacagtgtatgactttgatcagcccatgtagggcacattcccattgccatccaattttacctgagccattgggatgggatgcaaaggcctgacatggtttagaaataaagcataactctgcagtgccaactaggatggggtaaatgggattctggcctgggtgacaactaagacaagattgctggcccaggtgctgagaaatgtagcccgagataatggttctgtttctccttttgtgtagagatgggatcttggaatctagtgaggtgaagtacccagctctctgctttggtactgtgaggggattctgcagaggtagatggaatatggtttttgtcctcaaggcactgacaagctgcaaatgatacgagacagtgtatcaataggttcaccttcccaacccttctctgctcttgtacttggttggtgctcaattgtttgttgatatgatttaccttcatgatgacatgtcaaaacatgtgatataatttttagctctggatggcaaacagtttcaacttggatgccaactctacccagtgggtgctgcctgaatggcaaaacatgtgacactgcctcagggtgccaggagaaagagtgccgtctgatgaccagtgggaatgtctgttatggccgggggatgggggttagaagcagcaggcatgtggtggtcattggttcatcctaagtacattaggctttcaaaaggggaaaaatgatgctcagaggaaatgaaactccttagtcttcccttaaagggtgaagcaggatttagacaaacaggagtgctttcagtcttggaaaagagcagacgtgaagaccgtaccttccagtgagtatgcagatatgtgggaggctgtgggagctgagggactggaggcacgtggaggaggaaggggcatcaggaggggcaggggcactgtcctcgctggacccatgacagacgtcagttggttgttggtaggttgagtgtagacagattgcagaggtcctcggggatgccagatggaggaatttagatgtgatgcagtcctgtgcttctcaagaagccttcccagatgctccggacacgattagctgctccatcctctccgccccaaaggagactcctagtactctgcttgagcttggattcttgtctgctgtcctgaaatgtttatatattatctgccatcctccttgaggatatgaacagtgttgtagccatctttgaatccccagtgctcaggatcatgcctggtatggagcagataaccagtgagtggtgttgaattgagctgaaatagggtccctgaactgccaggcgagatgggatggaagtgggcagtgccttagaggtgaagctgggtgcggaagtgggaggctgccaagcatagaatgtaccctctgccaagggagctcagagtccatgtccctgggatgcacgggatgggaaggaaggcaagtctgaagcgtcaagtttacaagagtgtgcacagcacaggaaaccagttgaaattgaagatggcaacagagaacggaaaagattgaaggagggaatttggaaagctgagcctagatgaattcccagaggcagtgacttatagggctcggaggccctgtgtatagggaaccaccgctgaacctgtgggtcagagggagtcatcaaagatgttgtctcttgagaaatgaggagctactgaagattctctctctcagatacctcaacattttagagacatggagtgatcctacagcccattgtattaatatttaggtgggactccttcatttgcaggtgacaaaaactgaacccaaactagcttaatttggtggcttttataactgaaaagcccaaatggggaggggaggggagagaagggaatttttgacttcaggctcaacttgatccagggatgcatacagtggcctcagggccaggtgcctgcttctgagtttcgctggctggctggctgactggcacactttctcttcattttttggcttggcttcccttggtgggtgttagctcttcatctctatgtccccctggcaactctaggcttgtggtctctcagggctgaatccagccaacaaaagaacttcttacctagttaccccagggaaagctcccagacttgctctcttcggacccggttggtgtgggttggagcttatgcctatccccgaaccaataaccttggctgcatgccaactcttattgcccctgggatgagagcaggaatggagcagttcctgggggaaggtcagggtgctgttacccttggagttttgctgggtggcaaggccatcattactgccccatccaggctaactgttgtagtcttggcagcaaagcagaagctgcctttgctctgccggtgaggaggagagctccctgccagcctctgccgccccaggcatgctgctgccctcttcccacagaccgcatgtccttgaagctgggctccgtagagtggtccaccaggtcaccctgctggccacctccatttgtcatccctgggcacattctagacagcatcttgggccagggccttgccccacctgggtgattgtggggtcactgaactgtcgtgggatctcaggagaaacctcttcagagagtctgcatccacagggagaagtgtattcacacttcccacaggctggggagctgtctcacctatccttagtcagggcgagccttccattgtgaggtgctttatagtttgcacagctctatccaacttgttacttaatctggcttttaccataacactggtgggcaaggcaaagcaagaatgattgtccctgttttatggatgaaagaactgggaatcaggaggggtaaatgtctcaaacggggcaacacagctgtcgagactagcattagacttgggggacacaaatgtcacataaaatgtgtacttttaaaccgaaggtgaagaaagatgagggcaaacagactactgtagccagtttcttcatgtaaatgtggtgttaaattacccattgttgttcctctaagtgcatacttcattaatacctgcaggggaaaaaatgacctctatttacagccaagcatctctgagccgacgcctgcctgcccaccagcctcctgtggtttacccaccaaaattttactagaggttgaatcggcttgtagaagctgtgtgatagcgctgcggctcccctgggtcacctcctgaaacgtgtagggtcgtgagtgggagggtgtctcagcaagcccagcctgaatgtgcacgatggcctcaatcgacccagccacttgaaaaagcagccgctgctctcggttcttgctgttcttgcttggtcagctcttccctggggtctctgcgccctcacagagcctccctgtgaagcctgtccttggagactttgctcaccaggtcatagacaattgttgttttccaactggaagagatcatctgatttagtctgttcatttcacacatgagaaacgaagaccaaaccccgtaccgtggcacctggggccctttgtgtctgccctccactgtgtccctgcagcctgtcccttcccttcccacctgtcctcataccttgtgcttcagccatgtggactgctcttcgccctgaacagcttgccttcgtgcaggctcctcttctggatggaacaccctgcctggagcagggagggccatgatgagggagcaggtggctgtgctgagcctttccctgacatgcactcatggatgttttcctggaacagagcaaaaccagggggcgctggtatcatagaacttcttagtgggaagggacatttaataatagttggtcaaaacctctcattttgcccatttatttattcatttataaatgcggaatatctatttttgtgacaggccttgggaatgcaatgatgcatgaaatagaaatgatctctggctttaaaggaatgataatttattaggggagacaaatattaaagaggcaatttttaaaaattgacaaatagctacataattagggtgtacaacatgatgttttgatatatgcatacactgcggaatggctaaattaaactaattaacatatctattacctcacatgcttatttttttgtggtgagaaaatttaaaatgcagtcttagcaattttcaagtatgcaatacattgttgtaactatagccactatgttgtacaatagatctcctgaacttactctttctagcttttgtatactttgaaattttttatatgttgatcaacatctccccaatcttcctgacccccacctctggtaatcatcattcttctctctgcttctgtgcgttcagtgtttttagactcctcatataagtgagatcatgcagtatttgcctttctgtgcctggcttatttagcttagcatagtgtcctctaggttcacccatgttattgcaaatgacaggatttccttctttttaaaggctaaatagtatttcattgtgtatctataccacattttctttacccattcatccattgatgaacatggaggttaattccatgtcttagctattgtgaataatgttatgaagaacatgggcgtggcagacatttctttgacatactgatttcatttcctttgtatatacattcccagaagtgggatcactgcattatatggtagttccactcttaattttttgaggaccctctgtaactgttttccatagtggcagtactaatttacactcctatcaacagtgtacaaagcttccctcttctccatatctttgccaacacttatcacttgtctttttgacaatagccattccaatgaatgtgaggtgatggctcattgtggttttaatttatatttccttgatgattagtgatgttgagcactttttcatgtatcttttggctatttgtatgtcttcttttgagaaatgtccgttcaggtcctttgcccattttaaagtcagattgttttcttgctattgagttgtttgagttccttatctatttttgatattaaccctttatcagatgaatggtttaaaaatattttctcccatttcataggttgtctctttattctggtggttttccctttgttgtgtgtaagcgttttagttagatgccatcccatatgtttattttggcttatgttgcctgtgcttacagactcatatctcaaaaatctttgccctgtctaatgtcaagaagcttttactctgtttttctgtagtactttcactgttttaggtcttaatgtttaagtctttgatccattttgagctgatttttgtatatggggtgagagaagggtctgatttcattcctctgcatgtggatgtccagttttaccgtaccccttattgaagagactgtcctttccccactctgtattcttggcacctctgtcaaagatcagttgaccataaatgcctggatttatttcttggctttctgttaaagaggtaattttttaaaatttaaatttctattgtgaattacggctgtggaaaagtataatgggctttgacagcatgtaacagcaggctctaattttgtctgggaggtcagtaaaggttttgctgagaaagtgtcatttaagctgagccttgaagggcaagcagagtgtagtctgatgagaaagagggttggggagactgttttagaaagaagggaacaggatgtggaatggttccactgtggcccagggccacagcatgaatcagtggctgagttgggactagcagaaatcagatctatggctccaagccctgtgttccttgcattcaaccccgctgggtgcgtttttggccctgtatcacagagctctatgcttattcatctaaagagggaagttcatgtccatggggcaggcacccttggtggataaagcagggacggcaaagacatggaggtgggaaggtggctggcatgtgtgggagggagcaggttggcccatgacttggagtgaagcactctgacagaggagaggtgggaaagttggaagaggaatctaggcaaggatgaaaggatgagatccttaaccaagaagctgcaggttgggatagcaggggaggccaggtgagatattgagatcagctgttgtcctagcagtttgactctttatttcaggcttgttctaaaaagggtttatggtaacttagatacatacatatgtatcctgttttttgtttttgttttttaaatacatatgctaggatcataaaacctcatgctgtaatagcctctacatgtctagatctatagctttattcctttcggtttttttcttctctgctttctagtagcacctatgagtgccttacatatgtctgatgctacagttaaagacacaaagagagggcccctttcaatagagaatccaggactgcagggcacagaaggaatggaaggtgtcagtgggagagggggacttctggcagagtataagccagaaagccttcccaaagccttggggcacatgggtggaagagcaaaacagagaagtgactcttacctggctgcatcaagcctctgttcaccttttgacagcagcttgggagctctgtgaggacagggttctggctttgctgagaaggatgcaggtgctcggggatagatggatagacagatggacaagtattcatgccacagcactaataagaggattcttaaaataggaaaggaaagtaccaagtctaatgaaggattttggcatctcccacctcctgctagttgacagtttctgtttctcaagattctgtacagcattaactggtttggagattattaactagtttagagactactgatttagagcctctcctgttggtgaaatttcactgtttaaagaagacacatcaggttttagaattagatttcagcctttgtttctctagtggcttgagttctcgtgggcggggtagggggagggagtggggggacatccgtccatatacagggtagtttctggacgttgttttctaaaggaaggtttgactggccctgcctactcaggatctcctgccagggagaagaaatccctgctggtgggtgactgagtgccacaggtgtgactctgcctggcacacagagggggatgagatgcaagaatcatttactctttccctgtacctggggaagggctgttaaggtacagctcctgctcaggccttttataccagggacgcctcatttcatgtatggttctagagggttcctgctggccccttcttctgccatcccagtctttcatccttgacagtgcttcttcctctgtgcttccatcagtcgtggccacagacctcagtgtcctctatgtgtcacctctcacctagctgttttggctgggcccacagtcccaccttgcctgttaggaacctgactttcttgttggcttccttttcaaattgttaattcaacattcttttctcaaatgaacaatccttttgtaaggcgaataattatcccacttctcctgaacgacgttttgcaagatttaaaaataatacttcatttgttgaatgtggagggatacctgtttcataggattcctttttagtggcaggattgaggaccgggatgacattggcttctagacaaactggtctgcctgctctccaggctgtgattgttcagttggcatcatggtagaatctctgtaataaagaattgcattaaaggaagtttgtatttcttatgaagaatcccatcaaataattcactaaggattttggaaagagaaaccaaattctttaaaaagcagggagagggcaaaggagaaggaaaaagaacgttaaacagttcatttatactaatggcccttgtgttattgtggcaaaatttcttctaaataaaagtcagagaggaaaaacaagctttgtttgggaggtgtactgtctgttctctgccttgtttttctgctctgaagtatagtgtgctgtcttgacgtaggtatgtaactgctatgaatattgatggcagcaaaagcttttttttttctctctggcctagtaaataaagcagcaaggataaaaagggatgaattgtaaaatcagtgtgctgtttttagcttctctggttcccttagaactcttaagtctcaaacatattgacaatctgcctttggtggtcagggtctgatgtgagcactgtgggttggcattttcagggatttttgcctctggttgaagtaacagagttcctttttctttgagctttcagagttaatgttatggcttcattgaggccttcctgtatctttccctctatccagtggcaatgctggtccctgctcctcagaataccgcagtggcctgagtgtgtgatcgttcctccagcagccacgcctcgcatgcctcccgagcaagcactcctctgggggatatggcagggaatggggcaacggggaatctggacagtaagcaaggaagggcatcctcgtagctctgagcgtggcatttcatgtagctgtatgaagggcatgggggaagaaggcatgggggcatgggatgagcctggctaagaacaggactggtctgaagtctagagggggcatgagtatagaggttggagatgagctaggctttctaaattaaattataaacacactgatgctggctaactctcaaaacacacacacacacacacacacacacacacacaattcgttcactagactgttataatggtgttctgaggagcaaagggagctttggagggcaagtgtttagaaatgacaggaaccacaacagccctgtccttggaaggaagccctgttatatgaccagtgaagagtggagaatgggggcaaagactgggatgcatggccatggctgcatggtggtcaagagggaggatacctgtggcacgacaaagggatgttctgcctggcacggccggtgacagaggggaagcgattctggcagcagacagccggagcccaggggcagcacaggcaaggcttccatttaaatgcacaagggtgttggggatactgcaagcaaacatttaataggtgacggttcctcaaagggtcaggcttatgggaatcatcctaaaatttgtgtttttaaaaatgtttctgaatataaagtgttctcttcagaaacataaaatttattttcaaatacacatttgcctattgcataaaaatatataatagtgataatatatagcaaagtgctttttttccccctggaatccgttgtgaaaaggcaggggtggcctgatgggagggctgaagatagagaatcgctcttgtcagttactacttttgtgactcttgagaaattctctgtgtgtacattcaaaacttccccctccacacacctcccccccacaccaacagactaaatgacaggtaccatagtggggacatttttctggctcctggtacagtgcctgtcatttagaagtggtgttcacgtgtttcctgagcctattttattttgacctcttgccctaggcattttaatgagtgaatttcatgacctccatttctctaaggtattggtaacttttcgggtcccactgatattagtataggactctatagttcatattggaaagttacagttgctgatgatactttgttatttaagtagcttcatgccgaggaatgcctcttgcaaagttaattacacacatctctgttggtccatgtttctattgaaactgaagctgtataaagaaaacatttgtaaaagaggaaggagtcaaagtttttagacttgctgattggtatgttttccacagctcatggagttgcatgggttggaactggaaaggttctacgagtcatttagcccgtgagcagcacctgtgaggtctgtggcagtcagatgggcatggctgctgggatggatactagaggaaaggtcagaggctctgcctaggtttcctgggaaagtgcatgatgacctgtcacaagttcagccgggagaggcggcatgccaataagcaggcagggtgtttgccatcctgaatttacttcccttattgtgtggatgcaaaaacttatatccagaggaggagaaggacttgtccaaggttaccttgctactcagtgacaaagctgactgtgacttcgaactcagacataaacccaagaggaagagagggtcaaaacagatgcatcttcattttttccagaggatgaatttcttctgttcaaagacaccattggaatctttgttgtacccttgtgcttttctgggcctgatttggcaacctcaggaggaaagcatgctgcgttttgcaaatgtgtgcaaataacaaacatgcctgttatgtcctaggcagactcatcacacgcattggggcagttggcaaaatgcagtcatgcagcctggaacgaaaagtgttgcacacgtagttgcttatgagaaattcagtgttagaatgtaaatgccttcctggcccaggggcagtgtaattgttccatttctcataatgaaactttgtttggagggaaatgcttatatgtctaaggtgttgattctaatctctgttcctttttctgtctcctcttcctcccctgcccctgcttttttggtatgtttctttgtttttcttcacaggaaaaagtagaatatgccttcctgattatttttacagtcgagacatttttgaagattatagcgtatggattattgctacatcctaatgcttatgttaggaatggatggaatttactggattttgttatagtaatagtagggtaagtctcttttactttggggaaatgttgatttggaaaatgggaggtggaggttggggggggtggtggtaacaaaacagtctttttagggaatgtggttgctcttttatgccagctgttgcaccagaacctctcaggagttcttttaaggctggtgatgctgctgtcagtctctgggcagatactagtttgaaattctctcgttgttactcccgtttttagtaacatgttatagaagggagtctgaactcctaatatgagaggctttacctaacacggtcttggatctccagaaatagaccaaccctgttggtgattagagtcaaatgagtagagcttttaatacttagtgccaatgttaagttaaaaaaagtaaaaagtaataaaaccttcatagcagtaaggtactctgctatttaacatcccttgagcaaagctattaattttcttttttttttttttttttttttgctgacttgcgggagaaactctggcatactactgttccattttaaataatgaaacaagtgtctggataatgtcacgtatctggcataaaatgaaataagctagaaaatgcagagaagcaggtgttccaccaaaatcctgttgcaggaagaagacatcagtagttttagtgaaaggagaatgttaaaataaaaaatagtggcctgtgttattttagtccttccacacctggaaatgttgccaggaagagaaaaatgaatccatgttacaggaatgctgggtctttggaccaaatacccatgtaggaagataagatatatcctttttcccagtcttagttatgctagctgtaaagtgagttgctcctcaaattatgtttctgtaaatagcctctctgttttcatcttcatgacttcagtgaactgccttttgcagttgagcaaggtgatttttcttgtggattatccttttatcatgaatcttttgccttttcattggagactaattctgctgggtattgggagagtggaattggttgtgggccttcctaggtcctttcaacctaggaagttaatatgagatcctaattgcccagtgggacaattagacttgtgggaaacaagttagcttttcaaaccgcccccgccgccaatacattgtcatttaaggcatcattgcaaaagaagtgtaccaaaatgaacaggtagcagatatgtgccgtactttcctgtatttggtggactctgtcgaggaatggcaagccgaagccttgcaggtatgttggttctgggataatctggctgtgcctcttctgccactggactttttgttcagctaggaatggagatgcttagccccatttcttgcgtcaccgtgctatgatcacctcatatttctgcctggagacatttttcacactacagcacagcacaaggacagggaaccaagtggagcatggtggtcttattgagttaaggagacagacaagagtttggggaggcagaataggggaggggagggagctatttagagaaagagcttcataaatatgccttagagtactcttcagttttggctgagggctaagctacgcctacacggagttgtgagtccatgaggccaggaaagaccactactagggaaaagagaaagatcagggagctgtaaaatgaataataaccagggctcacaaaggactggaaggcattcaaattctgactaattagggtggaaagacctcattgaacaccctggactgtcagtagagaccccacagggccactggtagtagtgctaaactggctctagagcaggggctggcaaactgtggccaatgggctaagtcctagcccatctagcctgccacctatttttataaataaagttttattgtaacatggccacactcatttgtttacatagttcagtttgagtagtttaggtctacaaaacctaaaatatttaaatatttactatttggccttttacagaaaaagtttgccaattgctgctctagagtacagagactacctgaaatccttgcttacaatgtttgaaaagaagtctgaaaagaagcaaactaggctgggcatggtggctcatgcctataatcccagcactttgggaggccgaggtgggtggatcacctgaggtcgggagttcaagaccagcatggccaacatggtgaaaccccctgtctactaaaaatgcaaatattatctgggtgtggtggcgcatgcctgtaatcccggctacatgggaggctgaggcaagagaatcgcttgaacctgggaggcaggggttgcagtgagccaaaaccatgccactgcactccaacctgggtgacagagtgagactccatttcaaaaaaaaaagcaaactgatatgctaactgaactgcctgccagaacataactcaacattctttaaaggaagacaacaaaatccagacactgaacatatgaagaaatgtgacccataaccaggaggaaactccgtcagtagaaacagatcctgaaatgacagagatgatggaattagagaaggacttcacaaagctttaaaaactgctgttataaatttatggacttaaagggatacctgattatagtaaggaaagatgggacaatataaaaaaaaacaaatggaactttaagagatgaaaaatatatccaaaatgaaaaattctctggtttggcttaacctcagcttaaacactatagaaggaaaaaatatcagggaatttgaacatatggcaataacatgaagaataatgattgaggagaaaatgaatactgcctctgtggcctgtgggggaataacaagtggtctaacatatatatatatttggagcctcagaaggagaggagagaaagaggagacagaaaaaaaattttgaagaaacagctccagattttccaaatgtgatgaaaaatgaaactcacaagaagctcagcaaagcctgagcaaaataaacatgaaaaaagccacatcaagcacatcataattgtaatcaaattgttaaaaaccaaagataaggagaaaaccttaaaacagagaaaagaaaatctcagactatttgtcaacaactatgcaagccagaagacaatagagagacatctttaaagtactggggaaaaatgtcaacctaggattctcactcagtaaaatatctttcagagttaaagtcaaaatcaaaattttttcagacattctagagtttcagaattcatgactaatagacctgtacctcaatcagtgttaaagacagttcctcagggctgaaggaaaatgacacgaggtagaaaagtggatctacacagaaagaaatgaagagtaccagaaagtggctctacacaaaaaagaatgaagagtaccagaaagggtaaatacgtgggtacatatacagatatttctcccctcgtttaaaaatttctttaaaggtaattatttaaagcaaaaataataacagtgtattgtggtgtctatagcttctatagaaataaagtacatgacaatggtagcatgaagaataggaacagggaaatagccatatggtcttgtgatgtacttatacagtagttggaatgattaaatattatctgaagatagactgtgatacctttaagatgtatattgtaaaccctagagtatggattggtgagctacaacctgtagaccaaatctagtttgagcctttttttcccccaccattgacaaagtattttatttactgcctactttggcaaataaagcttcattgtaattcagccacattcagtcatgcctatggctatttggtattataatggcaaagttgggtagttgtgacaaaccctatggcctgcagattctaaaatatttactattcggcactttatagaaaatgtttactgacacttgccttagagaagccactaaaaaagaaaatcccaggtctatctaataagcctattgtagagattaaatggaatttaaaaaaaacccctaaatccaaaacaggcaaggaagaagaaaaaaggaacaaaggacaggacaaatagaaaacaaacggcaagttgctagatttaaacctaggtaaatccttattaaaatcattatcatgaagaaaggataatggcctttctttgtgtccatgtgttctcatcatttagctcctacttataagtgagaacgtgtggtatttggttttttgttcctgcgttagtttgctaaggataatggcctccagctccatccacgtgcccacaaaagaaatgatcttgtccttttttatgactgcatagtattccttggtgtatgtgtatcacattttctttatccaatctgtattgatgggcatgtaggttgattccatgtctttgctattgtgaatagtgccacagtgaacattaacatgcatgtgtctttatggtagaatggtttatttttctctgggtgtgtacccagtaatgggatttctgggtcaagtggtagttctgttgttagctctttgaggaattgatacactgctttccacaatggatgaactagttcacactcccaccaacagtgtataagcattcccttttctctgcaacctcgtcagcatctgttattttttgactttttaagagtagccattttaactggtgtgaaatggtatctcgtggttttgatttgcacttctctaacgatcagtaatatgaactttttaaaatatgcttcttgaccacatgtatgtcttttgaatagtatctcttcatgtcctttgctgactttttaatgggatttttctttttttcttgagaagttgtttgagttccttatagatgttggatattagacctttgtctctcattctgtaggttgtctttttaccctgtttcttttgttgtgcagaagctcttaagtttaattaggcccatatgtcaggttttgcttttgttgtgattgcttttggcatcttagtcatgaaatccttgctcattcctatgtccagaatggtattgcctaggttgtcttccagggttttttatagttttgggttttacatttaagtctttaatccatcttgagttgatttttgtatatagtataagaaaagggtccagtttcaatcttgtgcatatggcttgccagttatcccagcatggtttattgaatagggagtcctttccccattgcttgtttttgtcacctttgtcgaagatcagatggtcgtaggtgtgtggccttatttctgggctctctgctatgttctgttggtctgtgtgtctgtttttgtatgagcaccatgctgttttggttactgcagccctgtattataatttgaagtcaagtagtgtgacacttccagctttgttgttttgcttaggattgccttggccatccaggctccttttttgttccatatgaattaaaaaaattttttttctagttatgtgaagaatgtcattggtggtttgataggaataacattgaatctgtaaattgctttgggcagtatggctaattaattgatattgagtcttcctatttgtgagcatggtatgtttttccatttgtttgtgtcatgtctgatttctttgagcagtgtaaaaccatgaaatttatagtagaaaatattggataaaatctttatgacctcagtgtagccagagatgtctcgggacacaaaaagctccagccatgaaacagtaattgaaaatgttgactttatcaaaatttaaaacttttcttcaaaagacagtgtgaagacaatgaaaaagcaaggcacagattgtgaaaaatattcacaatacatacacttgtattcagaatatataaagaactcttacaacccaatagtaagaagacaacccaataaacaaataggtaaaagatttgaacagatcttcacaaaagaagatatgtgaatcatcaacaaacatctgaaaagatgctcaacattgttagtaattagagaaatgcaaattaaaactacagtgacagtactgcatacccactagtattactaaatgtaaaaagactgaacataccaagtcttaaccaaaatatggaacaactggaactctcatacaccacttgtagaaatggaaaatggtataatcactttggaaaaaatgcgcccatttcttacagtgttaaacatagacttaccatatgaccatattaccagttctactcttaggtgtttatccaagaaaaatgaaaacacatgtccccaaaaaaactttattcataatagagaaaaactggaagcaacccatatatccctcaacgggcgaatggataaactcattgtgatgtatttgtgtaatgggatattacagaacaacaaaaagaaatgaactgctgataaaacaacgtggatgagtgtcagaaacattatggtgagcaaaagaagatgagccaggagaacatactatgtgattccatttatatgagttctagaaaaagaaaaaaaaaaactctaccgataaacagccaatcactggatactcaaggctgagcttcaagggaagctctgtacaaggctgtgcaaaaggggcacaagagaatcatttaaaatgttgaaaccttccctatcttgatcatggtgtttgttgcttaggcttatgcatttttcaaaacccattgtacactttaaatgagtgtgttttattatagataaattaaactgcaatataaagtgatttaaaatgcaaaaaaaaggaaactgaagtagaactggactctaagaaaaacttcagaacatcagattattttttatctaaaatatgtatgaaattggagtcaaagaacagaagaaaggttttaaaaaagaaaaggaagaattatgatgtcttcatttgaatcaaattcctactcactacagtttccaactacagtctgtatctcaatccactggatttttccattccaacagtgacctattgcttttgtcaagattcccaatagtcaagacattaagaaagtaattgatatttctaaaatgttaactgttaatgtgaccacaagaggactcagtgtgtctgccagagctgaagttattcctttagagaaaagtttgatctaagccaactcttatcccatgcctccaaatttcaataaagatatatttcaagcattcaggctctattacttaagctttttttgaagaacgtgaaggcttgtatgtgactcctcattctggtgcttctgactttagtcagtttagacagctccttgtcttttttctcccaccttggggtaaacttttaataacaatctagagtcagttactcctttctcatcctgtccttatctcttcaggcccgtggcactttttttttttttgagaggcgtggtggtgaggaacagaatcacggaatattagagtggaaaggtcattctctgagtcgttaaatccagttttgtcattttatagagaggagaactgaggcccagagaaggagagggactttcctaatatctcataactcttaggagtggaaaccagccccggccccttgcagccctgcactgtgtgggaacacagcctgcttctctctctgacttggcctctttggtggcaagagagagacatttttcatgtgttttcaaggacattgctgaagaacaaggaataaagggaccatgatgtatatgttgcaaaacatggatacttgaaagcagtcttcagtcactacctgcataaattactttgctaaccctttggggtgaaaattcctgtggcttgcacatttcagaagagtttgaggttttctttctttctttttctttgtttttctgaagctatgaatttgttttggaggagagacttttcactttagccttgctgcagggatttacagtaatcttttaaaaactatgctgaagagagagaagcctgtcataaatttgatctatttcctcagtcataactagggagagctcaccatctgaagctttgtaaaggtagagaccgggcttgttttccctcctggctgggttcgttgctaattgctgtactgttattaaaacaaagggctgatctataaatgccccagaactacacaactatacccaatcagggctgtaatcagaccacccgatgttttatggactcggtgtcttggcaatccagaggcacgccagtgggggcagtttctgctttgtctgctcattaaactttggacaccttttctttgttgctgggccagtcattcccacaatctgattggccagagttgatgctgtttgaaatgggcaaattttatacttactctgaaaaacgagcaataattccaaagagtatttgtttaaaagagcaaaagtcactgttaaatgagcagattgcctgaaaatagatttatctgaacgttctgagactaggaaaaaatttattgtggctgccaggtacaatattattcacatttcaagagagagaatgatgatattaataccttaccttaggtaactgcctttagcctttgcacagctccttagtatctgtgatttacatcctccaaatatccctatgaaggtgaaggttggggtgtgtgtgttagtgactacattgactacatataacatattaagatgtgagactttgaagtcattcattgattgattcatcagatatttttggagtacttcctatgtgtcagatactgtaataggcactagactagaacagaccacatgcacaaatgagcagaacagactaaaactccttgctgttacagaacctgtgttctagtggggtccacatgcctgtgtttacatgtgttgctgctagttgtgtgaccttgggcaagctacttattcctatcgagtttgttttctcgtgtgtaacatggtgttcataattgctgctgcataacattttgtgagaattaatgtgacaatgtatgtgcagtgcttagcacatagcaagtgctcatgaatggtagccaccaagatggctgttgtcattttagtttgcagcagttccacttgtcatcattgagttcccagggagtcccctcttctttgggaacagacttgctctctgttgctccattgcggtaaaaacagatgaggttaatccctgtcccaatcattttggagatggcgtcgtttgtattccaattccacagcccagttcttgtctttgtcttccttttatttaagcagcagccacacagaattagcccttttcaaaaataaataagattatcatcctgttttgcgtccctggggtaacagactctaacatttctttctctttctcttctttcagattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtaagcacttattgtttcctagagtcaggagtgtgctggttttttcttccaggtgggtttcagaatcactggtgctttgaggtgagttgctctgtgccagccaggggtcagcagatgaccatggcctccttcacagttgacaggacactttggcttgcactgtcacgttggatccccatgacagaatgacaggcagttattgtcattctgattttgtggacgaaagaatcttctcttgcagaaagacaaggtgaggtgttggggtgagaccttgggttcaggcctttaattccagtctatttttcctctctggcaacatgctgccatccacgcctccactcccaggcctgcccctctgaaagtggtgggtttgtggatgagggtgttggagtacttagctgcgtgcctttttttttttccccaaatggggagcatcagagggatggactcctggaaactctgattagatcctctactatcaggaactgtgctacccagctctgggggaagggatgaatgcttcttacctggtgacagggcacaggagtacctgccttgaaggctgttgtgagaactgagtgagataatggagggagagcccctaacaggatgtctggagcacagaggctctcagtgggtgagagagagagttttagccgttaggccctaccataccactcagtgccaggccccagtgtgcttctggctccaggcccccaggccaggttaaatcatacctgagttggaatagatgccctgtctgtgccctggccaacagctgcagcctcttatccttccataaggtgtttggggttgcctcactgggctctgcccctgataggactcctgtgttggggacttccatgggtagaagtcctaacacctttctgagggctggtgcgtctgagcaagaatatgggattgcagggtgtgcctgtttttcacaactcataaagccatcagaagaacacagatcacattttttgcctctccagaagttcttcatgaaatttttattaaatttgttggcacttagaatgcaccaaaaatcctctggaaaaaaaaatttccaaatttaacattttaaaatgtaggaagtggtgttttatgtgtacttgtttttccagatggttcatttattttcattgaaaaagatcagcacaagtcaaaaccacagaactgtgtggaatcaattgagaaaaacagaaataccttggaaatgactggctctgttaagtgtaacacgattaaatgagaagttcagtgagcaaacatgttcttccagatttagttgttatagcttaatctaatttcaaagtaaccacgacagctttttcccccaaagagcaaataacaggacagcctgtctatggtatgtgttgtgtgcagactttgggggctgtggctgtgtgcgtgtgtgcgtgcgagcttctggccagtgaaaaatccaagaactcacatagcattgtgtctgcttccttggctaatgaggtttttactaaactagtgcagtgctcctagatattgagaattagttttaaactgtatttcttcctttccccaacagacatcactgtttgaaatttgatagggagatttgtatgtaactctcccccaggtcagcagggaaaaatgtgagtctgagtcttgtatgaggacttttgagcttatatttttaaccacctaggtagggaacatcccagtctctcatcaaactcaaataggcttttgaagaaaaggatcagaggttgtcggatgtgctgtttctagtgctggttggcagccgtggcctgctgatttcttctctagtacttgaagttgttaaaaatgtccaggaatgtttgactgtttacacttatcttggaattgtttagtccctgctaaagagaatccagactgttctgtaagacataattttgtgtgcatgtgtgtatggaaatatatattcattcagtgaaaggtaaatttatttcacaaggtggtgaatcaggcatttgtggagttcttaagcacccacattaagagactgagggagaatgggcaggaaccgagaacccaccctggagaccaggccttctgacccctgtgttgacgtcccccattctctccacagccccgcgacctcagcactactgtgctgctcactgtttaacttcttaccttctctttccctgtccttccgtgttggacagggaaacatttatcaaagttcaagaccatcaaagtggaaaagaatcctaaagatcatctggtctacctgcatcttttagacaaggaaactgaggcctgttggaggtagtgactagtgtaagttctcacagctagtgagtagccagacagaaccagacccacgatctccacatttctgacccggtgttcttcccacttctgcctccttgactagagtcccatgagatccactgagatctaccgtacatgttgattatgtacaaaggagcggaatgcaataaagtatacatgttcacagtcggatacaactttatcatctcataaatgtgacaaatctgaaatacagtagttactctaaatgtaaaaaatattcacaaagcttactgccatggaatttagaagagctaactgctgggggttagttttgcatggcccattggtgtctcaagaaaaccaaaacaatgatagaaacctggccatggggattggaacgggtgtcgtcttttcctttccatgtgttccttgtaggaggtaaaaatattgaaaatcatcctaattgatcatttttgaaaaaaccatgtggacatttacatatccaaagatgtagcacccagagttttagttgtaatagaggttgtagcaaggcagggtcgtgctgagtctgaaatcctcttactgctcttccctcaccatcctctcccctgcctcctcctgtgctgcttatcacggtaaagatttgtcattattgctaagtcttctctttgcttgctgtattctggtttccgatgtaagcatctcagcttcttgcattctttctttcctgactatgtattgggaaagtgagatgatagcagaagatggaaagtttgaaggtggagagacaacagggaaggacagggaaggagaaggtaagaaggaaaagagtgagcagcacagtcgtgctgaggtcgtggggccatggagaggatgggggatgccaatgcaaggtcaggaggcctggtctccagggcaggttctggattcctgcccattctccctcagtctcttggttcctcacaaccaatcctaatcctgagtgctgcccccatccttcttttcatgacctctttttctgtcccttggcgggtagccttacccacactctggcactgagtatgactccatgggtagcttctattaggttggtgtgaacgtaattgcggtttttgccattgaaagtaatgggtctgagtctgaggatttcagactcagcaagaccctgtcttcctaagacctccatggcagcaaaagttttaaatgtaggaaataatcgtctctctctctctctctctcttttttttggagacgaagtcttgctctgtcacccagactggagttgcaacctccacctcccaggttcaagtgattcccccacctcagtctcccgagtagctgggactacaggcgcacaccgccacacccaactaatttttgtatttttggtagagatggggtttcatcatgttggccaggctggtctcgaactcctgacctcaagtgatccatctgcctcggcctcccaaagtgctgggattacaggcgtgagctacctcacaagggcagaagtaatcatttctcatgtgcctgtctctcaagaccacatttcagcttcaggacacgtctaccttaatgttacataataccaacatcatacttaacaaggctcaagtcagtctcaacctcccccttcccctcccacctccctcattcctggagaacctccctttggaatgcttagttttgttggggacactgggattttgcctcaagaccctggctcaaataactggtgtgctccataggtaccttcctctcattctgactcagttgctgagttctggtctcatcctgatcttcaccctcacctaccccagcattcttgaactacctctctgtgtgtctggcctgctgctgtcctgttggtctttctaaagcagctgccttttgctagtgatctaaagtttggcttcatgacctggattcaacacccacaaccctggctgcaatctacttttctttcgtgattttcttttccactaaccaccaatcaagactcaccaccctcaagcccatactgtgctactctcctctgtgcttttggtactctgttcttcttccctgaagttgcctctctcccatgcccacctgtggaaatccaccccacctggcctttgggctgtgcccagagagaagctgcctcaggaccctttcttcaccccattcatccctacttgtcacctgcatggaccttgggggactgaacaaaggatgatgaacatgggaataaagacaaagacaaaagagtatatttggaagaaggggtcagggggctccttgcttctagtgaacaagagccctgagcttcagagcctttcacattttactgggtaaaggagatagggagagaggggagttgttgtcggtcagcagcttgatttacagcagacttgcaagactgcattcttctaacaacaggctctagatgtcccagtagataacctcaatgagcacggtgccagggagtgattgccctcagcaaacctggcggtaggcacagtcgtgagtttgcccacatcctgcattcatgataaacagtttgctgtttgatcatatagcctccagtggaatgctgagttggtcacaatccctttggccttttcaactcccaacacctattaattttaactattgggatatttatatagcatctatgtgctaccccagggtagagttatttgtgtttaattctatgtctcctagaatataattttttgagggaaaacattttacataaaccgtcttcatattgctccaaagcaccaaaccttatgatttccacatggtagatgtttaagagattttgtcagatggatgaagaaatgcataaatgaatgatgaactttgacattgggcagtcccctccctaggccttagtttttccctctgtctagtgagggagtttgactagatgatccttaaggttccttttcagtctatctcacatccaggcttaatattaatgaaaagctttgaaatacctctttgaattttattactatgtgttctaagtaaaggaggcatggttaggaattatatatatgattcattggagtgccttcctggctcacaaacttatttttttttgtctttcctaggtttacaagttgtcctgaactccattataaaagccatggttcccctccttcacatagcccttttggtattatttgtaatcataatctatgctattataggattggaactttttattggaaaaatgcacaaaacatgtttttttgctgactcaggtgagtaatgagaattgtagctaacttaactttaaaatttttttgttttccccaaagcaactttcatggtttggggaaaatctaaaacaaaataggaaaaaaaatgcccaatataccagcacatttactgagccagttctcagtgtgagctatgttcagaatagatgagaattcagtctccctttccaccccgatttcctgtgtaatgtgtcctggcaaacaagataagagacctccaaagtaaaaacatgaggcaaaccaacagcattgtgctatctaagcctaaggaggatgctgtaagcgcaggtgcagaggaaaagaaccatggatgctgacaagaggaaatggcagattccgctaaggagggagcatttgaagggaaccttgaaggacaagcaggatcctgaggcaacgcagatggggcggtagggtgtcccgggctctggcaagggttctcaccttccgctggcttggatttcctgatgtttctgtcctgagcggtacagcctgtttgctctgtttgcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaagtaccctggggagagagtttatggagtgttctttgcttggataagtgggttttgtgagctagagccactggagaggtggctggaaaagaaaccctgaagtcagttatttgggaagggaagcagatgctgtctttaccagcagtcttcatcatcctgctcctcgagggccttagtttcagttgcaggaagctgctgcgcgatgttggcttctggctttagtcctctacttcccagtgctgcctgaagacctggtgccaagggtgcccagtggtcccctttggaggaactccaggaagccagggctatcctgattcaactcttaagagagccaaagggtcactttccaggtaaggaggctcctggactgccacaggctaaggttaatcatttatacatcaaggcaggttgctctactagatcctaaagggaagaaagggaatgtaaatcggatccctttcatgcttttcataactcagtataaccttaaacccagtgtgagtttctcccatgataatatttcccattctttagtattactataaatcatcccagcacaaaaccttagctgtcttcctttctatttgaagctacagacctctggcagaaagggtaggaatggcacgtagacttccagggctggtggacccatccagcctgccatgaaaacagttggacactctttcaaggcgagggtctgattcctcttgttcctgatagagccagaaagatttgctgtataaaaataagtgctatagcattttaacagccatttcccagggctgagtttgttagaatgcaaataaagctcacagaagtttagaaattgtttttcacggtataagagttgctggtaaagacagctaacatgtagattttgagcctaaatccaagtccaaaggggagtaaccaggattccaatcatgagttgttaaaaggaaattagtaataaagtagttctgaaatcagcagcttttagacagaaggcctgtaaattgataagtagcttctggtagtttctaaattttagatacttttcaggatttcctatactccataacttcaaagaatgtaacatataatggttataaataggtttttgctgcccttcagcagctcacaggattgtagatgtccctatatatttaatatgaggcaaagaagttatatttttatctttaatccccaaagtcagtctagtttgatcaggtttaagcatcaccaacatgttatatcttgtttttcctacttccctttctttttctgattgtcataggagtgtgagtgtgtgtgtgtgtgtatgcatgtgtgtgtgtgtgtgtatgcacatctgttatttatattcataaaacgtcttttcataaagaggaaggaggaaggagatgatattggctgagccaggggcatggcttctgtatgcaggagggccctcaggttaggtgaagcattcatttttgctattatttcctaaattgcaacttctagtcagattagttgagatctcaattccagtcttcccttgaagtttttcataaatagaaaaagcatcatcaaaatagcccaaactgatacttcccctccccaaacagtacataaaacaacattttgatttttttaaaaatcaaaatctgtgactcttctcagctttgtttttctctctattgacatggtgaattgtcagctgcagagccaacatgccttgactgatgaaaaattttatactttatgttatattccttcacatcgattctcagaattttcctgttgccaagcaagtgtaaaacctgggagtagatgattaaaggagagggaacttcaggctcctagaagcaaaagtttccgcttactttcctgagaaggtttaaatatcatctaggatgatataattactatttttattattaatatgacaatcacgtggttaatactttgacagtataattgcactctccataaattacacagcatctttattctggtggggatctcaagccattcataaactttatcccagtctgtatccctttatagaaggtctgggatcttgaagatggagacagtggcgtagagaccatggaacattccccgagttctacagcaaatggttgtggtccttgatctagaacagtggtctataaaccttttcataagggggcaaatagaaaatgtatttggccttgcaggctacatggtcacctcagcaactgttcagcccttccactatagctaggaagcagccatgggcaatacataagcaaatggatgtggctttattctaatcagacttcatttatggaccctggaatttgaattttgtatgatttttctgtgtcatgaaatattttgcttttgattttttcccccaccaactatttcaaattgtaaaaatcatttttagcttgaggccatataaaagcatacagcaagctagatttggtctgcaggtcatgctgtgggaccccctggcctagactagaacccagcactctttccttggcattcttccacctgtcagcagttgatgaatccttccagaacactagggggcagctaagtaatgtcttcccgactgttctctaagattttactctctgaaacacatcaggattgtttttaattacctgttgattgcatttattagctcatcatagagataggcaggggccaaggaaccaagccttcctaatatttcatgggccacagtcagctggaagccacaccgctgtgatacacagcagaacatccctgcccagcatggtgcctggcaccgagcaggcactcaataaacacaagggatggtcatcatccttcaagtgtaccaggcatattgcctcattagtgtagatgtgccatgtttgaatatctatttttatccacaactagggcataaaggggacatcttgggagataaaaagagattagattttaaatattgactacaagcacatttctgaatcctttaggcacttacatatggtggacaaagtctttgcgggtcattgttttgcatctagtcaagtttatattcagtcagcgttctcaagctcatttatgccttgcttctcactagtgtctggaaaatgtctggcagggtcttgagaagggaagtaaaggtgggtccaatatgtagaaaggcacacttagaacaggactatttggatgtgtgggaagtgggatcattaagttctggtggaaagaaacctatggtagagttctttgataaagtgagttccataaatataattgagctgttgtttgactcacatgtgagtgtttgttgctcacagaggcagtagggtgtagggcagggaaagagtgtttatttagcctggttgtgtgaccttgagtagttcatggaacctctctgggcttctcaagatgcagaaataaacttacatgatttaatttttcccttcaacttagaggaaattttttttccttcaattcaaagaaattgtttttaaatgcaggaaataaaaagtattggtttcaggagacagctatccagataaataatttcggtgtcttgtcttagcaccaagctcttttctcagtgcacactcctacggaggtgctggctgtcagaccttcacgggaagtactcatggtcaagctgacagtctccttcattcagggcacctaggaaatctctctgtaaccagccgagggcttgcctttttcttattgcatgctctggggtgttaaaaccagtataccaagtttccagaagtgttttcagcagctagaaaaacagccttgcattggtctataacttgagacatgaatatgcatttcaaccttttatttttattttttacatttttttgagacggagttttgctctgttgcccaggctggagtgcaatggcgtgatcttggctcactgcaacctctgcctccggggttcaagcgattctcgtgcctcagcctcccaagtagctgggattacaggtccttgctaccacgcccagctaatttttgtatttttagtagagacgggtttcaccatgttggccaggctggtctcgaactcccaaactcagggtgatccacctgccttggcctcccaaagtgttgggattgcaggcgtgagctgctgcacccggcccatttcagccttctaaaagaaggaaaactgaagctaaaaagaaaattatttcctgggcaccagatgacaccccttgatgactttgatataagttttttaaaaattagtctaaattgaagtccttcagtggaagccagtttcttcattgttgataaagaccatacaggcaaaatcccaagcagtctctattttcacgtgggtatttttgggaacagcttgcatgttctgatttttcttttgtatatggtaagatccaagaaatgcttggctctgaaaagggacttggattgagaagggttcaatgggagcaagaccgttctcagagccgaagcttgtctctcttgccccaccttctgacttagagatttggaatctccagtggactgtattcatctccagccttcccctccaggcctcaactgtcattccaagtgatacttctgatttgagcaaatgtgaatctgatgaacacctactcccaagaaattaaaagggttttaaattttttaaaggaaaattttccctcccaagtagagaagacagctgttactagagccattctctggaacaccagactgaggcctgaaggagggttggtgaagcagatggctcagcagatgacggttgctagggtcatggaagagtgaggtttcctgatgggagccctggacctgtctgccctcccgtcaccttgttgggcaccttctcccctgctgcatgcacctctgttccaacacagagggaaacaagcccaggtggggctctgtctcaggtgctgacccaggccaggcacaggccaccacaccaggcagccagttccttcttcatatatgggtttttcagtaagtttagtggtatagttgctctggatgaattaccctctgccttcctgctgaaattagtttatccaacttaattagatcaacaattgcagccacagcccaggctcattcattactctaattgccaatgtaagatgtgcagactgatatgagttctattaagcacatcaattttcatgtggccaaacaggtgtttcataagggatttaatgccctctccctagacttcagcaacagatgttaggtaattttttttaatgttcactttccctatttggcttctcgaggcaaacattgtgaaatgcacgagcctcattctgtaaagttaaaacctggagccagatcatatgcaggaaagcacatgcttaacaccctaagggcttgcacctgcaaggcaagagcgatggctctatccagactgtttgcagttctcattggctgaaaattctgggtgttgtggcagggtcataccttgggccatccattctgtcccctgactggttcttaacacctccttcctgggaaaggtgttttgctgaatttaacattgacctgtgctgctggaaagttccatccagctgtgatccttaaagccctgtttgctctagcttcctttggccaggtctgccagggagactgtgtctgaatgtgcagcatgagcttgtccgggaataggggaatggggttcctcaggccacaccctttcacctctaaacccagtcagctcacagctggagccagtctcccaggggggtcatctagatcaaagctaagtgtggagaataagggctgcttctcctttctgtgggtgcagctaagaaaaagcccattccccaaagagcccgtggcttgtgtcagctagttgaccttgaaaaaatttctttttcacattcattttgctgcattcattttgtttgcactcacaggttgcagataatccagatctaaggtgggtttggtttccttgggtaggttggtttccagtagaagattattttaggagtttttaaaaagagtttatagagtcagatggtacaagtttgtctctataattaagacttttccaccatcacaaactttaaacacaaagtctaaaatcttgggcagcatagaaaataggttctagctaagcaggagttttgtcctctaccaagacctttcctgaaaatcacttatcaagacagtttcctgtaagaaaaagccatatcccagctgattttccttcctggggccaaaatctgctattattcggcctgaaagccttgatgactctgtgtgtgtgtgtgtgtgtgtgtgtgtgtgtgtgtgtgtgtgtgtgtgtgtgtgtgtgtgtatggatgcttgtgtgtgtgtatggggaatatgtgattaatgtgtgttggctgctgttgtctctgatttggctactgttgtttctgatttaaatctaagtaaatgtttaattaaatgtatagaatgctgtctctaatgtgaccctctctccttattaaatcctcttattaacccactcctatgagaccatcttatttcttgcagatgaatgatgctatgggatttgaattgccctgggtgtattttgtcagtctcgtcatctttgggtcatttttcgtactaaatcttgtacttggtgtattgagcgggtaagctacacctctttcatcttgaaagcagagtcctgaggacagttgccaagaccacacaagctttgctggatgagggccgccaagaggggttgccagacattttatgtgtcctctgagatgctttcttttctgctgaggcttcccaaatcaagctgtttcctggaacctcaccaggcttcatgaaggagaactatagaacgattattgaccagaaattaatcagcattgttgcttgagatttaaacaatttccatagcatgccctttttttgtctgttctaaagtgagatacatttataattgctttatttgtctggatccaaatataatgcagattaattgttataaaacgatagcaaaatgagctggattgggtgggcttttggtagtccccatttgtagatttcagccgctgagcttgtccttatttgcagaaaaaaaaaaaaaaagggaaggacctaggcccagtccctgtcctaggagcactaaccttcagcaaagcactgagaggtttggcagctgcaactggggctctgctctttagtaaatggataactgataactgatctccttacattttacaggtaaatgatgcgataggatgggaatggccatgggtgtattttgttagtctgatcatccttggctcatttttcgtccttaacctggttcttggtgtccttagtgggtaagcagtcggatccgtgttgcaccttctcctgctgccacgtgtgaggcaactctgcgtgtctcctagctgctccctgacagcttctctgcatgtgtttggactctgatgtcctctcagtgtgttgcttttggattgaactgtgattctttctgcctgtatctgtctgtgagattccgtgtttccaatgcttgccaaacactgttaatttaatgaaaacgttcccccaaagccagttgtgttagtatgtgaacgtgtagaggtggattacaagtgagttaaaggaattccagccttggtctcccccaggaaagaggcttttgtcccttgtcattttgtgtctattagtacataactccttgtcgttttgtgtctattagtacataacctggcccctttaggtcaccacagtgcattataaatacttccaggggagttttagattttactgtgaaggagaaataagcctcaagcacataaatactggacagtttcaaaatcttccttagattgggattctttattagcttggtgttctagtgctgtcattgtgagaactgtccctgtgattcagttttaaccgaaacttacagaatccttctcttaatgcagagtgatgatcgacttttgtgcacacatttcccatggccttacagagaccccgtcattcagtcacgatttttgaagtttgcttgtttatcacttcctctctatggattgactctccataaagagggtgcaacagattctggcctggaaagggaactccttatgttgcaggctctgccttgcccgtagctggagatgccatcccagaacccttgtgggcagccctgcatccacaccgcctctcagacacccccagaaggtggggtgctacagagaagggagctgggggctgtatggctctctcacaatcagctccttcatacagccattgccgggttgtggggggcaggcaggataccaggaggccaagaggggcccacgtctcccagaggagcctctgtcactgcgctgcgcccaggcaccctcaggaagtagtgttgatggatttgattccaggcaagtttatctcctcctcactcactttatcttgctctttccgaggctgtatctcggggaagtgatgtcttcatgtatgctgagttagtgaaaggctttaatcgcatttttggaaacactgccttttccagagcagaaagcagagtgcgtttatccatctcggcttcctttctgcatcttcccctaaacctgccctggattgaatgtagtcagttccacaccagggacgcatactgtcacaggaagtccctatgtagagttggcccaggggccagtgcccgccagagagaggagtgggggctgagcctgggatggggccacataaccctcccctgcctgagccgcctcctgtagatgagtggctcctcaagcctccggcccttccacctcaacgtgagaagtgtctctctcctagtaaacctcagtggccttaggctagggttggacatgtgagggtggtgtctattcctggagaaataacatcgcatttgattttgccacaggagctttctatacaaggttaacagcaatcctgttgtgaattccttggcgcctcatgtctcctaaacccagctaaactgacggaggccatggaaaccactaattttaacagtgccggtgacatcccttatcttttagctttcccaggcaggaaccgttgccccagcagacatgatgaagtagaggcaggagccagatcgtgaggtgcttaaaaaaagaaaagagaaaaagatgggcgggggggcttcccactatcacaaatggggattaaacctgcaactccgtgggaggtacccaaagctggaggataaaaaaggtacactccttcatggaacaaccagtttactgaaatatattttggggggaaataatttttttaaaaaatattttttcatcaaaacaaaacttagatccctgatggaggagactggaaatgacacatgaaattataaaagaaaacccgagacttctctgcgatttttaactgtcagtgcgggctgtgctcaaacccctagaggctgcacatgacctcctctctactcccccagaaggcctccggtagggctggtttgggtaaaggcagaaccatgtctgcaaagcacagcctcgcagctttgttcctgatttggccagtatttcctgagatcctgtagagtgcccggctctggtccagaggcgaggggtgccaggatgtctcagacacagacagcggccttgtgcttaggcgttcattatctcatggggtagcccattttgaagcagtgcagaagggcacatattcagtagaggtgcagacccagaggctctgtgagctgcactagagagatgaggaggcatctcccccggcgactgacgatgggctggcatgcctccacctccgcccctccgccccctcgccctcccaaccaccaccttccctctctgcctgctactcccctcttactttcccattgatatttttgttgttgtttaagcaaattattattatttttttaaattttagcctcaagagtcttcataattttttaagggaacactagaggtactgcaaaaccagaaggatataaatgttgagaggaagacaatttgtgttgcatagaccctgagggactgtcagaccaacacaaatgtaatccgctaagcactgaattaaaacgccctcattttagaaaggctggtcgagaccatgtgattgccttctcacgaggaaatgttagatggtgctgtatgtcttcaagtctgtcagccatttggaaatacctgtatctgtttttgctccttggctccgtcatgtgtgtggccatgccatcctattgtattcttgaacagactttaatctgcacattggatttggtgtttatttgtaaagtgttgtaacactgatgctttgggaaaatctttggttttataacagtcttttttccctcaaggtaagtatgaagtttatgaactgtaaaccctatgcagccatgcatgaatatagatgaatacttccatctctgatcacagtgctctgtgggaggggctgagaatgtctatgtctaatgttgcaatttaaccttaagttgtcattgaggatatgctcccattatgaccaggaattggaaagaatgtcttctttaagtctgcaattcagacatattacacgtggtcttctagaagtttggcaatttttcacttttcaaattgttaattgaactcccttttgaggttttcatctttagaatcatgctagattcccagggggaccatgggggtcatgggtggtaggctggttggctctgcctccttctccatttcagggcccacctgccaccagccatccctatggtggcagtgtctgagcttgcaagatgggggacgccctaggctcccaggatgtggctccaacccccaggaagggggctggaagacttgggttccgtcctgctggagtcccgcgttcactctgggacttcactgagttaccctgagcctcggtctctttgtccttcaggatatcagcgacatcctgtcttgccgtctcccacacagggtggttttcaatcagctaatgactgtagaagtgcttctaaaaatacataaagggtttttctaatttaacatatccttatcttaaatccgtggatatcccccactcccctcactgggttaggtgggaagggtgcagggtactctttggaaattctggagtgtagcattttctggatttcccagcaggtggccacactttacacacacatcaacgttgtactcaatgtcacccaagaggtggctctggagaatgtggaagcactgtgtcagctgcaaagtattacgcaggtctaagtcattgttattatatatttgacaatgtttttttgcacaaattgaggggaacggcatttctattacatagtggttaagcacaccagctttagaatcagacaaccaagtcttgaatgtttgttctaccttttccagttgtgagatttggggcaagttacttacctctttgagccttactttcctcatctgtgaaatggagctcatcacagtagcagcttcgtgaagttcagtgaggactcagtgagctgaagaatgtagagggcttggcctattgaaattatgacagttcaggaagggtgcatctcttcctggatttgatgcaagaaaagaatcgaatcaattcagtcctttcaaactaattaataatagctggccaagataggtctgtgttagtgaaaagcccaagttatatttttaaaatgttttattatatatataatgacataagctactgctgactaaaggatattactacataaaccccctcctgggcttgctttaaagaatagatcaaaatcatttataattcgcttatgaattcaaacctttggttttggcaacaacttatgaaaaatatttgaaatactttgttaagtagatcttgtatgttgttagacaataaatattgttattaaacccactcttatgacataaaattgaatgtaaacccagcccaggtctataaattcaaaatcataccaattaatttgtattcttggtgttctagtaagttccagatcctaccagatcacaggtatcattttaaatcaatccaattttgtattactataggcctatttatctttagaagtttaagggaacatggatgaagcgaagcattatagaaaactgaaggcaattttcaaactagtttatgtttttgaatctcgcctcctacatcccattctggctaattggataccaggggcctagacaaagactcaggcatggctacttttaggaagctttggtttcctaaggcaaagattcatgggatggagaatgtgaagagggaaggtggtgctggtgccggtgtactgtggactgactataccagaattttacatagtggaatcaggtttggtccatttaaattcatactagtaatagccagacaatctctgatttcttctacttgaatggtggctcaagaggcaaaacacaccaatagatagtagttgtattacttgtgaatattttctaagtggagacatatcctctgggaataggcattcttatacatttttcatgactgagattagatttttctctcatttggccaggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaatcacttgaaccagggaggtggagattgcagtgagccaagactgcaccattgcattccagcctgggtgacaagagcaaaactccatctcaaaaaaaaaaaaaaaaaaaaaaaaaaaaaaaaaaaaagacttttctctcattcaacactttaccagcatctactgacagaaaatggacaattgaatttcctccaatatatatacctctgatatgtctgctttgtaaaagagtagtgtaattgcttacaacattgaaaaggttgttattggggtcctggggtagccaggatatcggcatgatttgtcaccatattcagaataaaactgtactgcaatagtgagttaattccatatcttggccaacagagaatttttggccagtggctactaaggcacacggaagtccagtctaaaagggacaggggaggactctttgtagatagttcttatgattaaaaaataacttcctatgtgttgtagtgatgattaagctgacagaatgctaaagacacccttaatgattacttgtagcaaagtacttccccacatttagctggatttgtctttggtttgaagaggctaatacgtgaaagatttgttcacagttggatgtccccttttctgaaccatgaagtaatattgtgaatggagttgaatgctgaggttagggtgccggaaagattcagggtccttcggtaccctcacatggcttggctttggtagaacaagaaactaagctctgatttggctttaaatgagagtgctaaatttcctttttctaataaagaacctagctaaacatttatatatacttttgaacactgaactttcttgttgcagagttaacagctgttgggggtagctgacagctggatcctggtgctgttggtaccatggtacctgaagtgcacaggctggtagccacacctgacattaacaagtgagtggtaacctctctgccgctggcttacagctactgtttccatagaaatggctgtcgggatcagtggaaacgaggtaagtgaaagttttcgctgatccttgtttccatcaagctgacgtctgtttccctggcaacagcagtggacagcagccaggcgctagcaacagattcagtagagctctcacttgtcagctgtggctatcatctgttcctgaccaagttctttttttttttttaataatgtacagaaagacctctgaggacccaggaggcacctctggccacatgtgccctcctggatgctcgttttgcagatggagagctgtgtgctgagttgacttctctgtccgcagttccccctccacctgtgctctgggttgttgatgtgcaggttagaagagggaggttgttgagggtattagtgttgcaggggaggctgttgaatctgttgatcccaaatcctaggggaagagaattcattacagtgctttcatgcacagacccagctctttataaagctgttgctaccttaatagttgaaattaaagccataattttcctgtggtccctattcaattggaggcattaacaattgccattacttttacaatgaaaaggatatttaggagtttaataatttggcttgtgagaaacaaattgatgattgtctctaagatgctactgtcaacattatgctttttttctcttttgtgtaatattcttttacaggatggtaaaattgcttttacagagatcaaatattggtattgcagggcagcttggtatacaaagaccagtagatctatagtgtagggaactcttccttgttaaagttcaacagctccttttctggatttcattttaatgtttcaacagatggatgcacccaagccctagccctaagtattctccacccatatgagacagcattgatggtgccacagagcaaaggagagccactgttcctgccctggtgtgtgagatgagaggcatggaatgaggtgttggttttaagcccttactgataccatttattaaagagattttctctggaaaaaacaaaacagctttgatattcagagctgtatttttgagactcaaatgaacataaagatccacggtcttatgagaacttagatcggctgctagaagagcattggagaaccatggagttttgtctttggagggctttccggatgacattgttccacagctctctggaaatagggcaactgtgcttggcctgcaggcagttgaatttgatataacagacgaataagaagcagaaaatcctgctggatccttttttctccctctctcttaacttcctaagaatgacttattcatttaatgaattttttttcagttcctacacagtggtagatgtatgccaagtgccctgctaggcactggggttacagtggtggaatgtaggcactgggtaggcaccaggattacagtggtgggatgtaggcaccagggttacggtggtgggatgtaggcaccgtgtaggcactgcagtgacagtgtggaatgaaatggtttctttcttcgtgaagcttatatctaatgatggaggccaaaatgacaattacaaactcgtataaatgctttgaaagaaaggttcatgtgctgtgagagggtttaacaggcacaactgctgtcagtttattgggtaggagcatcctggaagtgaagaatgagtagtccacatatccaggcaaggtgggacaagaagctagggcaagggtattctagtcaagggaaaacccacagaaaggaggtacagtaggaaggagcagaggatgctggaggaactgaatgaagctagggtgacaggaactgggagagctggagatgaagtcagatgaaaggaaagagactggccggcagaatccaggtcacgtaggacctttagactatgtcacaggttttggtcattagctgaagggtaagagaatgcatggatgaattttaagcagggagtgatattcaaatttacattttctaaaaattatgctgtattctcatatcctcaacttaccttaaaatgcttcaaaaagataagatgattaatagatggatagggggatgcagagataggtgataaagaaaatgtagcagctgggtgctgtggcttgcacctgtaatccgagcaattcagaagggtgaggtggaagggttgcttgaggccgggagtttgaaaccagcctgggcgacatagcgaggctttgtctctggtaaaaaaaaaaaaaaaaaaaaaaaaaaaaaaacagaagtctttttagctgggcaatgtggtgtgtgcctatagtcccagctactcaggaggctgagacaggaggatcgcttgagcctaggagtttgaggttgcagtgagctatgatcatgcttctgcactccagcctggggagcagagtgagaccctgtcttaaaaaaaaaaaagaagaagaagaaaaggtagcaggtgttaattatggaatctaggtgaggtaggcatatgggtgttcattgtataattgtttctacttttatggatgtttgaaattcttcctaataaaatgttgggaaaatctgcatatgaaaatcactgtggctgcagtaatatgaatagattggatggatacacaaatggatgtagagagaccaacttaaggctcatataatctgcttccagccacaacatactagtgctaccagactggacctttcaccataaacaactacaaaagactgggcaaaaaataggaagcaactattttcagaaaatggaaataggatatacaggattgcaatccctacgagaagggaaacacatgaggtaaactccgcagttgtcctggctttctgcctggagacagttttagaattatggcagagagggagagcccagcagagaacgatggtctatttgctgaggggtcaaagaacagtgttcagggctgctaagatagctgggattttcagggcagagtatgggtgagaagtatgcagagaaggggctccagtactcagagtggaggttctttgaaatctgaccatatactaagctgcttctgtgccaggtgatacttattgaagccaggcagagaacagctagtagaatgctgtaagtggttggaaatctctccgtgctgggaggtatatggttctgctcagctgtagtggaaggacctaattgaatacattgggtactgagacttcagaaacgccaggctttagggttggagctactttagcccttgagtaagcctactgtagacctgacttaaaaagcatagaaacaagcttcaaaaggatcagggaaatggccaataaattaaacacctgtcaaaaagacaaaaatcaacactcgttaaaggaagagaccaaaactcagatgttcccagaatgtttttcctcatgacccaaaactataagacatgaaaagaagcaggaaaatattcacgatcaaggagggaaaagtcgatagaaacaaaagatgacagatgttgcaattaataatcaaagactttgaagtcactactatgagcctgtttaaggaactgaaggaaaagatggacataataaaagaataggtaaatctcagtaggtaaatagaaacagtacaatatctgaaaaaagtagactggacattgcagaaaaagttgatgagggcttagtgatctctaaaacaacaataagcaatctggtgtatatgaaattggagtcacaggagaataaagagattgaggaagaaaaattttaagataaataaagctgaacatgttgcaagtattgaaaactaagttaacagatccaaaaggcccaacaaacctcaagcaggggaaacacaaagggaaccactgctaagcacatcaaatttagatggctgaaagtaaaagatccagagaattttaacagaaagcaaatgggaaagggcacattacatactaggagaaaataataagaatatgcatttacttgtttgcagatatagtgcaagttgtagggcaatgggtgacatcttcaaagaggtaaaaggaaaaacgattctgtatgaagcaagaatacccttcacaaaagaaggaagtagaaaaactttcaggtaaacaaaatctaagaattggtcaccaacaaatttgcactctaagaaatgttaaaggaggttcttcaggctagaagaaaataataccagatagaaacgttaaatgtccgctttaaaaacgaggagcatggccgggcacggtggcttacacctctaatcccagcactttgggaggctgaggcaggcagatcacctgaggtggggagtttgagactagcctgaccaacatggagaaaccccgtctctactaaaaatacaaaaaattagctgagagtggtggcgcatgcctgtggtcccagctactctggaggctgaggcaggagaatcgcttgaacctgggaggtggaggtcgtggtgagctgaggtcacgccactgcactccagcctgggcaacaagagtgaaactctgtcaaaaaaaaaaaaaaaaaaaaaaagcatcaaaatggcaaacaaagataaaagattttttctcatttctaaattttctaaaagataatttaaagtaagcacaaggtattatgggaactgtaacaggtcaaagtaaattataggataaccatacacagaagatagaaggaagttaaatggagcttcactgtgataaagttactacattttgaaataatatgaattcatggtagactgagaacttaaggatgcatatgataatctccagagtaatgacttaaaaggggtactaaaaagctaaaagaagagataaaatggaatattaaatagtactaaattatccaaaataagtcagaaaaggaagaaaaaggaacaaagaacatatagtaccaacaacgagatggtagacaaacccagtaatatcaataattgcattggacgaaaatgtacacaacattttagttaaaagatagaaattgtcagactaaataaaaatttaagatgctataaagacatggattaaaaataaaaaatggatgaactgtactaatccacacaagttggactttagtataaggaacatttccagaaatagggacatttcagaaatagacattttattctcataaaaaggtcaattcactgagaagacacaatgatcctaaatgtgttggcacctaaatacagcttgagagtacatgaagcaaaagttgttaaaattaagtggagaaattgataaatctagaaacatagatgaaaatttgtatcattccttctcaataattactaggttaaaaacagcaaatatagataatatctagattatatttagattggttaataaattcagccaacttgacctaattgatatttataaaatactgtgttcaataattgcggaatacacattcttttcagagcacgtggaacattcaccgacatagaccatatcttggccatgaaagtctcattacctctcgattgaaattttacaaagtatctttgttctaatggcagtagatttaaaacagaagccaataacaggctgtttataaaccttcccaaatgtttggaaattaaataacctataactcaaaaaataataaaaattagaaaatactttgaaactgataaaatccaactgggaaattgtatgatccgttgaatgcagtgcttggagggacatttatagctatatcagtaaggaagaaaggtttaaactcagtagttctacatttccatctactaatctagaaaaagaagaccaaataagtccaaggtaagtagaaaaaagaataacagaagtaaataaaatagaaaacacaaattataaagttatttagaaagcgtaataaaaattgataaatctctaacaaaactaatcaaaaaaggaaaaagagcaaattaccagttttataaatgaaagaggagataccacagatattacagacattaaaataataagagaataaacttggtaacttaggagaaacaggcaaattccttgaaatacacagcctaccaagaaataaattgggagagtcctatatttgcctttttaaatggaattcagaatcgcaaacagaatcgcaaacagaatcttctctcaatcttctctcaaagaaaattagaagcctagatgaggtcaaaagtgaattatgtcagccgatttagaaaaaaattataccatccctagaaattctttcaggtagtaaagttggagggagcatttcccaactcatgaggccaaaatctcaataccaaaactttacaaagacataataagcacagtgtccttcattaatttggacacaaaaattctcaaatattagcaaatagaatatagcaggatgaaaggaataatatctcatggccaagtgggatttatgccagaaataagttgattcaccattggaaaatcaaataatttaccatattaatagaatgaaagaggaaatcatacgatcacctcagtaaatgcagacattactaacaatattctataatgatttctaataactctcagcaaactaagaatatgcaaaaacttcctcagcctgaaaaaaaaactatagctgacaacatacttattggtgaaagactcaatcttttcttcttaagattaggaacaaagtaaccatttttctatcttcttttattcaatgttttattgaaagtctgaaggtaagacaaagagataaaaggcagaaagattggaaagaaagaaaaaactatttctatttacagacataattgtctacatagaaagtcccaataattgaaccaaaaacctgctagaattaataaatgagtatagcagggtgacaggatacaaagtcagtatacaaaattccattttattcctgtatacaagctgcaggtgttgaaaatgaaattttaaaaaattaccatcaaaaattatttacaatagcattcctaataggaatgaatataagaaaagatatggaagacctctacactgaaaactacaaaacactgattagtaaaattacaatgatctaaataaatgaagatataccatgcccatggattgaaagactcaatattgttaagatgtccatttttctctatgcattgaatgttgtcccatttataaatctcaatagcctttcttttagaaactgacaagcttattctaaaactaatatataattgcaaatgacctctaatgaaaacaatcataaaaaataaagaaggagggcttatactgctgatttcaaaatttactgtaaagctgtaataaatacaatgtttgacataaagatagatgactagaataactgaatggaataacaaattcagaaattcctttatatgttcaattgctttttgataaaggtgctagataattcagtggagaaaggatactctttttagttaaaaaaaaaaaaataagctggagaaactgggtatctgcaaaaagtgtgatgctcaggtcataccagacacaaacattaaacttgaaatcgatcatagatctaattaaaaagctaaacatataaatattttctaaatagatttctgctcttcaaagactagaaatttaaagggaaaccacactgggagaaaatacaacacttacatctgtgtatctagaatatgtgaagaactcttaacaactagataatagatgagcaactcaaaaattggcaaaacatactttacacaagaatgtatatgagtagccagtaagtacacattaaagatgttctatgtcataaaccatcagggaagtacaagttaagaaactgctacatagatagtacaatagctaaaatcaaaaagactatttccaagtgtcaccaagagtacagagcaactgatatgctcatacattgtttatagaaacataaaatgatacaactactttagcaaagtttgtcagtatctcataaagttaaacatatactcaccatatggccaagcaattccatttctagtatttgcccaagagaaatgaaaatctatgtctacaaaatgactagtacatgagcactcatagagccttattcatagtagcccctgtggggctgttggaagcttcagtctccacagactcggccttgggtggaggtccgcccagctggggtgaggcagtgatctggctgcgagctgtgccaccctggcctgtggggtctctgctggctgagggattactggtttctctgttgtagtgaggggagcacaaaggcaggggtcagaagtgctggcccgtgtgcttgctctgtacttacagaggcatgacttctttggtcagtatacttcacgtttccaaatcaaggctttttcttcctaaaattggagcgccccatctctgacttttctcacagagccatcctaataaccaaggagagaaatggatgggaagggcctggataaacgggaagacctttccaagtatgtgggagctccacactggcctggttgtgtcctcctcctcggaggtcatttctgtgagctggaaaagtcatctcatttgcagtctggatgtttatctgcacttctctccagggcctcacatccttccaagacctggagcggcacttggcgcattagcctgatttctctaagtctgactgtcatgagtttggttttgggttcagggataaaacattaatccacagtgaacccatcattccttcgaatttctgctttaaaataaatcttggtttaagttgcctgctggcagttttgggcctctgagtcttggagacccttgctgtgtctgaaggattttaagtcagtgggtgagagtacaccacctgctgagaggtgtactgtccccagaggcccacctgtccttaaatcatggactattacttacaaacaggcccacagacacatgccaagaattccagggcccagtgtagattccagcagctgcactctgtccccctttggctatcagtcaaggatgtttcagcgtcaaacctgtacctatcagtatgccctaggagcacagcagagggttggcaagtcagagggcctcacccaaggaagctgggctccagttgggcattgaaggatggacaggattcgttaggatggtaaagaaaggaagcaagttgtcaggagagtgggacctggtgcctcctgcctgtcggaaccagtgagtgcaatggtgaggctgccagggtgctccgtgctggctggtgagcagtgggcagagcagatgtgcagttgggaatacccactgagagaggcagggtttttttttttttctttaagctgcgggagctgtcagagtgtttgaaataaggtgatggttgacagctgtgcctggaaggtaaagctgccacctcccagagtgcagtggagttaggagagcctgggggctgggggctgggggctgcagggatggggtctgcatggaggtgcagaggtggagatggaagtgaaggtatagatgtgggagtttgttgtggctcgtgcctctcagataagaagaggtctctggattttgattgtcaagtctggggatgtggattgtatgagagaatttttcttttttcttttctttttaaaaatattttttatagagacaggtcttgctctgtcacccaggcagcagtgcaatggtgcgattgtagctcattgcagcctcaaatttctgggctcaagcaatcctcccacttcaccctcccaagtagctgggactacaggcatatgccaccatgcccagctaattttaaaactattttttgtagaaacaggatctctctatgttgcctggctggtctcaggttctggcctcaagctatcctcctgccttggcttctcaaagccctggaattacaggtatgagccactgcacccggctagatttttttttaattgcttataatcctgtgctttattcagtttattttaatcatctccactactttgatgaggtaagtgttctttgcctcagtttacagatgaggaaatcaagactcagggaggtttatcaattttctcaaaatttacacagctagtaagtagttaaactaggaattaaatctagatctgtctgtctccagagcccaagctgcttttctcgtcagttggaagctggttctaagtctggtgagaggaaacccgctgtgggaccctgtcttcccagcctgggtctgtgctcgtacatcctcagctgctgtattctcaaagctctatgctttgtcgtttttgtttttgttttctcttcctgaaattaattacccaatgctgagtggaacaatgggatacagaggcttcagagaaattggtttagttttcctcttgaatctgcttttggacaagtctcatttgagctcaggtggtccttttgggtcctgttgctggagggtggatctctcagtctctgagcccagccctggggtgtggtgctctgccccttgttctccgtcagccaagtctgggtgctctgggaaggtacttcccacccaccgtgcctttcagtgggcactccccctgcggggggatcttctctatccctctcctctctagatgcagctcacagggtggtttccgtggcctgcgagtgggatttgggctgaatttcctacagtgactgctttagggatatgccagtagggggttcaatttcagccccttccttgggtccacagtgctcctccacagtgggaacccctagcagctctgaacagcagatccagcctcgagcttattctggcagtgtaaccaggcccttcacacagcaaactgtagtgacatgtcagtagcacatgccctgcggttgctggtgccttcaaaagtgttcattttaggtggttctgccaccctcccaagccagacttcatgtgcacatcttccttattttttcttgaaaaactggaatctgacaagtctagcagagtgtgtttatgaagtgacttcttaagtagcagtatttgaaacctgtcatgaagatatgtgatgatattggtttggctcatgtgattaagtgatctgtttcgttcagagagagtgatggcagaaaagagagcccatggttttgaagaatacctctttttttttttttgggggggagatggagtcttgctcttggagtacaatggcgcgatctcagctcactgcaacttccgcctcctgggttcaagagattctcctgcctcagcctcccaagtagttgggattacaggtgcacaccactacgcctggctaatttttgtatttttagtagaaatggggtttccctatgttggccaggctggtgttgagctcctgacctcaggtgatctgcccgtctcggcctcccaattgaagaatacctcttaaaacatgtttaagttttaaaaagattgaaacaaagtctgtaacttttagcatgcaaccttcatggattctcatcattgggaaaaattttctactggaagcattggcatgtcttttgtagccatggaaactaacccttcaaagagagagaagctcttctatcctcaaacaaggagatacagtgaaaggaaggcatatttcatactcagatgcctgaaatactttatttctgtgtgagtgtgtgtgtgtgtatatatgtaatatatatattgcagatatatattacatatataatatatatattacatatataatatatatattacatatataatatatattacatataatatatatattatatctataatatatatattacatatataatatatattatatattatatctataatatatattacatatataatatataatatatattatatatattacatataatatatattatatatattacatatattatatataatatatattatatatattatatatatattttaaggcttatacaagactcctgcttgtttttgtttatcaatggcacgatgggtgtagttttaggtgattgaagttacatatgcactgtggccaaatacacccagtacaaagcccaaagttgcatgtctttgatcctcattagtgtaaagtccatgtttgtgaaagcaattatttaggtgatttttatcgagcaactactaatggccggggtttgtgataaggaaccagtatacaaagataagacagacacagcccctccttaacagagtttacagtctggtaagttaaagaaaatagtgaaaaaccaattgcaggactgtgaagtaaattctgcaaaagcggagttctaatctggaggactctaaggtagagaaaagtctttatgtcttgagccagccgagtgggatagtatctggaagagcaggaggggttatgcaggcaacagcatgcacagtggcctggtgttgaaagagctccatgccttggaggaactgagtgaactttaggatgtctagagtacacagttcaagggggaagaggtcagaaaggaggcaggagagatctgacatgaccagataggtggtgcattccttcactccatccctaccgcactctcctgctcagggtaagtgccacatgtaaacagttaggtttggtctgtgcagggtggcccagctgctaattcctgtgttctgttcatggtggataactcaacctagtcattaaaagctaggaaacaccgactctgaaaatgattcatcttcccaaaagatgaaaactgttttaaacatcatcaccgtcttttatgtcaatgaaagcatcaacaaccctggctgggcacagtggctcacgcctgttttcccagcactatgggaggctgaggcgggtggatcccttgaggccagaagtttgagactgccctggccagcatagagaaaccctgtctactaaaaatattaaaaaattagctggacatggtggcgcacacctgtaattccagctgcttgggaggctgaggcacaagaattgcttgaacccaggaggtggagggcatgccactgcactccagcctgggcagccgagcccagaccctgtctcaaaactaaaagtaaaaatagaaatgtgattgtcaaatgtttttcttcaacatattttactgtgtaaacaagggacccccattttctcgtcctttttgcccaccagcggttcccatgcatttcttggcagctgtgtttcatgactgctgctggagaatgctgtcccaggccagctgtcttccccccacagacattacctgcaaaggagcaggtcttatttatggggtgctgtattcctaatccctccccaccccactctgcctattggtctcatgcagagagaacatcctttggctatcaccagcttttcatggttgagggaaaaatggaacaaatacaatgcttttgatgaactatgagctgagccagtgccaatgattaaaaattttttaaattgtgaaacatcacacattgctgttattttttttttttttttttacaaaattcctagtttccttgaacagaaactgaacctttatgctttccaagaagttatatttaaacaaaaaagttctttgaatcaaactacatttgcattctgtttcatttccttcatgtctatgtagaggaaataatttaggtctaaagaaggctggactcccctgataaaaatcagtgggttacttcttcaacttcccccttctctttgcctttataagtgttgcctttgtttttttctgaatttctgagccttctgttttactaaaaatctgagtccctagtgattttcgtggcagttttcaatggaggttatgttgttttttgctttgtttcgagggttttttgttttgttttgttttttgcatgtgtatgtaaatatcaaagtgttttgtttgtttaaattttatgtgggtctaattaaaacagatagcattgcaacacaagaaaaaaaaatcctgtatctaaatcaagatgacttccagtggcccatttattttatgggacgtttaagaaataaaagttcccacagcaaactgcgtgtcctcttgcatctgcggcagtcccattccacctgcacctctgtttgtgtgtgatggctggctgcagcctgggcgtgctgtctccagtagtgttggctgagccaggggtccaggagatcaggatgtcagggcctgtaaatcctggggcatgtgagtgtctggtggcctctctgcagaacatgaggcgtgtgcccagcccgtgggggctccactggggctccttagatggaggctggctgggtctggggcaaggggttctctccctggagtggtgcttactgagtgggagtgagggacagcaggtggagagatgagcggaaagggggctgtcacctttctctgtcctgagttggggctcttggggaaaatcagagtgcagtagtgagcagagctgggctttatgccctgtcctccctccctggtcctgattcatgacctccccgtgagccacagccccacggaagggacgtaggatttggagcctggttagtaacgctgttgttctgttgactgggcatatgatgtgggccagcaacaatgcctcgttgagcctccgtgttggcctttgtgaaatggatgtgaaaatcctcctcctgcctcttccactgaggttgtgagcagcccagggggcagtgaatgtaaagacatttggaggactctaggaacaatctaaataaatgaggggcttttttctgttattgttagagaaggggacatggcagagactcaggctgttttgccaaaacccaggtcgctttccccagctgtgcaggctcgtattctgctgaagctgctgttggttattcctgggaccctgggcgatgcagtcacaggtgaaggaccctgggcgatgcagtcacagtggggtgggctcaggctgtgcttgtttcagagacgattttggcttgttctgctgtgtttgtctattccatctaaaggtcttttgggggctggatgagtatggggcgcataccattgttctgtcgtcagagcgccctgcagccatttctcgtgaactcactcagcacttatgcttcttgggtgtcaatgccaccaaactacttggctgccaggtccaagagcgtgccaggctgttgcccagggaaagaaatgggcaacaaaaaatggactaagtcacagcagtcaggtccccgtggaggaggtgctggggaggctggagtcgcagcagcagctgaaaggtctttagaacgtgctgtgatctggtgtcgctgccgagtcattagtccatctctactgaggatccctgtctggggaagttgctgcatcccagggcaactgtgctgaaatcagttgtcttatttcaaaacttgtgcctgtgccccgagaccctcagcaggcatccttcttccttcatatggcagcccttcagatactggggaccagcctctcttctccatccctcctcctgccccgcccagcccgtccttcttccctgaacaggtggacaagaaatgttcatgtggcagatggggtgtcacggggccctgacaaggaaggtccacatgaggggagatgattacactggtgtgctagacccaggggactggtgtggaaagggcagaggtgacagtgaccgtagcatggtggtggttgggggtcagtgacaggcgtcataggtgtttttccaaatagtcgtgtaagaaagttggggcttcatgagaagtgtgtttttgaccacattggtattgatgttaaatccaacccatcacccagtgcttactgaatgtctctggtcttcctcagcaccattttcttcttattttcattttctgttcacgcataacacctgtgaaagctgataggagtcctatcaaatttctgtctgttcctccttgcctacagagaagcaatccaggttccttagttttgtatttaagcccctttctggactgacaggaagcctgttttcgttagtttttttgtttgtttgattgtttttgagacaaggtctctgtctgtcacccaggctgcagtgcagtggtacagtcacagctcactgcaacctcaacctcccaggctcgggtgatcctcctgcctcagcctcctgagtagctgagaccacaggtgcatgccattgcacttggctaacttaaaaaaaattattttgtagagatggggtctcactctgttgcccatgctggtctcgaactcctggcctcaagcaatcctcccaccatcacctcccaaaatgttggtatttcaggcgtgagcctctgtgtctggccttgtagcctggttttgatcctcatcctcctggtgtctaccttctccttcctctgctcctgcttttccttccaggcatcgtgttgaggtgcttagggtagattcagcagctgcatggccttgtgtgcccacgtgctgtgagcctcagtgtctatacaagagggtgatagcagcccctgcctccccatagtcactcaccagcggggatggggtaaggtgttgctctgggctctggttaggttgcaaggctgagggggccacccagggtaggggacacatgtattcatgttttggtgctcaatgagtagagttttctggtgaattagaggcaggcagaatgcatttggatggggtaagccagagaatgtgtcaccaaaagcatgagacttgagcttggtcttgaaaggtgcactggattcaaagatgggagaaggctgcccaggtggatggaattctgtagacaaaagctcacagggttgcggaattgagaagagtgtggccagagtataaggtgtgcatttataggatgggtgaataaggctggaatagcacttgggagaaggctggaaggccttgagtggcaggcagaagcatctgaccttcatccttgagggaggcaacaaggagctgtgagacattctgagtaggatgccaccagggggaagtctgggtctgcagcgacctggagcagagagggaagcaagctctgatgaaatgctctggccgcagctcctgtggctgcccagggaatgggtgtgtgcagacaggcctgcataagacacttcacagctgtcctgttaggctgttagggagattccttactgagtaattgcttctcaaccaggagataaaagggaatatcttaatgacctagagacagaagatctaccacatgaggcctgaacacaataagggaaaatggcgagctggccgtggaggctgctccagatgatatgtctagttttgggcacactcatttcatgcttctgggcgatcccagcaattgtgggctttctgtcctatagggacattttctggcctcctgaaggagtaggagtagggcttgttttgttggatacaattttttgtacatagccttcctgcatgcctatatgaagtggcgccaaggggaaatagagacatgggaagaaatacatgagaaatggacagacaacattgtccgttcctgcctgcaaggagcttacagtctagctggtaagctgaaatgaatatgtaatagcatgaatttgaatttggttagtagtggagttatatcttctaagcattcaaatttttttctatttggaaataatttcaaatatatagaacaaccccaagaatagaaatagcacagtgaataatccatgtaccccttaccccagttcacctaatattaaattttacctcatttactttttcatttgttatctatccataagacatgtggactgatttttaaaaatattttataatttattactgtccttagttatttcagtgctcaaatttcctaagatttggctagtaggagctacttctctagctcctgtatccttatgacatatctccataatgtgttttggtttgtttttgttttttgagcacttccttattttcttcatcttgtacctaccctacccttgccctggaatcacccagttctccaaagtcccctggttccttttaatggggaatgttattagagaccaagatgtgggtaccaggtgtgcttgtacctgccagagcatctttgcttctaagtcctttcaacaggcagacctaggaaatatatgcatttccgtacacatattcatacacatacttacattgatacatacacatactcacatatcagcctcttttaaaaatcagacattggaaatcagactttaaaataaacatcttttagaaatcatcagttcacacctataccttcaattccagcctgtccccagagggttcttctctgttccgtgtttctgtgtccctccttccacagcgagaactctggctcccagcagcattagcacatgtactcactggctaaatcctgtaatatgtctaagatagtttcagaatggtctcatccacatcactgcaaaaaacaaagctactgaaaagagttcagcatttgtttgtagttcatccctcactccaatcctacccaagactgagagtatgtcgtcaaatattcatgagctatttgaattagttttgtctttctccttcagtctggttatggtattcatttgaattacagatttgtttgtttcaaatcactttcagtttaggggtattttcccttcatctcatccttactgacttaatttttaaaaatttaaggtgaagaacattaacatggttcccaaagtcaaaactatagaaaaaggtatacttaagagtgtcactccaaccttgattcctttggcctaattcattcccatcccttgttttctgctctttcttttagatacacctgagagaaatatgctccttttatttcccagtttttcgtgtgtaaagggtagcacactttattgctttttttttttttttcatccaggcacttcttatttatcttttgatcagacacaccataaccaaaattctggtttggaacaagaagactcctagcatataacagttgttggatttttagtcacttgcaaaagtctgttggtttctaccaatagctttattaaataagctttgtaaaacaatctcttagtaataggattcttagaatatgatgaattcttatgcaaagtggagtaacttttttcccatcattgcaaagtttgatagaaggtgcctcggacttgaggtgtgattttcaggatcagagggtcagttgtgatgggaatgggttattctcaactgagcagatagtgtacaggattggcagtgggtttgccagctcattgcgatcactctgagccttgggacccatgtgtccttctatgtgtctcccaatcctaacgggtttgtggcagcttagagcccattcacagctagtgctaatttttctccctttgataatttgagaaagctcttccatttgccttttgaatgtctctcttatgtctggattcaacaactattatacatttgaacttcacgttgataccactctttgtgttttcaaagccttactgaatgtcttgcttaattcctgtgaaacagcggaacaggtattgttgtgtctgtttggaagtgaggaaactgaagctcagaacacagcagtgacagagctaggactagaagccaggtcttcagacgaagagcccagagtggtgtaggagggccaaggatttatctgggtttatcacagggactctacctccctgcccccttcctccatcctgccctgtggccaacagatttctactgtataaacctcacctctgtccacatcaataaataataccttcctgctaaatattcagccattcagaactgtctaaaatcagttcagagggtctatatcagcagctttgttatatgagcttttgtgatagtgaccatcattgtgagtgggccataaaccaggacttggcagggttttttactcctaggaattttagtcagagtagagttttacttatgcctgcttacctgtgtcccagcagtggaaaatgtacaacagtgatgcagcttgttagaaatgggatttttatatttgtaatgttaaaaaggcataaaatattacaaaagaaaattaggaagatagtaaaagagttaccctgagaagcttaaggacgttcattttataatgtatgtaattatacattataaaatgtatataattatataatttaaaaataaaatataattatataattataatacattataaaatgtatataatgtatgtaattatgcattataaaatgaatgtccttaagcttctcagggtaactcttttactatcttcataatttttttcccaagaacccatatatgatatggacccaaagtaagaataccttgtttgtatgtaaccatctgaatttagtattctaagttcggaatcaaaacatgcaaacagatttgtactaggatacttttctggtgaataatagaactgaaggtccacttttctttgagatgtatttaagaaaacagattatataattcattttcctgcagatacatgacatgccaagccctcttactgttgctcagggatgtgattctggattgagttgtgattttttcagagttcagagaatcatttggtgaatttacctagagctgagttatgtatttcccatgtgtcaggaaaccccggaggcctagaaaccccaaaccattctcagggtgtggtacatgtgaatggcgagacactggagtccttacttctttgagacagcaggtgttctttgggctgggaggtcagagcacgtgtctgggctcagatcggctcctgctcactctctagatccacaaagcctggcctccttccttattcacagggggtggagtggagactgacagccctaacaggaccaaggataggttccagggagtctggaaagtggggtgatttagaagctatgagagggatcctttctttttcttttcttttttttttcctttctttctttcttttttatttttatttttattttttttgagatggagtcttgctccgttgcccaggctggagtgcaatggtgcaatctcagcccgccgcaacctctgtctgagtgggattctttctaattgtgggcagagggtggcacttggtgaggattccagtttcttatctgaagtattagtgtcactgggtgtgcaagcatctgttcagcccctcgacagcctagagttaagagacgggtgtgaatatggggttagttttgttgttgttgttattattattattattattttggagacagcgtcttgctctgttgcccaggctggaatgcagtggcatgaacttggctcactgcaacctctgcctcccaggttcaagcaattctcttgcctcagcctcctgagtaactgggactgcaccaccatgcccagctaattctttttattttagtagagatggggtttcaccatgttgaccaggctggtctcaaactcctgacctcatgatccacccaccttggcttcccaaagtgctgggattacaggcgtgagccaccgtgcctggctggggttagctttatgaaagcaggtcacttccccattcgtgggttgggttgggttgagttgggttgggttggcttatcgaggtaggaccctgaaagagacatgctggctttgactcggaacaaaggcaagaaggcagacagaagtaacctgtgtcagaatctcaaggtctgtgtgcagaaactgcattgctgtaacctcacctgcttccttggcagctttttactaagtctctaactcacatatcttggctcctataacaactcacggttggagatgcagatggttcctcatatataaaaattgggtaatcgtccacctgactctcaggcttgcctgagtatgtggggttttgtatatatgcatagtcagaggcttgcacacatggtggaaagtagcataaacaccccacaattgggaacatttacctgtctgccagatcttttccagggcaggtgttcctataaatgggcagaaaatcatatgcctcttcccctcctgcagggaagacttttggggaagaccatgacaagtagcaggggttaagaaaaacagtaatgcttcatcagtgctcgagttcccatctgggaagggagaactgggttgtggagggggtggggactgccctgactccatgcactgctctggcccgaacctgcaggtgatgggtagaggagcctagtgtgggcaccagcaaggactgctgcctgctcagagctcttggtttggacaaaaggggtagcacacaatattaatgcaaagtttgtccaaaagcattgaagaagttctaaacttggtactctttgaccacagcttggcccatttgggtccctcctctttgaggaggctctggggaaagtggggcgtctctgagttcaggccccttgttggggggtgtcagaggcctgccatgacagcacatggtgttttgggcctaggccccttgagatcgctgtcatcgaggggagttcattttctaagaaatgatgcatgtgtgttggtgtgggctctgcgactctgacccccatagtcttgctttggaagacactgtcttctgtcctgtccaagtgtgtggctccattgctgtgctcatgtgactatactcagtgctgtgtgtcctgcccacaagactgttgtgcagtagggcagtggctcaggatgcaggtccccaaggatgtcctgatatgtgcttgtcctctttgcctccttcagagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatagtatgtagcgcctttcctgcccctggctagacagacccagtgtgcggttcagacgcctagcagtaggccttcctcgactctgacccaggctgtgagtgggacagcctcctcccagccatctggtcccttctgcctgcacacatcacggagagaacaggtgcattggtgctgactctggatttctgcctgaggtttggggtttagagttgtatttggtaaggtggctttatagccaaggaaggtcaaacggacccactgttggcctgggaaattcagtaagcgcatttctgtgcgggcacaggggtgatgagacacatattcttgtaccacaggagaagaagctgtggtttccctcacctcagagtgaacagtgttattggacaagaatttgaagtgcagggttcctcttgactcttactcttaggccacctgacatggctcctacatgtgctattcatatgaagccatatgcttagcccatcaggggctgggaggaaaccggctcaccattctaggcaggtgttaaggggcacgtgagtcagtgacagctgctttgctgtcacccatcgacaccccacactgtgacactaagcaccctagagcaccttctgcaggaggcaaggcctgagaactcagtccatcactgacattaattgccattgtcaaccacggtgtctctttcactgcatacttttcccacagatgcgctcttattctctctggggccctttgtgcctcgggtcagagtggaaactggaatccagcaatgcatttgactgagatgtctgtgacttgcttcaaatctagaagagttggataggaaggaccaagaacgtacttcaagtgcacatgtccattgagaggcctggggacccgaggccggccctacgttgtagaagatggccgagcaagtccctgcttgagcagagcgccttggatgttttgctctcagcaaggcctgttgctgggtacaggggaaacccagagctggagaggatgtggagtgctgcctcctagggagagacaggcctgtcacactaaatgcagccctggggagcagagctgcagggcacacatagagggcaggcaccgccgacgagggatcgaggacagggctggagggagcatttggcctgggccctgaaggatggatggattgcaggtgtgaccattcagtgtcagaagaagcaccctgacccaggggactagcgtgagggaggcgtggaggtggacaaaggccaggtttcagggaggaagcagtgggcccttcagctggagcacagagggtatgaaggtcggggtgagctgccataggaagggtgggtgaggtgcaattgtgcctcttctggaggttgtggagtgtgtaagtgggggctgagagacccctggtggagaggcttcttgactgagagggcccttacctttcttcaagcctgggctctgtgcctccatggggagggagtgtgttccgtgatctcagatgccctggctggtgcaaaccagtgtgctgactgggagtgggcagggtcaggcctctcttctctccctccctgcttcttgccaggctcaggaaggggccaggactttagcacctgaggatcagaagactgagggagggtttctagagctaactgtttgctgaatgcaagttcagagtttataaatagacattcatgtgagtctcagactcagcgatgtgcctatgaagtgatcagatgtaagagtgtctgcctgtcctctgcacagctctccccttggcagttgagccaacgtgaaccccatggctttcgtggagcttctgcacctgcagtatggcaacaggccatgtaggtgcagcttggagatgcctgcaccgctcttttccccttcacttgcaaactgtaactcagatgctgacctgccccatctcccctaaacccaacatgttatttgtaaacgagaggaggtatggcccctttttctcagcagagtgtctttctttgctagtttagctgtgtcccccagggagctgagtgaggccttcttacaggccagtggcctttcctctgtttatttctcctcctctagaagtagacaaggtttcgtgttctagtgttgctaacattagtcgtggtagagttgtttatagggcctatgatttgaggattaagggttttcattggatttaaggtgatatcttgagggttaaccattttatctcagcccagcatttcctatgacctatcactgtaaaaacctgatgatgacagaaatcaatgactctgcctttcagagaacttgccatgaggggaagatggagaaggagtggcttagtgtgagaagctgatcccattgttaaggcccagcactctgctgtgtgagcccaggagggcgcgatgattctggctggtgggagtgggcaggctggggcgatgtgaggaaggctccgtgggaggagcagccctgggcggcagaggttgggggtgggggctttttcaagctggggaaatggcacaaacaaggtgtgcgaagtgacaaatattcagggcccttaagtgcattgctcagtaatataatctaggaaagaaacaaaacctgtttaaaagccttgtagatcttcagaattcactctcactggggctcccaagcccataaagctgcaatgtgtcttgggaacatcagcagtattgtttctgctatgcaccgtgatgtgtgactcaaaatgattaactagcttaacgtttgatccagaatagcaaatatttctgtggtgcgcccttgttctttatggagctcgttttgccaggtgctggggtttcctgtggagtgaggctcacagtgcttcccgagtcatcagatttccagagccttgctgatgagggttttaaataaagacagaaatcttggctgtggaggccatgatgggatttagctgacttgagagcaccaagtctcctcctcctctgaggagagaacctctctgatcacagacctcagcagcccagaccctctggaggagacagcactgttgaggtttccctggggcctcctgtggctgccagccattttcttcctgtcacagccagaaaaccacacaaggagagggtttcagtgaggcccacatggtcctcctcaccaaataaacagtcctggattcaccacatgcacatgccaggtctggggctgtctctgtgcatctgattagcaggcagtagaaatgtgggtgttgccagtgttacggtgtctgcatcctccctgggggtgtgagatcaccccacgtgccttccactccaaccctgctcctctgttacctcttgagaggaggatggcgcagggcccgggctcctgactttgtccataatggctaaggatgctaattcaactgagagcccttttcagctgggtcctggatgtgagttgagcagtttcctcccagaccttgaggattgaagtgacagtgtgagaagaaatgcttcctgatagccgagcctcagcctagatgagcagaagtgggtgtaggaagtcattaataacagcagatgtctgtgagctcacaggaggcaaaggcttgggctggagggcatcttgatgccccttctccggatgtggctgcaatggagttttgtgacttggaatttggactttagtattaggcaaattactcaacctctctggaccccactttccttgtctgcaagaaggggataaagatatatctccccatggggctgttgtgacaattgaacgttctgtgactgctaggagtagtcatagttgtagtatgtgctgctgctgttttcatcagacaccagtaaaagttgacctcaacagaattttaggggtataaatttagggggtacaaataccgttctgtgacatggacatattacatagcggtgaagtctgggcttttagtgtaaccatcacccgaaaagtgtacattatacccagtaagtaatttctcatccctcatgcctcttccaccctcccacccttctgtgtctccaatgcctattattccatccacaccctatgtccatgtgtacacattatttagcttctgcttatcagtgagaatatgcagtatttgactttcctaaacataatatttttgaaggttctcctagaccgctaaccagcctcagggtggggcctccctcttaggaccattgccctgtgcttttctgttcagaaactataaagttctgaagtattgatggaaaacaaatctgttaactaggtcactttcgagatagggcagcacagctttcaggctcttgaagtccatttctagtttggcggtgcttgctgtcagggaacagatgtcaaatcaagtacttggagatgcgctcacattatcttttctctctgatctgctaaatgtcactgcatgcgtctgcgatgcccaacactggctgtacgttataatcacctggggagcttggatgcttcttgatgccatactccaccctctaagactcttgattaatcttggggtgggagccaggggtggctctttttcattaaggttccctggggattctaatgtgaagctagggttcagaactcctgagtccaggatgctatcagtggctgaatatcacactgttccaggcattcacttgaaagaagaggagaggcaatcaggcctctaactgagctgtctggtgactggtgacaggtagctccagctttgtgcattcatagaatatttaaaatgtcaatttcataaatttgctattagaaagctggtgttacacaattaactgaatggacaaaattccctttgaagtgagttcctgagcatttggtaaattttcaaggataatttatttaactttttgctgagcttcaagtttcttaagaaaccctgccaaatctcaaagtgatttttttagacatatgcagctgcttctgagttaacaatggagttttgctaggaccattaaaatctggaagcctaaaattctattttaaactcttctcattgtcagtgattagtcttaaaaaaaaaaagcattaaaaatgaaatcattttaaagggagctcattctaaaattctggccagaaaagcagggcaattttattgtaggaactattaatgattaataattcctctaagtaaagatatttgatgcccaaagaaagggaggggcatacctgaaacttcatctctgaccacaagggcagcctctctgtcttctgcttcttcagtggtcctggaggctatgggcactgcccctgcctgcccggggactctgccaccctggggcttggtggagcaggttgccctagctgcctctcttttgcatgtgctacctagttgcctcttactgcaatgtttgctttgggggtggacagaaaaccaggacgttatagctggttgcaagcataaggcatagcaatttgctggtcctgttttgaaagactgtgttttgaaattttgatttacaaaactgctttcatcaccattgaactacctcaaggcacaagttcaaaatggaagatactcaagtaaaagctgtaaagcaaacagcagcagttagagtggcatacggtaaatatgcgtccaggtcaagagccctcactggagaggcagctggaagtgctttcactgggaagtgggagggctgactcaggggctggccctagggtcagtggctggacactgtctccattggggtggcactgggagtagttgtctggacaggcagactctctccacaggggtgatagaaagcagtggtaatttctaaaagtgcctgcatgtctgccatcaccttcagcctcctaagagctgatgggagctggactcagggactgttgccccactgtggagacaaggagtgggtactccagccaagtttgcagtctcaaatcagggttgttttatttgtttttaatacattttaattatggaagtaatatttgcctacataaaaaattcatgtaatttcaaagtatataaagtaagaaaaaaattctctcttccttctccttaaagagaggcagacttagaagtttggggcctctacttccccacctcactgcacataatacatgacacagaccgcatgcatatagcttccaccctaagatgcccaacacaggtatttttcactgaaccatgtaccacagatatttcccatgtttttaaagcaaaatgttggctcttttcaataaattgccattataaaaactgctacaatggactatgcactctacagcacgtggacctctactttatagaggtctctccaccatgagaccatcagctccatgggtgcagcaggaatagggtctgtttctgccctctgttgtgtggctgcacccagcacagtgcttgtcccatacatgagcatgccattacttccttcttgaatgaaagaacatagagtaataataactagcatttgtcaggtgctttctgtgtgtgagacactgttccaaaggctgtgggtgaatacattcattcttcttcacacaactctgtgagacaggaacttgacagatggggaaactaaagcacaaagcagttcagtagcttcccaaggccatgtgacttacgtggcaaagctgggatttgaacccaagctctgccacagtctgcaggctaactatcattaacccctgcaaacacatgcccctgtgtctgcgtgctcgtgttcatggttttgtgggagaggatacaagaaaagggtctgctgtgtcagaaaggatgcacattttaggaacgtgagtattctgcctacccatagtgtgcaggtgtctgtgctgcccatgcccttgcttactccagcattcctgctgctgtctcacactgcttcgcacaaccctcccctagagcacagggtccgtactctaaagactagctggcttagagtgatcatggaatcatggggctgcaaggggttaaagatcctagagtcatttctctcgtgacctggtggtcatgggagagtcgtagtgatgacagtagtggtggttgattgtgccttgccaaagctgggcacattgcttttattactgtctccactgttcacctcttacaacaaccttacgcagtacaggtccaattattattgacatcttacaggtgtggaggaaactaaggcttcacagtatcaggtaacctgtccacagtcttctgacatggaagtgacagggctggggttagacctggcctgtcagagtccagagcccaccttttgaactcccacctgtcctgtcccatatggtagtgctgtttggaatcacatatccagtctgtacagggctcctgactccccctaaagtgccttttccttaataccctacttagatgggaagccaaaccctggaaacctttatctagcatgggttagctggttgttgatttagaacaggttcttaaagacaggtgtttgtgtaatagctgtggaaagggcacttcctctccgctgttctgatgctgagctggattcctagcaggaggggtctggggcaggcgggcgtccattgcgtgaggcaacctggctggcagggctggccgcgtggggccctggtttggctgctgttgctgccctctgctgcttcataatgaaattgcctgtgttcaacctgaaggggtcacagtggccgacttgcttaaagaggataagaagaaaaagaagttttgctgctttcggcaacgcagggctaaagatcatggtaaattgctgagactgagctttctttttccgcaacatctctgataccttttccttgcacataggcattgtgtgaagtgcatgtgccgtgtggtgtgttcagaagatgcctatattttaattgcttgatttctttcttcttgtctttttccaaaataatgtgcccttaccaagatagcattgcagttttctttttgtttgaactgtaccttataaagaagcagctgaaccaactcaaaaaatgtacttgattcggcatgaatattcttagactggaaggcagacttttaaaatacttttccccaaatgatttttttaaatttaaaccgtttagaaattccaataatgttatttgattgatttttttttctccaggctacatgtttcaaattgcttctctgtcttttagtctctggctactttgcccaggactatgccaaagctagtagtggcagctttaagaatgaaattagctggatgcagtggctcacacctgtaattccagcactttaggaagccgaggcaggaggatcacttgaagccaggagtttgagactagcctgggcaacaaagtgagaccctgtgtctaccaaaaattgtaaacaaagaagcaaacaaaaaaatcaggtgtggtggtgcatgcctatagtccccagctacttgggaggctgaggcaagaggattgcataagcccaggagttcgaggctgcagtcagcgatattgcgccattacactccagcctgggtaacagagtgcgatctctgtctcttaaaaaatcaaaataaataaaaatagacttcagggatgcaaagatttgggggcacttgcctttgaaagtgagaatgggctcgtgtgggaaagttatatttccagatatgtcctaaaatgatgctaaacatacccttcctcagaatccctggagtagctgtcaggcccatccccaggcagacagttaggtgagcagctggctccctgccttgctctgcccaagtcatggcagtggttcgacagcagcacaaagctttgcctatgcacaccagcacagtcgacccagttctgccaccaggatcggccctggtcacctgactctggggaaagtctgtttaaggagattcagacagcagggacgtgaagccaacaactaagggaacagaggggacacactgtactcttttctttgaagtggcctctggccccatgggaatgctgagctgagaggttatgggacgcagatgggaacaacccgtggatatctgaagagggttatattagagtctaggtctcatcagaaggcctaaaagtgaaaaggaattaagagattatcagatataagcccttgtcattcagcacgttgtggaccccaaaggagggagaagaggaggtggaacttgcctgaggtgggacagtgagttaggggcagagttggggctgccttttttatctgtagcattcacggaaggtttatgaacaggaggctgggcttgatgcagcacctgaaggtgtctgcaagaagaatggccttcagctaagcaggaaatagtgtcatggacataagaaaaaacatctttaaagactgacataggaatatagctctggagaggttaccaaaaggagataaatgatttctgtccccagaaaagaaaacacccctccttggttctgccttgctgaatgcaggcttgggccttgtgattctttaaggattcttgtgccttctccattgtctttctgagatctgcagggagaggaagcaggctgacacatttaaggaactttattttgagtgggaatggctttttattgactgaaatacctggggactcaggaaggactccgaccctgctggcaccaggtggggcacgagccctcatatggatgctgggctgcccctgtccctgaacacgcggagatagttattgtctgggcataattcttgcttgagacatggaaaccttggtctggccttgacctccattctccaagaagagcctggcttctttacagcagcaagaggctgttactctgtggtggcctaatgtgtctctactagcatgtgcatgtgcctttagggggtgtgtgggcttcttctggatttggcaggcctgtacgtcatggtactgctcatgtttgtcatgaaaataagatgaaaacatgaggtctaggtgtcaggtaccctgtcccctaggaaggcagccacaactcagccactgctcagttgtccagcctcaccccctacccttacctttgaaaagaatgagaagctttaggctgcttggaggtggaaggaaatgctaaaataaattcctgagtgtgcaaaaaagtctgtcctgtggagaacagaggagtgaggctctgaggccaaagacatctgtgaatgaggctactaatgggacaggttctagacgaggctggagggctctgggctcagtttgatgtgtggcaagccttcccttcggggtgccttgactggaggactgaggctctcctgtgacgccctgaggcctctggggagctactgcttcctgtgctgcaccccattctctgggacattctacatgcagagcacttggactcagttctccagtgcaggctgctggctggacccctggcttccctcctgagggtggtgggcaggggctcacttcttgtgccctcccctccttgcagagctgggggaatgcaagggaaaccccctggttgttggtagtaaaaccagccagcatgtgggcgtttctgccttcctgcagttatagcaggtcagaggtaaatggatcttagagatgatactgtcctacaactcatcttacagatctggtagccaagcataggggaaaagaggcacttgtcccattgtcacctgatgataagcaccaggctttcctgacatttcttccatcatttttgacctcatcagcctccatcactgaaggttgatctgagattttgctatacctgttaatggtgaacataattttgaggctgcctgcttaggacccacacatagactcatttgctctgtgtgtatgtgtgtgtgtgtgtgtgtgtgtgtgtgtgtgtgtgtgtgtgagagatttgcctccaaattcacaagcctgacacatttggctgagacgaatgtcgtccttcagcatgagagtagatggataaatgtctacaccttggtgaaaatgctagttgtgcttacctgagaagcagcagatttccctggtttactgtgtgtggcattgcccatgataacatctggcccagtgcaagatcttaaagagaagcaccatgacccacatccacagagtgctccaagtaggggcctggcccggctgcccatgctgcaaaggccttggaaactctaattacagtctgggacatgcagggctgctgtctgccaccatcctctcacccccagtggcacccaggccccccgccaccaatctcagtgcaccacactgtaagcctaagggtctgccctggagctcttcccagagatcccaatgcctggaatagattgcaaaatataggccttgagcttctccagattttcagcaggcaaattgcagtgccagcatcctctcacaggtcacaggctttcctaatgcttggtttttcccagactcactgaaagtagtttttaaatttatataaaaaataaacttctctaacaaagctctaacattccagtttcctgaaatgtgtcagggaagaggcttcacagcttgttcatgtgcagatggcccctggtgcttatttctacagtaggggactggcacttgtcggcaatgtggggaggtctgaggggtctgcctgcacctctaataaggcctagccacttgtcagcaattaacactgaatccctgctgaaggggacaaggccatcacctaaatggggcagtcacaatgctatggaagccagttaggagaagcccatgtattcgggtaatttgcccatggctttaccttcatgagtttgtatgactctttctgtctggatttttataaaagcccagtcgtcaccattgcagcctgatttttgtgctgtcgtcggtcactgagctgatatcctgtaagtgatctggttatatgccagattttgagtggttaataaaggtcatcagaatagtaaaccagcactggtagataatagactcgtttggctttttggaacttgttgatttgtggaattttaagtacataacaccaaaatgtataccagtgaaaccacagtacatacttgaaaagaatggtgagtggaagttaggagagatttctcagtgtcagctgtgtgtcccaaggcattttggcgagttctgtcctctgagaaatcaagagtttgctcacgtattctcagaagccccttctggttctaacagtctatgattcttttctttattttttaaaaacatagatgagatcctattggggctaaaggaagggaaagtcatattaattttttaacattaaaaaaatgaatgcctaatgcaagtgaagggtaaaatgctttatttttaataaatgaggtctttgttatacccactgagcctgatcttttcaaatatttttggaaaaggataagtgtgatatttcttctggaaatattttggaaaaggatcctgtgatagggagtaagtggctggagaaggtaggctgccagggccctggtcagagtgcgtttcctctgcccagatttaggggctggatcaagggctgtttccaggaccaaatgaggtctccaatttctagcgtaggcactgtcctctttctttccgtctgcctctgctcatcctcagccctggcaacatctttttgggatatatttatttattatgtgcctgtggctctttaggtgtcaaacaactatgacaggagaagttgctatgcctacagtaggcaaagttagacaataactcagctaaagacagagaaaatacaaaccaagaatgatggccaaagctgattcagaggtatggaagatggctcacactagatgcgtctgtgcaatgatgaaagtggccagggcaaaatgacactggattggtcgctttgcttccagggagctccaggagagcttttctgagatgatggagttaacatgtgtgggcctcactgatcatccagccctggggacccagcactccgcatgcctcatctcattcttacccttttacaggtgaggcaatggagatgtacagaagtcaggtcacaaacgcggggttaaacttagatctggccaacctgtgcacctgctctcagccactatcccaacccagctgaaggacagaatcagctcagagagcaggaggaccctgcctcaccctcagtggagccctggcacagtgctgtgagactatcttcccctctttgttgctgtttggggagttcgattttacttcttgtctttccccacagttagtctagggagcaactagaacatttcatacactaatagttggcagggggccagaaatgctaactgatgaccccattcccatagaaaatatgtaatttatctgtttcaatcagattgtttttaaaatgaagctttagaattgaaatgctgcaactgtaccgatatcagcatgagacatgactccagagattaaaaagccacaaagacttagtcttttcagaagtttgctcttttgaaaataatgactaatgttcctacatgatcaatattagaactatgagatagcaaactgttaaagatggaaatgaccctcaagattgtggagttcacaccaccattttagagacaggaaagtgaagcctggagagaggtgatccattgcccaggagactcagaaaacaggaccaggcctgtgggttccccacatcatactgccctcaactcctggtcccctcagtcactgcagtaaccaccacggaaaatgccgcacagagttaactcatgatcagatgtgaaaagggtctcccactgtgattttctttgttggatttaacaacctcctcacctttctgctgaatcagagtgaggaacagtcgaggagaattgcatgagtagcttcttgtgtgtctgtgtgtgttaatggagtttttttttttaaggtttttccatgattagagtcgtattttttgtttgtttttgtccagttttttttgtttgtttgtttctgcatgaaataatgaaaaagtaaatcaaggtttgtaattggtttcttctcacttaggaaagaagaaaattattctatgagagtaccagcaatgtaacatgagtctataattttactcacttggtcttaacttttgacacccttgcctcagtgttcctgggcatggcgtggaggctcccatgcaggcaggctcagtttctcgggcactcacaagcggaacggatcagggatcttctttggtatcctcaagaaacttctcagaccactgggttccttgagccaggttccacctctatccctgctgttacctttatgaagtctgctatgagcaaggcgggccgaacacagccccctacgcgagctgcctgatccagctcctttccccctgagcctgggctgggcctcagaatcttcgccatagcgcttccagcccactaccagtatttgcagatgaaacttgaggcatccttgctaaggggagccacacgggcagagcccatgggccaagctttcctgaagacatcgtaaggtctgtaaaaacagtcactacagttcaaagccatgcctcaggaaaaaggaagtacacgtggattctcttccgtgacttcctcttttacctctgcaccccggcagaattaatccttctttactctggaacctcctgcacagacccctgaggtagctctcttcacagctgatggaagtgagctgggggctgcctgtccctcacccctattccaggtgggtgcagtgctgtgtgccctctttttgcccctgccctcctccactgcctgggctccagcacgtgttcgtgatgtttatggggttgaatcaagtggatgagaaaagacgctcgtgcaccagatggtggccctgggtggaccctggacctccacacactagtgggcgtgtttccacatttcctctacttccgctcaggatcctaccatggagaagtgggatgggcccagagaccctagtcatactgagaccagagtcaaccttgccctctgctcactggttgataatgatcttcttcttccactcgtaacactataattccttggtgctctagttgttcttacccagcttactgggtaagaactttctgtgtattggcttcacaagctcagcagaacttcagcatcaggtaaaatagcaaaaaaatagagttcttaactctaaaaaatgttgtgcatggtaccttcatgcactgccttccccattcacaatagctcttctccctcagtatatttaagatgattgactcatgaaatgttagggttattcacagatgttctatatgcaccttttggggcaagcaaagatgtacctgtaaagtacattttggtggcttctcagtgtgatcccagagatgaggaggataaagtggtgctatacccagccacaggattcactttgatcccttagcttcctttcttggaaatgtctagggggatagaatgtcctcctcgagggggactgtgtttcctacaggccatgggtgcagagactcgcctgcagtggagatgcctggctccttggcactcccttagcccagctgaggccctgagggcccttttcaccctcctcctgggttccggaggtctgcctggtggcagaggctcccacctggcctgcctcccaggcgtgcagtgtgccccgcatgctctctgaagcccgtcttctccccacagctagcatgcccaccagcgagactgagtctgtgaacacagagaacgtcagcggtgaaggcgagaaccgaggctgctgtggaagtctctggtgagtgtggggagcacttgccctctttcccctcctgttgtctcagagaagcaggtggtgaggaagaccgcccaggctgcagcagagccccgggccatcgccttgggtgtggcgggtgggaaggctcctcgtaccccacgccacgcttcctcctgtgccagggctatccctcctgcacacctccccaccccccgcccccccgccccccggcccagcatttcacatgcctcttcctgtaagtagagcccgtgaagaatgtggtggttaacctggccacctgctgtgtccattaggtgctggtggagacggagaggcgcggccaaggcggggccctctgggtgtcggcggtgggggtaaaggcctgattctccttccagcctgggtttggcatttgtgcttttgaagaagagcttctgtggcagagttgctgactagaatgtgctacgtatttaagttttcctttgctcatgggaccttcctaacctcaggcctggcggttggatgacgaggccctgccttcttggtgcctggcactttttccctggagccctgcaccagcctctcctcatgatggaaggcaccattgcattaacactcactggcttttttctagatgatttgggctgtggcagctggcgggggggctgggggggaccagcagtgcagaatgtgctgggcactgtctgccgtgggggagccctgtgcggtttggttttgtttgcttcttgctggtatccttcaggtcttatctctgtaaagtgcaggtgtcatttttaagagaactcaatcttactcttggcagagtttcataaaaatgatgtgttatgggcagaatatgcaaccatttgtgaagtgattttgcctccattctcttgctctgccctctctgagacatcatgaagcagacagagaatgggtttgtcatccccactttacagatgagaatgctgaggcccaagacctgctgctttcccatactcacccagtgggagaatggcagtgctgggactcctagtgcagtgctccctctgcggtagtagcagcaaatgctgctgtcgagatgagtggcaggagagactctgctgccttcattttggcccctgcatcactgcctgctgccagggcctgcagggaatctggccgagtcttccctgacctgggcctcgagggtgctcagtctgctcctctggccctggcagcatcctaatttctgctctggccttgcccctgctggcctgctgtggtaaccaggggtgctaagtccaggctgtatgcatggcttttatgatatctcagctgaaatgatggggagtgtgtgctcaagccctcggaaccagaatcttaacactttttgtctttctttcagtcaagccatctcaaaatccaaactcaggtcagtatcttctttctgtttcttcgtcagcctgtgtgttgcctttgtatgttctcacttctgaattttacgtagtattgctctggacttgagttttcctctgtggattataacattgatactgaattgcagtcagtcaattgaatcctatgagcctggcttagggggagatcttaggtgccaaagatctccctcaaagtaaaccaataagactcagtaacgagttttgcctccccattaatcctccttatcctctgagtcattttcctaagagagctgctgcttgtcacttttctgctcgaaagctttccatagaaagggagttcaagaagtcttccaaggtactagcatttcttgatgtgcatgcgggttacgtgttcagttggtaaaactcattgaaccatatacctatgattagtgtactttttcatctgagtgtcatttttcaacaaaaacattttcctactatatataaacactaacttaaaataggcaaagacctaaatataaaatataaaatcatgaacattccagaaagaaaacaggagaaagtctttgtgatcttgagttatgcaaaggtttcttaagatacaacacccagtatactttctgtaacagaaaacaaacagataaattggtctttgtcaaaattaaacttctgttcttcaaaagaaaagaaaaaggttagcttcagacttggagaaaaatatttgcaaagcatatttgataaaggactggtatcccatatatataaagattaatgcataaaggagagtgtcaataatagaaaaacccaataaaaaatgggcaaaatttttaataggcatttcaccagagaagagatgtggatggcagataagcacatgaaatgaccatcagttgttacaaaaatgcacattaaaatcacagttagataccactacacatctattagagtgaatcagatttaaatatctgacaatgacaagttctgacaaggatgctgattggtgggaactttcatacagtgttgatggacatgtcaaatgacacagccgttaaaaaaatagtttggtagttcctcataaagtttaaacatatatttaccacgtttatatttggcccagccatcccacttctaaggtgtttgtataagagaaatgaagatatatgcctacatacaaagttgtaacatgaatgtttgtaccagttttattcatgcttaccccaagctggaagtaacccaaaggtccatcaaatgtgaatgggtagacacactgtggttcaccagtatgatggagtactagttcatgtctgctgagttatgcatcctaggagaaacccagctgtgagcgggacagtctttagtgtccttagtagagtttttccacgctggccaacatgttagaagctgctctttccattggaacctgcacagcaagagtaataataaaatacaccttacttgatccaggttttggtaaagagttggcacaactctttctctgctcacttcctgggttacagattttctttttgcctagcaacacagctgagtcagccagggctgcagcttgggtagcctggagattcctcttgactcaggcccccagaggaagtaccccattgtcgttagtgaggcagcacagcctggagaggactgactttaccaattggctgacctttccacgggatctgggtcactgagctgcagctcatggcacactttaccaaagcatccccttgtggcagggaaggttttctagaaggagacaggctaagggagagaatattttctctaatcacaatcaggaactgaaggtaggtggaggacatgctacttgtctgtttggctgagctcattttatttttatgaaaacacgattcaatattggctcttctcctaaaggtatattttgagcatcactagttagaaagggcacctgatgactcagtatgaagattcatgtcctactcagctttgacaactctgccaggctctggaggaacctcagagatttaagaaaggattgaaaaggttccctttaaaaaaaaaaaaactagctttgtagcactttgctgcctggtaaattctgtatggtgattgagatgctgcaagagatgtgtataataagcgaagtggctctctgcactgattgcatgagcagatccacgtcccatatggtggatataggaactgcatatgtgtgcaagtgtagttttgcatctgcacgtgaatctatgaatatctagattttctaacccacttaagggctgcatatgacagattctggagttatctataagccataaggaaggactgatagcatgatcaagtcaagattatacttttaaaagtcgcattttaagaccaacataatttttatgatgaagtctgttaatttctgtgccatttgtgctcatctttctttcctgcactcccaccccaatctagacctccagagtgaaagccaaattatctctcaatcatatttattggatactcagatgctgtatctgtcatctacgtagtaatgtttgcttgtcttttagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaaggtacaagcagaggccattccttttttgttctgaactagagatttctgtggctgtccaactgccatttggtcttatctgatcgctgcatgatgaagtatcgcaacatttctagtgaggacaaacttggtagaaccatccagacacagcaactaccagagcgagggtgccatctgtgccgcgtggtgaagcaccttggagccacttaatgccaagcatctaattgtcctaaccctgagccaacctaggaccaagaattcttgaagctggaagggacctcgtaatccctgctccctgccctcatcggggaagcttcattttcccctatagtacttctggcaaatggttttggttcccctgctttgaatgctccagcactggggtgtgggacactcatccctagagacagcccattctgggtttgacagttttgagcctttgaaaagtccttcctttcatccagtcaaacccgtttccctctacctctccagcctgcttggtgatattttcagctgttagaaatgacattgataggtgactgcttctgatatcgtcatgccataaatgaattcagacagatcttttctgtgtgattgaatgaaaaaatatgtataacctgatggtgtcaacgcagaatcgtaggcttttagggctggaaggagtcagagattatgtgatgagctgccccttcccattttgtcatcagtgacactgagacctggagaaatcaagtaacttctccagagtcacacacatagctagtagcagaagcaggaccagaacctggtggacagactgtccacgcgaaggccacgtttctgtcctgagtgaggtagtgaagagagagacaaggtattggcgtatttcctgtggggcctgatagggagggaggtgtgaggggcacgagcagtctgagtgtcttgcaggagaccctgaggatgggtgcccctttgtctttccagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggtaaggaaatgtgggtcccactgcaaatgttttatgaacatgaggcggcaaccagtcacatccccgggcaggtgatgttctgctctgtcctgcatgggtgttctgagctgacaccctcatcttgacttataggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccaggtgagtcctccctccattccccgaaaagcacttcgtgagcagcagctaaaactcctctgccttcttgtctgctcacactcaggaagacaaaaggactccatttttgttcatctctgccctaatcatagcctggtaaattttgtgccatttaagttattcgttctgcatcatcctccagctgtctatcttaagtgatgtaatttttttaaagacttctagctacattacaaaataataaaccaaaaaaaccgtttttcacactcaagctcttccaagaaaactttttgattgattttatgaggtttctttgaaatagactctaaaattcttttctctttggtactttttgatggcaggccagttcataatcctagttataatagatttacacaagaagtgaattctcatgcctccatgctttggtgtgtagttggaggaatcagagtggtaggaactgtggcagccattggtcccttctgtcctcctcctgggatgcagtgaggacacaaagattctgagggtgcctgtcctgtggggcctctgcaggcagtagctgagaagggagcggtggttgcagagaggcaccgatggctctgctgctcagagcagcagcacatgctcccctgactctacgctgaggtgctcaaaaccctcctccttggacagggtctgatggggaagtttaaaagacccacctgtcctcattgcttttcctgtgtgatgtgagctgcagagccctgccagagaggaaaggcagcagacagctgggtcctgtggtggccctttccatgcccagctctctgctgtggatgagtcacttacccatttctgaagaaatccagagaccaaagggaatgatctggacaattctctcccacttggtcattttcaggtatatataatctgctgtaagccatagtattgttgtttgaattatacttaaattttggctgctgatcagtgattcttttttaaaaaaaaatttctttcagagaaactggtgtctttttttttttttggtaatgcatgcatatggcacaaaattctaatgttacaaatgaataataattctcccagccagccacaaatttcctcttctaggaagcaaccaccattaaacagtttcttgtgaattcttagatctgcattttctgatagctacaactcagttaagctacctataggagactttccacagacaggagctcactgtacgtgctgttttgcatcttgcttttatcactttgagtgtcctcaagagccttcctgcttggtccataaaaggctgcccctcctttgaaacgctgcgtccatgcggtggtagatgtgccgttgttcatatgaccagtcccttgctgacaagcattgagttctgtctggtcttagcccacatacacagggctccagtaggtgaccctgaacacgcatcagagggcacatgtgttggctgtagatctgtgggataaactcccagagatggaattgctgctttagagggtgtgtccattttaaatgttgacacacgtgcccaagtgctctccttatggttgtattagctcattgtcttcacactgcccattgcctcactgcctctcccctcagtggagagcatgctttgggatgcccatcagttaggtgaaaatggcatttcattgtacttttaaaagatactgttcttatcaggagtgaggttgaacgtcttttcctatgactcagagccatcagtagtgccttttctgtgaattactttatcttttcaaatcatttgcccatttttgtttggttgtgatccataacagtttaaattttaaaaatatctagttcagattgaagataaaggagctctgtctgtcgtcggaagatagcatttttttcattactgttcttattcatctgattctatttcatcatggattgaattatcaagtatgatcagtagagaagattaaatttcaggtcattggtgatatctactcttgaggtagttttgtaaatttacatgagacatttagaatttcctgcttttgtaatttcataggtataattatccatttccacagttgatggactatgtggaatgctatgcagcagttaaaagaatgagatgcaccttctgacacagagggtctccagagtatgttgttgaatgaaaaaacaagccagttgcagaaaactttgcatagcatgatatcctttatgtctgaaaactcagagaagacacctagtgcttgttttctttgtgtgtaaacgtgtttaaatctgtagttgaaggttccagagagacacagaaagagcatgctttctggggaagggactaaaactgggctggggtgtaatcaaaaagcacataaatcttggctgggtgaggtggctcatgcctgtaatcccagcactttgggaggctgaagtgggcggaacacttgaggtcaggagttcgagaccagcctggccaactgctgtaacactctctctactaaaaatataaaaattagccgagtgtggtggtggtcacctgtaatcccagctacttgaaaggctgaggcaggagagttgcttgaaccggggaggtggaggttgcagtgagctgagatcaagccactgcactccagcctggcaatagagcgagactccatctcaaaaacaaacaaacacttaagtcttaataataaggttattttttttcactcaaagaattatctatttgtgtaattaaaaaacagtgttttagaaattccatgggataacagatggatttgttcagtgcaaactggactgtgaaaggcagcttaaaccagatctaggcagccaccgaggggctctaagagagcggctgcaatttgtgaatccacctgctggctgataccagtttggcttctcagatcctgacaggcgaagactggaatgctgtgatgtacgatggcatcatggcttacgggggcccatcctcttcaggaatgatcgtctgcatctacttcatcatcctcttcatttgtggtaactgtatccttcaagccgaccaggctttgttgttgccgtcgttatctggttttgtttttcttcctctgcatttctctgtggtgatggtggtggtagtagttgtggcagggaggtaaatgcctttaccttattagctcaatatctgcttttcttccatgctgctgggggacagcgtcctgtaagcagaattccagagaggctttgagggatgcgctctggctaagagaagcaagcccagggaaggagcgtgagacagcacacatactggtcccagaggtcactcagtttggcatcatgtctcctgtacaggtcccgagggatggctgagcgcaaggccaggtggttctttatgttatcattattgggagcttaggcgtccatctgtgacttcctaagacccttcgtgactgatgagagccatctttgtggactgatctgtgctcccctgggctaatttcactttgctgatctgtccatctttgcggatcaagtgtccattggctagctgctaaatcatgctgcataacttctctctgccttactttaccccttttccctgtcgagaggcaccctctaatcctagacttctggaattggcccttagatctgtatttacctcattcagacccttcctgatcctatagcctttggttctcggtgttttatctccaggtcctccatgcctagcaccagacctggtacacagaggcctttaatgaatgtttgatgcatgaacgacgtacacactcatgatactacatctgggttttcacccttccattttaaaaggtcctaatctggattctgcttctaaggtggcccagatctctgtaggtgttttcttctttatcttgtctggctcactgataaattttcttcagtgtggtaacctcagtgcaaacctgcccccttttctacaaggacaatgctttgtgctataaggtattttataaaaaccccatctcaacacatatacatccttgtagtcccttgactcggctctaaggccccctccacaagagccacccctgccctgtctcccacccagagaaggttcttctacctctgagctccccctcagattttatccacgtctcttactgcctgtaggttcttctgtctactggatttttatttatttattattattattttatagaaggagtctcactctgtcacgcaggctggatggagtgcagtggtgcaatctcggctcactgcaacctccgcctcctgggttcaagtgattctcctgcctcagcctcctgagtagctgggattacatgtgtgcaccaccatgcccagctaatttttgcatttttagtagagatggggtttctccatgttaaccaggccggtctaaaactcctgacctcaggtgatccgcccgccttggcctcccaaagtgctgggattacaggtgtgagccactgcgcccggcctgtctactggaattttgagtgggcattcctccatctccctaactagatggataagcttcttgagtcaggaatctttttgtattcacatctctcaatagagtacgggatcttgcacatagttggcccttggtaaatgaaaggtcattattttctttttctgctgtcctatggttgactctttaggccacagcaacatcctggacttgaatctgcagagaagtattccctggtgcttgtctgtggttgcatgttgttttctttatagcacatgccactgtatcagaggtgcttagggagctgcttatgctctgtcttccccaactagagtagacattccagtgtgtggtgtttcttcctgtgccctcagcacccacaacagtgcctgacacattggaggtacttggtagatctttctggatgaattccagagcatgccactctttaggagggtctgagtaatgcctctcaatacagatgatggattttgctctggaaagttgttacaagcttgtaagatcttcctgtggctcatcactctggatttgctttccactacccaaaggagttgagtgtcatggcaagactagagagattattgtttcttcactgagatcatggagggaatactcagtacagctagtctcatcactagcccctgtccgagttaccattaccccaggcctagcagaggaatgctcatgttaccaagccatctccagcccaggactaattgcttcctgaggctcattgcagctccagttaaaaaataggccagcatgtcaaaggctttttgagtcttaatgtaattcacttacgtttctctcctctttaaaaccttgaatagattagtcaggcgtgctattccctcacagagatttcatcatctgttccttgttaggttatgttggtttacgtgttcagcaacccatccaagacaacaaattgcacagggcgtatgggacagtgctatgctgctcctgtctcggggtctctgggctcctgcagttttgcctgcagatggccgggcatcaggcagagagaagcatttgtcacagaagggggccttctcacttattgccctctcatccctgtgcttctcaaaaacatgcttcactgctagtgggtaagaaacaggcatcttctgatttaggagtcttgttcagaatacttgttaaaaacaaaaacattcaagaaagccatgtatacaacattagagtaagagtgaaaaaatatgataatttgttcagtcacctaaccttttattgtgttttttaactggaactgcaatgagcctcgggaagcaatttgtcctgggctggagagggcaaaaatcaagttcaggtacagtgatcaaagatcgagctgcagtgagactattcacaacagtccagcaccaggtggcagtaagtcagacacattatagtcagtcagtgtttgtggagtgaaggaatgaatgagttatctgtagactctgaaggttatttcaaaggagaaagtctcatactgtcttgtgcaagggcatcatcatttgaataacttgcaacctttgaagtggtctgttttggaaagcactcccctgaatatatatgttgtagttgtagtatgtgtttaaaaaaaaaacccaaactactttttaattataccatgtttatgttatagattgttttataaaatgtataacatagctatagatacgtagatgtttggacacacacacacacagagaaaggttgaaattagtgggttttcatgggttttagtgaatcttaattttacttctgtagactgtccttttacaggtttttacttttgttttgttttgttttgttttgttttgtttgaaaagcagggctctggtactctagttttgctgtgtgagtataacacttgggacggtcacttactaccagcttcccgggatgcagaggtgtgtggcgttgccattgttggccgcacgtagttgcatttagtagtgtgttgtgcccttaaaaagttgaaattagatattctactgaatgtcttcttggccatcgctgtagacaatttggctgatgctgaaagtctgaacactgctcagaaagaagaagcggaagaaaaggagaggaaaaagattgccaggtaaccctattttcccctgacgtgtttgtccaggggctgtgttgggagccctgcaacagttgcagcctgccaggcttacccccgcatcacggcagctgcagcccccgggttgctgctttgtggatcatggttgaccatgcactgcagaccaaaacggatggaatcttgggcagaagccaggctcttggctgtcatccctcggggctgagagtgggagtcacgtgtccccatgcttaaagaatcactgcagttaattttggtgtcataaaataaatgatgcattcaatgctgattagctctcagatgagaattttaataagatggtctgtgtaatgaatccatcgcattgagattaccaggaagctctgagtttgggttgtgctaggctcttgtggttagtgttgtttctaattaaattctgtccttcattggagcattattgattcagaatcctgattagcatttttatacagagtaacatggttatttggtttcttgtgctcttttctcttctctttagaaaagagagcctagaaaataaaaagaacaacaaaccagaagtcaaccagatagccaacagtgacaacaaggtatgtattctaagatgcttctcccctttttgtttcaaaatgatcctgttgatctccatacatgtaccatttacactgtggaagtgtcttgtgtatcattcttgtaatattttggtgtgaagaatatggcacaccatatagaccctggcttcccaggggggattctggttgaatttaggcagttagttgtgtttactgatatttcaccagaaaaccaatatgataaagaattgactagtttgaccacttatgttttctttattggaattgtgcaatcagccctgacccgtggtcaggatcacgttagcatcttctgagtgggtatgaaaatcgcggatttttaatagatgtctgtttccagaggtaatcccaggatcaggtggcctcagggctatactgtaaaactgaatcccatttatgacagccctggttgttttgttctttctctgttcatcgagttgataaatgcttactgagtggctatcatgtatcagacactgaggattcaggaatgaagaagacaggtccctgccttcatggggctcacagtctggcaggaagacaggagtatgagatgcattatcacatggtatgagtgaatgtgctggcacagggcaaggacagagccctgaatggtgctggctaaccacgactgggtcagggttcagccttcttctcacctgccctcaggccttctgtctgaagcagaatcaccatctggggacatctgcctgtccctgcacactcaaatacagatgcagctttggggaggaatccatgccctatgctggaccaccagggtgacttttcctctctgaagtgattttaagtcagtctcccctcctcccaagatgtctttgtcatcctaggttacaattgatgactatagagaagaggatgaagacaaggacccctatccgccttgcgatgtgccaggtatggtggcggaggccggagacgctggctttgctgtgtgtctttgctactgctctgtgaccacctgccgagtctgcggccagccagcccagcagcgtgcacatgagctgctgaggccaccaaggccgtgggaccagttagctcgcctttttcccatggtcacaggcagaatgtgtcactcaaattccaggtgatggggagggaaagtgcaggtgggtcagggcagtcccagcttctgctgggagactggtccaggaggccccccggtgttagcgctcacctgacacttttatatttgactggcacatttattggctgatgtgggtgggactgtggagttgggagcctaggagctgattgagactgaaagtcccacacagtttctcaggctagtctgagcgaggaggttactggggaaacagccaggtgttgggaggttggcagtgagaatctcagcactgccacctttcatctgtggtcagatcttacgctggtgggaatctcatcattcccgcaaactaaacatgctcaccagacggggacacttctcagcaccccccacccctgcaacacacactcagtccatgttctgaaggagcaggagggttttgattcatgtaagcaggtagatgttgttaaagtttaagccaaatttgcatgtgaaattaagaataattcaaacccatatgtagtctttatttcatgcctataaaaaaagtatttcatttaaagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgtaaatactccccttctagtctctcacggctgcctcttgccagtgaccctacaggttgcttgagggtggctcgggtgggggtgaggggaagtggttcacagccctttctgaacctgagtgtccctggcgccctcacccaagtcccctccaacccctctctcctccactgttgctcttgccctcagctcatctcttcctagctgcctccttcccacaggggtgtggccaggtcctgggaggagctccattctaggttctcctccctgccttcacccctgcatggggacagcaatggggaaagccttgtccaccccagcatattccagctggagctcactgctctggtgttccatgcttcggccagccgtggaaatttttcctaatgagtggatcttctgttaggatgccttgtgggatgagaatttttgtgaccaaggtccgcatagcatcctcatcctcatagatcccccacttgattgatcagttttcccaattgagttttatctttgtaaagtcatattgcacagtgatattttatgggttgtaagtattcagttcagctctatgatagtctacttaaaatagcatttctcatgttaaaatgataaggtgctcacaaggaacagggtaatgactcacaagtactataagaggaagacgtttatttactagctagtttctaggttttaaatcatctgggactgagtggaatgccaggggaaataaatggctcctggaaaggtttctagaattgcagaagtagttcttggctgtcagagaacaactctttataattcattggccctagggagacacaggtgggaagcaaggcctgctggcatcctcagagatatgaagatgtgatggtagcttttacagctcaccactgtttgggtgttctttaaaaaaaaaaggttattaaactgatattgctgacacctacagccctttgtgtgtgtgtgtgtgtttgtgtgtgtgtgtgtgtgtgtgtatgtatgtatgtatgtatatgtatatatatatacatatacatatacatatatatatgtgtgtgtatatatatatatatatatatatatatatatatgttgagggaatgcatttattttcacctaaagctacaaagcactcctgccctcactagcttggaagttctttcccagactcaactgctaaccaccttcaggtcctcaggggggtacgcccagcattaaataggcccaaaagggaggacttgaagtgaggggtcgccttacataaagttgactccagtttgaaagtggaaaaaatcttttccaaggaaaagctatctatctataatagtcttatagaatacaggaatacagataggtatatatacatatacacacgtatatactttagaatttaaacatatacatacatattttagatatacatatatacacacatatactttacaatttaaatatatgtgtatacatatatttatgtgtatgttttatatatatgttttatgtgtatacatatatgtacatatacatacataaatacatacatgtgtatatgtatatgtttaaattctaaagtcaaacattgagggtatggataaccagttgctaaccaggcgcagggcacattgaggacagcagcgaggttctgatggcccagagagccatcgtttgagcccaggtgtcaggcatgagccaccctccattgcttcacgagaccacaggacttggtgagaactctcatgccgggccatgagatccttgcatgttagcaaatgatgctccaaccttcactttctgaggactgcttgtgggtcaactccaaaatttaaaaaaataataataacatctattacaaaatctgcagacagccagagatgtcctgaagtctcagttactgcaggtcactataaatagtatgaccttgcacctgcaagacaagcctgggattcatctcattctgtgtgaactgttgagggcaggcctggcctcagtttcctctctcagtcagggaagataaacagatgagtttcttgtcatagtggaaaaacttcagtgatgtagacctggatcgattctgcccctggtccttactagtgtcactttagaattctcttattaagcctcagtttccccatcttgaggaagacaacaagccccacttccaaggacttggcagagtggtctgtgtggcacccccagcacagaggtgacacaccacccacagtccacaggttgcctttggtgggcttcgagaggctgacggacaggttgctcaggtgtgccgggcagggtgcatgggcagcacagcagacagctgccctctgcctggcctcttgctgcagtggccccacactcttaaggacccagtgtgttccaccctatctgggactgtttccaagcagcggcttttccctgcaggatccgcgtaggctgccacaagctcatcaaccaccacatcttcaccaacctcatccttgtcttcatcatgctgagcagcgctgccctggccgcagaggaccccatccgcagccactccttccggaacacggtaagtccccagggtggggctcgctctgggatagccctggcctctctcgggcagaggccactgtagagatgggagctgtggaggccctcaaggtgacagctagagtaggtctttccttcagctggggacgttggctgtttccggtttgtaagtgccagagagcttgtgttttagctgggtaaatctgaatggaatcattaacttagaacttcatcttaaatactctgcaggaacggtcagtgaattcagggagcctgcttctccgcctctttgctccctgctgctgatatttaggtcctcctttccctccctgctcaggtttacactcacccctgttttgagattcatgcctcgtggaagcacacagcagggaggaagcagaattcaaaccaggcacaccacatgcccaggctgtcttgttcagggttggaggcaagatgcctatgtcgtgtagacttaaatacaccaagctgctaggctccacgactcaggagaaatacaagttagggagatgataggatgtcaagttgaggtgttcagtggagaagaacattaggccaggtgcactggctcacacctgtaattccagtgctttgggggatagagggggaggatcactgaaggacaggagttcaagactagcctgggcaacataatgagacctaatctgtacaaaaaataaaaaaaattagctgagcgtggtgtcacatacctgcagtcccagctactcaggagactgagggaggaggatcgcttgggcccaggaggtcaaagctgcagcaagcaatgtttgcaccactgcactccagcctcagtgatacagtgagaccttgtctcaaagaaaaaaaaaagaatatataatgaatgttaaaaaatttcttctctgggaagatttattataaaatatgtgattatgttatatatttcacaagtatctccaaagaaagtgctgaccttggccccagatagccaatattaagtttgagtaacttcatgaagcagagtgcaccaggcagagccacttggacccttaagcatgttaacttagcggtttacaatattacttttcattggtagaattaggaatatacaaagagttattaattggctgggcgtggtggcttatacgtataatcccagcattttgggaggccaagacagtagaatcgcttgagcccaggagttcaagactagtctaggcaacatagtgagaccccatctatataaaaatttaaaaattagccacacgtattggcacatgcctgtcccagctacttgggaggctgaggtgggaggattgcctgagcacaggaggctgagcctgaagtcagctgtgttcacaccactgtattccagcctgggtgacagagcaagaccctgtctctaaaaaaaaaaaaaaaacaaaaagaactctagattttggtgtggcagaggtggctatccagttagccctctgtatccatgggtttggcatccatggattcaaccaaccacagatagaaaatgtttgggggtggccaggcgtggtggctcacctgtaatcccagcactttgggaggccgaagtgggtggatcgcttgaggtcaggagtttgagaccagcctggccaacatggtggaaccccgtctctactaaaaataccaaaaattagccaggtgtggtggtgcacgcctgtagtcccgactactcgggaggctgaggtatgagcagtgagctgagatcgcaccactgcactccagcctgggcaacagagtaagtgagactctgtctcaaaaagaaaaaatattttgggggaaaaaatgtactgaatttgtgcagatttttttcttgtcatttcctaaataatttacatggcatttacttgaccttgggtatcttgggaaatctagagatgatctaaagtctacaggaggatgtgcatagattatatgcaaacactacaccattttatatcagagacttgagattttggggtctgagagagtcctgcaaccaatcccttatggatactgactgtactaagaaaacaagtcaagggaccgggagcagtggctcatgcctgtaatcccagtactttgggaggccaagacaggcagatcacttgaggtcaggagttcaagacctgcctggccaacatggcgaaaccccatctctactaaaaatacaaaaattagctgggtgtggtggtctgcacctgtaatcccagctatgcaggaggctgaggcaggagaatcgcttgaacccaggaggcggaggttgcagtgaactgagatcatgccattgcattccagcctctgcgacaagagcaaaactctgtctcaaaaaaacatacaaacaaaaatacaagcaagtcaagggttttctattagttagttttgtaacttagagatggtgcccgctgactgtgtctgtgttgtaaggaaacttgcacctaaattggctcttgcctcagcagccccaccttagctgtgcagcttactcggcactgaggaccattcaaaggcaagacggctagaagcagcagcctgttgactctcaggcctagatattatcgtgcagtttcaggttattaccaagaaacccgaccagcagagggaggctggcgagtgtgcaagcatcaggtgtccctggcttgctggtgggcacctttttctgagcaccaggttgttagagattttagggttaagacacacctgcagatctgtgcctccaggactctgttgggacaaccaagcctcatgctgttgcttcccatttctggagcctggcaagccctacctatcagatttatgaaacacgcactccgatatgaagagaaaaagtgctttccccatggtgcgtgttagtgtcaatataaagaggaaggcactgggcctgtcttgatttgtcctcacagattagggtttttgttagagagggtttagttgctctagatgccccaatagaagaaagacctctgtgtcatttcattccatcataaaaaaaggacacaagggcagtgtttggaaaaaaacagcattaggtgacaaactaggccaggagctagtctaggattcgcattgacaagggattaatttacatgggggtttcatgtcttatttttaattataactgcttctccataagtttatttccctgctgccttacccaaaaatgttaccgttctgcttaaatagatgtacatatgtgtatgagtattgctttttagattctgcagtgttttgtatgttttttaaccttagccgaattcttagtttaaaaaagagagcgagagaatgcaagcagagtgagggaaaaaaacagcttaaatttcaacttcagccctggcgccaggttgccttgtagacttgtgggctgcagtgtctttctgggctactagatgctttccatgttaatattcccactgtgacctaggaaggagtaaggaaaagttggctgaggcctggcagtgcacgggaagacaccttccatagcctggccaagaaactccattacacagaagtggtcccacagaattcataagtccaaaaccagaaacagtttggaaagtgaataccctctgaagagagagactgggcttgaaacagaggtcctcgcattattgtgacacagcccccaggcgactcctctacctacaacagctcacccctgtgactcttcgctggcatacgccaggcctactccttgctctgcagtgcctgtgactagctgcgtggcctatgcgtgtgtccactccctgctcccagcagccacatctgttaaaggattaggcctgggtggtctccacagtcccttctagctctggtctcttcagttctttcaaaaccatagatcatagttgtcatgaagatcagtggccaagaccaactcgcctttgcagataagggtgctacggtcagaagctcctggtgagcagctttcctggtggtcagacttcttgctgctggcccacttgcctccatggctccgaggagaagcagggaccccagaaagggctagcaggactctgctgatgggataatagatggtattgtcaccaatgaggatagagttgcctggactgaaaattcaaagaccaagtcagtctgttatttgagtgggcccagcaaggttttttaaaaaaaaccctgagtttagagagagcagtgtgagatgcagaacaacgggcaggagtgctggagaccaccaatgcaggagtctgtaaaaccatcccttgcagacttagccagcccagcgcatgagcagggaagggtgctgacgccctgattacacaggctggaatgcgagggggcatatggaagctactggctccgacagatgccgctgccatcttcatttatgcttctccaccaatctgatgctcagatggagggcaacatacttcattcagccagaaacgcggttaaaaatcgaaaatgtgtataagcctctaatttatttggtgccacaagtcgtttgtagatgtagcactctctgatgagaaaagcttgttaacaaagcactcttagaaatgagcctctctgcctgtccaagacacaagactgggaagcaagtcggtgagtggttaaaggaggtcaggattctcaaacgctctttgggaatgatgtaattgaccaaagtgggcattcacccgtggctctgcacttaccttcagaatggcagggttttcctggagggatgggtctctgactggatcgggggtttctgcctgtaagcatgcagatgtcagagtttgtctgaattccttttctcactcccacatgttgtgccttgcagatactgggttactttgactatgccttcacagccatctttactgttgagatcctgttgaaggtaatgaattttccttgatcttcacatactccacagcagctggagcaataatagttgcacttctttgtttgccttccagatgctaggttacgcagactatgtcttcactggtacttttgcatttgagatcattttaaaggtaacaggttacccggcagtgtgtttaagggctgctcctgcgtgtgacacacaggaaagaagcgtggagtgcttttgattttttatgggttttttttttgtctttcgtggttgagctaagttttttttttttgttttttaaaccgaaggatttttttttcctgtgaccattccaacttgtttttgctctttttaacctttgaatgcatgtaggagccactctggcttcatgatagtggttgagaattacattttgctcatttaaaaaaaataccctctgtaatttgtcaactgataacacatatatctctatgtgtgaacttttttccaccctttctgacatcaaagtcagaggaaaagcatttatcctatgaagaggatgtctctctttttgtttctctgactgcattatgcttttggggacctaaaatagtaacacactattttcttgcaataggatttgcaagatgacttgggtctatttgtgttaaggtattttctgtctgttttaatggatgggcttacatttacacaaaaggagcgccctttggccggggtgacctaaatgtactgcccatgcatgagctaatggctgccattgctgcttgtggtttgtggactgactgtgaagtctgccccatggggagcccattccttatgtgcttagagtgctggagaccacagcagagctccaagaacctatccaaaactggccaagaaccacagggcgtgggtcattgtggttctgggagaacgtggcccatcagaactgtcagggcaaccatctcctagcaggaagacaagctgggaaatgaagacttttaaccatggttttctttaagccattggggaatttttgtgtgtgcaattcaggcaaaatgtattttgcatcggactactgtggaacttgggctctttacaaaatcttatataaaatgaaacctcaattaatatggtcagggaatgaggtggttagttttttgaggttggtttttttatttttttattttttggttcatgaaacagcataaagccaaccaacaactgtttacccctttcttaaaagtcttctaaaaatgtgagttcattttcctgcctttaagccgatgaatttggttgacacttctcctaagtcagaggtgtgcagtgggatggtgaccagctcttgttgatgaggcctctgtgggagggcctgtggatgcagaatgcacagtggtgggggtcggagggatgccgccagaacactcaccggctcagcttctgcctcagcttcttggttttagaatttgacttcttttcaaagtgaatggggagctgttctacttagtctgttagcctggttaattgaggttttattttactctccacattttttagttgttaaatgaatatagttacccttgggctttggggaaaattagacacaggattatttaaaaggaaaaaaatgattgttactttttaatttcggtagaattgcttcaccgacttaaatcttctgagtcattcttcattttgaaggtattttagagaatggaaaataagctaaaacaagaaggattcagaaaatggagactcaccaagaagtgtctaatatctgagacgatggttcctggtggccttggggacatttggaaggctctttggttatttgcttaagccctatgaaattgccatttttgtaggtcaaaaagggttgaacactggcgatttcataaggttcaatgtaatatttcccacctctacctctcttatactgtacttacctgagccttctccaaccttttttgttttaaaataaatagtgagctgtatatattttgctatttttactttggggaactaaactctttttccatcaccaatagaaatctcactgaagcacccataataggtgctccaggtacatgtggcaggtgagcacagagccgttgagactggctcaggtgagatgccacctggcttcctagccatgcctggcacgtgtcatcagacttggaggaattgcttaagatggatgcgtcattaaagaccattaggaacaataaggggcctctgtggaaaagtgatgtaggtccatagagcctgggagccctgaattcaagcccccactggaaaggcttaattgaaacaaggtaggctctaccagggcctcagaggggccagaaccagcactttgtggggaagtgggctctccggacagcacttaccttttgacgaatgtagtcctgtggagcctctcttagacaggctctttggacatgccaacagtgtattcatacttgaaacctgtgatcactgtaataaagcctaaattggtttcttcttttaaaatgtatccaaaataagctgcccctttttgatttttgtttgaagaaattatcctgtggctcaaccccgttggtttacatttctgacttcttaatgcacacttgttaatgaagttatactttcctcaagattttgcaaagagcccaggtttcttttcctttggagacaaaaaatggtaaatcatccatgattctgcttctagatgacaacttttggagctttcctccacaaaggggccttctgcaggaactacttcaatttgctggatatgctggtggttggggtgtctctggtgtcatttgggattcagtaagtattctggggtgtgtgcccagaattgttgggctgaatggtttatgtaagggattttaacataattgataaaggctgggcatcattttcatgattatatttagttatataggtttatttaatttgctcccattccagaaagatttaaacaattcatgttttcttgtgtgtgtgtgtttttttctttttgtgcctgctgctaagttgagcttattactgtctgtgaaatttgctttcaactgaggtgaaagaagtgttgactaggagggagggaatctaggttctagtcctggttcctccaaaggctgattccagggccttgagggcatcctctctcaggaaccctgtgccccttttatataggaggggctgggaccaggtggcctttcagtttttccagcttagatattgagaacttcctttgattttcaggatatagaacctgctaggactttttctttggcctcaaaatttttcagctaggagggagccaaggctgaaagtcagggccccaggtcttttccatggcatttagcgatttctggtgggaacagccattgctgagtactgcttaccatccccaggggtgtggggcagaggctccagtagagcatcaggtgtggccttgctttcttgctggcctgtgagcacttctgttcaggtgctgagcatagaatctcccctgtatgagcacacatgcacacacctgccctctaagctaaagagaagtggaaaggacctgccctcctaggaagaccaaaaacctctgcttggaacagccctttgtgttatccttctcgcctgccactgagggaaccctgtgatcatagcttggaaggccatttgcattaacatctttgcagctcctattaactcccaggctgttcatgtccaagctgcagccttgcccacttcctcctgagcatgtgttctggccacactcagccacctagggtaaagcagaaagctgcattctcttgtgtcgcatctttgtacatgctgctccctcacactggagcccccctccctattgtcctcgctaacccctactcctcctttgggactcacctggctatcaccacccccaccccagagtccttcccaggctccccctgccccacccccacaggttgtgctcccctggctgagcacaccacatttacccctgtcatgtgccacactgggttgggattgcccatctctccaccagactgtgagctccttgaaggccagagaagccctggtaccaaagtgctacagcagacctccaaccttaaacaaaaacaaatgatatatgaagcctaaaagccagctactacctagtatttacagtgagtggaaagaacaaagagagttcgtgagttgtgtctctgccaaggttagctgtgcacctgtcagcctctgtgagtgccatgggctgggcttgggaggtgctgcctcgtgtgggcggggaggagaagtcgcctctgagtcgtgaagagagatcagctcagcaccacatggatcccacgctaactgtgcagggatactaaagtgaagatccagtgaaagggtgaatctcaaagcatcctgtccatttataacacgctctgcctgccgtctttctgctccttccctagatccagtgccatctccgttgtgaagattctgagggtcttaagggtcctgcgtcccctcagggccatcaacagagcaaaaggacttaaggttttgattcctctcctcccggctgggctggcttgggttggggttggctgtaattactggctcttctgggcagagctgagctgaggcctgatggatttttaaagtgagttataaggacctttctaaccaattcagccacctgtgccaagtgctaatggcattttaaaaattattatttattgtctttatttttggtaattgaagatatttttctttgtaattattgttcatttattacctttttattagtagttctttgtgtttattttagtcttttatttagtttatttagtctttcagttttcatgtagactgtataaaaggctactgggtttctgttttcctgagtcatttatggggtggggaccctttgggcccatgtgccaggcagcactgcacctgtagcatttcttctttttttttttttctttgaaacggagtcttgctctgttgcccaggctagagtgcagtggtgtgatctcggctcactacaacctctgcctcctggggtcaagcaattcccctgcctcagcctcctcagtagctgggattacaggtgcacaccaccacgcccagctaatttttgtatttttagtacagatggggtttcaccatgttggccaggctggtctcaaactcctgacctcaagtgatctgcccacttctgcctcccaaagtgctgggattagaggtgtgagccactgtgcctggccaacacagaaactgtcggctgatgttagctcacctcaaggccaaaatcacaaagaagagtcacgcccctctgccctctccgcagcacgtggtccagtgcgtcttcgtggccatccggaccatcggcaacatcatgatcgtcaccaccctcctgcagttcatgtttgcctgtatcggggtccagttgttcaaggtagaggaactgcctccaagcataaaactcaggtggatttctttaaggagaagcctgcatttacttaactgcctgtctattttatacccaggggaagttctatcgctgtacggatgaagccaaaagtaaccctgaagaatgcaggtgagcgtcctgagagtggagtaggggacttagaagagcaaatagcagacttcaaggattcacacatgttggcacgtcagaagttttggtcgtgaaataaaataggcctgtgtgctcagcttgtgggtagatagatggtgtttgtttttcattgaggtgaaattcacgtaacatcaaccattttcagtatacagttccttagcatatagtatccatggcattgttgtgcaaccaacatctctatctagttgcaaactttttgtcatcccaaaagaatggctagatggcttttgtggtggagaatctataaatgatgggagttgggggaaccctgaaataacaattatgaaatgccccaaatagcttccatgacagccatgtggatgatttccccaaatcagaatttggaactcaactccctggtgtttgggaactggctccctcttcttatacactttctagacttcctctctcctggctcctattacctacatcttggccatatttccatagacaagaactggcagaggagagacaaggtgggagatattcatgcctcccattccaggatgtccagtgaccatgaaggcagtcatggaagccattgcctaaagtttcagactgtgcagaggcctgtgtctccccacccgcgagagacataactgactgggctctggctgactgtgcctgtacattggtttggggtttattttaagcagaaggtgcagtcagagagcaccaattgcaatttggctgtgtctctgcacctccagaggcaccgttcacacaccgttcatggcgtccctggaggtgagcagcctggcattggcgtgaggacactgtttcttccctcttgaagcctctgtgtcttcatttgtaaaataaagatattgcgctttatctcttgggttccttccagaaatgaagttctgggagaaataatttgccagaaataatgcaattctttcggaaagaaaattgggaatgtcattagtaagaagagaaagggatttgattaaaactaaaatgcaggaagagtatacgtgggttcgtttcctagagcctacagagttctctatggctgagctttgatccttcagagcgcgcctcaagcccattgtgtaagagatgctctcaccatgctgtggtttttatcggccaacgacgtatgcccggtgtctgggtggctgctctggagaatacacgttgcactggtagttattcaatggttatttgagccgcgaagtagattaaatggagggcgaggagaggagaaacggcgccggtgttatgctcagctgtgtgacaggcgggcggactgagtgtgacctgcctggaggttggattggggcagtgtgtccaactttacgctgcttccacctgtcatgtgtgaagccagacgacccacacctgttttcctctccaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgtaagtacagggagcacacagtcttctggagaggcacctgcgtgcccagggctgagccctccctcctggagtcagtcccatttctgttctccagtgtcgcaggattgccctgtggctttttaaccttgggccacttctcagtcacttcttgacccacagggcctctttctgtgtaggtggatgatttgtgaagcagggttggtagaggtgcctggcagcatctctgggtggaagcagggaggcctgagatgcctcagtcccatgaactcccattggatgtcaggaaagctgccatccgctgctcccaaagagggtctgaatggtgtcccaaaccattcattcattcattcattcattcattcattcattctaatatattcccagttgcggacagttgctgttatgccatctcttttactgagcacctgctcgctcatttacagaccatgctgtgcagaggcttgtgtctccccacccgttaaaaatgtctaactgggctctggctgactgcgtgcttagataccagctctgtgcaacatggcatgttaggcactgtggaggaaacagtgtctaaacatgcttcctctcctcaagcccaaatcaaatcagtgtcaagtggtcaaaccaggcaggtggtctggtgtgtcctagatgtgcagaacagggtcctgaagaatggctaagatgttgatgggtaaagtaagaagagcaggtaaggagaagttagaatttgaaagggagaatcctctgtgctttcgtgttgctctttgcttctggagctcccacccccagctcctgccatcagtgtgcaaacacacctagagtcctggatacccggtccccatgcatagatgagctgcaggaggtgggcaggctggggctcgcaggccagcagagttcttggggtgtgtgtaagagtcagatattttcaggagctcctgtaggataaagagacagtcaggtggggcttgttcattagggatttaatcctgggagaacagaggcatggagtaaggcccttcactgtgtgcaggcacaggctatagtgtcaggctttgaacactgtacttgagcaaatcatggtggcagctgaggagaaaggagcaaacctgggactcggggcttggaggaactggctcaactcctggctctgcccccaaggagtgtgactgtggcactttgatacctccctgaatattcctatgatggggatgatagtaatgtctgccttcccagatggatgtgaggattaagggagaggctgtgaaagtgtctcgggaagcctatgcatgggctgggtgccccagaagtgttgaatctgcatcagaatggggatcaatggaccccaagggtgttacagtaatccccctcttcctgttaagagttccgctaggcatagctttaattttagtgcatatctctgtttggggaagcacccttagttctttggaactactctggttggtcacttactgtcttgccagtgtgcatagttttcacttcctccagtgtcttacacgtgatattcttcctctctgaatagaaaggagtgttttaggatatttgtgaaatcttttgattttcagttcctcagaacagtccctcgatgatgatatcctgggtgccccctcctcttagtgctggctgtttgggcctgaggctgatgggagagacctggttgtgtccagcagccttggggtgggttcccagcgagtgctcatgagaggagttctggagagggaggacctgggaaggcagcgggctgggccgtgtgggctggggggcttggcaggtcctcacttggtttttctctctctaggttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcaggttaaagtcacacactgttttggcttctgtcccttggtcaggagcggagtgccttctttattgactgatttcccccatacccagagaagggcacccacatactgtctgtccctggggctagggccctgttctaagcacaccctcagcccatttgagtcatcactgctgagcgttaggtttcccgatacatatgagactttgtaattatgaaatccatcgccagacctggtggtatgaaatcagagagtgcttacgccacctgccatggtcatgacccactagtgatgtatcagaatcttagttggggtgctgtggccactcacacagacattcacagtccctactgggagatggtctttaaagccacttagggcagtttcttacccttggtgctattagcatttcagtctgggatgattcttggttgtgtttcctgggctttttaggctgtttagcagcatccgtggcttccagctgttagatgccaatggttcgtcttcccctggtagcagtaaccaaaatgtctccagacattgccaagtgtcctttggggggcaaagctgccccttgttgagaactgctgaccgaggggggaataccctgcatcaccccagggaagtcagtaactttgaatttgggactaagattgtattggcatcattcttgatctgacaccgtgttttagccagtctggtagaagtaggagccttttgctcgggtgacgtggtgaggagagggagccctgtgctctgggctatcttcctacacctgcactgtgaccctaggtgccctctgatccctgctggggcttgatccctcatctctaaatcgagggcattaaggagctgctctttagagattccttgcagccctgaaagagtctacaagatcgagattcttttctgggagtttccccgggtcctctatcagtagcatctctgttttgatgacgacgtcgcaagcaagaatgatctggtagcctaggcttcctcagaggaagtggcccaggcacggcaagccaaccatagctggctgtacccactgggaaatgtgagaacatgccggtttgtgtttgcaggaagattttcctttgagttgtcagggtgtccctgtagactccaccagtgattgtcagggagaggtctggcccagcaatttgctcacccaaggaagaggagtgtcagagcaaggccaggccagccacgcagagccagcgctgaaagtgtgtcagcctctgaggtccagcacaggcttgaattgggggtccctggagtgagcatgtgaggtcagagcagcgccgggtcccagacactgggaacctgtccgaagcctgcacccagagtcaaagcaggagagcgggggtaggtctaggctctcaatgctgagctgagggctcttggggctagaggttccctctgggcctgctgcagagggtggaccagccccactacccagagtaagtgagaaagtgctccagctgggtcccaacctgtgttcaatccaattgtcactacagtgctccagctgggccctaaactgcgtccaatcaatccagctgtcgctacagtgctccagctgggccccaacctgtgttcaatccagctgtcactactgaccacatcctagggattctgaaatgaacacaacaagctccccagcccagaagctccccgatggacatgtggatagctccccataagatgtgtattgttaacacactctggctcctgaagggtatctcatgtggttccaactgggagcatccaggaggctactagtcttggggaatgagccagcccctctcgttcttgtgagtttctgtggttacttggcctcctttcctggaggacagcacaggcaggggaactataggtgtgatccacctatagatcccccgtatgtgtgataaagaggaaaggcagtgataaggcctggacccagtcctcactcctgcttgtgtatacactgcagggcctcaggaaagacagctaaaagctctgagcctcagtttttagtaagcaaaatggaagccacatgggtaggcacccagcttacccggagcttgctgggagggtcagcgaaggtaatggaggcagggccctcggtgactcaagagtggtgccagcagcaggaagggggtcactcgtaatcattttcaccatcgtccacggccccttcccgggagctgtagggtgagctctttcagagcagatgaccacggggtcctccttccctgcaagtgctcagaaccccgtttctgcccttttctgctgttgcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcaggtaaaaatggagacagccgtggggatcaggtccgggcattccgcacagccccgtgccccaaatgctgagggtggaatgctgcccctcacaggaggggtttgatttttctgatgagtctgggctataggttggccagagttctgttctggctgacagttgtcacggtaggagtttaagatagttcttttgttgaagaaattatccgtacagcatgatggtaggtaacatttccatggagcctggcattggtgctcaattctgtaaacatttaccatgggcctcctgtggccagctagtggttgagaactacagctctggagatacacagctgtttcaatcctgattttactctgaattttttgtgacttggggaaagttgtttaaattccccgaggcttgatttctttatcagtaaaatggggaaatctgtcacacctacgttagagataaggtttatgctgtagataattcccctcagacactttgttttttattttttgccttttgtttttgaggcagtctcactctgtagcccaggctggagtgcagtagcgcgatctcggctcactgcaacctccgcctcctgggttcaagtgattctcatgcctcagcattctgagtagctacgattacaggcatatgccaccatgcccagctaattttgtatttttagtagagacagggtttcaccacgttggccaggctggtcccgaactcgtgacctcaggtgatccgttgcctcagcctcccaaagtgctggtattacaggcgtgagccaccgcgcccggcacctttggacactttgatctgggcctgtcacagagtaacactcaatgttggaaaacaaaacataagtcacactcctgtcctcaggtggctctcagcatggcagtagggaattttccagttgatgaagtgttgagtttgacctgagttacagctacttcttattccagtgggggcaagaaatgcaattgagtttaattggccaagtcagattatagtatggtattaacagcgaatgttttcaaaagttacattgcctagtagatactctacgaggacaggaagcaaagaccaaggtctagagccagcttttgcactgactttaagaactccagcacatcaaaccagctctcagtgctgtctggacagtaggtctaaagatagggataaattttctggcatttttcttaacctaagagttctttttgaatgaaaaggactgtgtgctgacgtagaagaaagtgtaaaatcaagaaaacactgccttttattcaacataaacttacatggcataaaatttatccctaaccaaattctacctctattcatagacattttggtggtatctgcattgtgctctggtcaaggccctcaacataaagccctgccagaagaaagggtgaattccctttatcctgagcagaggaaatggatatgttttcccccttcatcattcaatcatcctcatcttgtcacagaccctcctgcactttgtgggagttcaccacatgaccttgcaatgccggtggaattgcccagcgagggtgctgggctgtggaggatgcccacaggggcacagagggctgggagcctccatgtgcaagcatgtgagatcgtggctgaggctctgagaacggtccctctgtcttcatccatagcactacgagcagtccaagatgttcaatgatgccatggacattctgaacatggtcttcaccggggtgttcaccgtcgagatggttttgaaagtcatcgcatttaagcctaaggtgagttgcagaacccacttttcaaaggttgttgctgagtcaccctagagaagtacccgcttcctgttagtcttgtgttactgaattatgctaaagtgttctggccgctaactgggttaccacctgagaacattaaaatctgattagagcatgtgtgtatatatgggaaaatgaatctgcaagaacaaaacctcatgaaaacaattctgagaaacagaagcagggagattagaattgggaatttgtaaactgcagattattttgaaagccagttttctgtttctagaatagtacatatcatgctgtgtcagggaaacctgcctcattacttgagcactagagaaaatgtttgaacataacccatcagaaagaatttgaccctgattatactttcagatatctagtctaaagactttgttttgtttgttcttggtctgcagcatcctttttaccctttaagggaagtgctgataccagctgcagacctctcacagccataccatcttttgtttgcttaatttagaaaaatttcacttgactttaacacaaaatgagacatgaaatgtgttcaactgtgctcgacgactcagcgtgttgtacccctttgggagggagtgaattcagttccccacttgtcagtggctgccagatgaggggcagtgtagttcagtgtcaaattgcatagttgtggaactggactggattcaaatctctactctggcacttacagctgaaacaagttcctttcttccctgcgcctcgacttcctcacccataaaatgaggacgctaatagtgctgtttcatggggttgtcatgaggagtaaagagttcccatatacgcactgcttaacagagtgcctggcatgtagcgccacgctgcggactgtcggccactgctgttcctacccgcaccaccaccctcatcatcatcaagcaaggatgttccctcattctaaaagcctagacagaagagccacaccaagctgaaatgtgggatatttggccctcattttctttcccagtacagccaaaaactctcagagttagagatgacagagttcagtgacccagttagttatctctgtgtaaggtatctgacgacactgatttaattaagttaggcatggattatgaaatggatggtttcacatactccatagttacatgaaattctaattccaaactgttcctttctttaatttgaattaatctctatgcaatctttatcagatctttgtggaccaaaaagaaaggacatttgtaagtgattaattggggtgattgcagtggggtcaaatttggcacctaatgcatggccagatgttattatctactgtgacttgtccatatctacatacataaacatttcctccttttccaaattcatcttaatttcctttgagattttggtttgcttccctctcacctttacttctttgaacaatatttgtctggactgatggaaaaggttgcaaagtaagaacatcgaaggtacttgagaaatgcaacatggaacctctctgtggaacatttcccagatacctgggccatgtcttcccttgccagatgattaagctctgaagtttttgaaagcttgctctaggctgaagagaaagcacactcacccatggtgtgtatgtgtgtgtgtcagtgtgtgtgtgtgcacatgcgtgtgtgttcatgtgtgtgcttgctcccttcagccggccagtgcattgacagcccagtagtgcactgcccagtaggctgacagttgcccagaagatctccaaacctgggaggagagttcagtagcgcgtgaacagataggcgataccaaagggaagtgagtagctaagctataatcagtactgatagatcggagtttttaaatggttgatttttgctggaaattgtactgcttgtagtttcactcagcaagatatcttcatagcattagacaacctcacgttacaattgggagaacttttaagacagtagcagcagcatctccacacttgaagagcactgtcactgcgttccccccggccaggggaggttgagtttatatcgtgtgccgggatgagtgggagagtatcggttcaccaagaagcaatgccctccttaaaatttttcctgccctttttttcttgctcttctctttggtgttcacaagcccagcccgagcaagtggtctttcacaaagaagccagggaggcctcctccctcctggtcggtggggtagtcgggctgaagaacaaggttgtcaaggctgcagaaggaggaatattctgaggagatggccacatgggacctcagcctcctctcaggagagcctttgtctcatgggaggagctttgtaaaagggtccctcatggcagagttctccactgagtcaggtacaccttctagcaggactcgtcagtatctctgttaggggacacaggctggcagagtttcagttgcttcataaaataagtatagaaagtgaggtaagacaaaattcttactggtaggtgagaaggcatttcaagagggaacggttaaagaaagttgagaaatctgaccttaaggacttattttatgtaagggagcttgatggagaaactgggcctcctaagagagtatatttagagggaaatggcccaaggtcatgggagatgagatgacccagcctctgccaacccagagggaggtgggaagtagacagagggagaaaactccgagctggaagcctccatgatggaagaggccatctcacctcaggggaggaggcattttggagcactggtcaggcaagagtggaaggtagttaggagccgaagcgcaaaagcatccgggaaaagcaagcaggtgatttagccgattgtgggttcccgaagggaaagttcaccagctgggtgttgacctggtgcagcctaggtcctgctttcaacttggggtcaactagacctctgtagggttttcaaaagcaggccctagtttaggtgacacaagccccattctccaagcctttccctccagctgctagaattctccaacaagttctcttgctccaaggaggaagattgattaagaagggcctttttcaaagtgctggctgcagcaggtatagagagcacttctgtggagtaagaagagcctggtctgtctgggattctctttgtgggatgttacccatctggcgttttgtccaggctgcattctaggccatgttgtttgctgcggttactggccttctccagtgagccatacttcgttcccatcttagtcctttaaagtgttttgatcttgattctaccctgaaaatatactaatttatactcctagctacttgggctggaaaaagtaaggagaaattaggtttggggaaagaagaaagtgttttggtgctgtcctcatgctgctgtgcagagctgatgcagaatgggcactgagtcctcatctgccttcaagggctctgttcgctgctccagggtcccttgcaagagtagagcttcttcatgatcttcctagagtaccttttccacctgctggagagaaaatttgacactgtttttttttcagttcttcatgaccccatctgttctagatttacttttaatggcaaataatacttgaaaccaagtattactgtccttagaactttacattgggcttcttgttgggctccatcctgtccttttgacattgaggtttcccagagccctctcctggtccccttcttgcctggtaagatgcatacatgccagagcgtcagtggccgcctctgtggcatgcagacctgcactgcccttctctctcctgagcttctatgcctccctgccttcaaaatgatctccctgcctctggcctcagcccttctacctactccctttgtaagcccaaagctgaccagaccactcttgcagtgatattttggcactggccacctattgcttgagaaagcatatacaattttcttagtcgaatattcaaagtcctccatgaagcactggcccctgtatatttctgcctcatttcctgccattccctccctgctatttcttcgtccccaccccatccccaggtgttggcatgctagacctttccctgcccatgcgcctctgtctagataccctgcttcctctttgttatccttgaaggcctgtgggaaatgttatcttctctgagacagcatcctcaccccagccagagccagccctgtcctctgctcatgcatccgttgggggcctactatgcaccatcgttaccaacactactccatgtctgcctctctgtttgttggtgagcagctgcttgaggtctcaggctgagtcttctgcttctggctctgtggtacctcacatgatgcctggtggtagcttcctggtggtagctcagtaagattggtggaatgaagaaaggaataaagggatgatcctggaagtgcagcctctgggcatgagacgatacctgcttttctgtcgcagggtatctgggtagagcagagtggagcacatcttcccttaattccccgcttacctttggaaaggcttttgctagttagaaagctgtcaggcatagtttctaccaaaagttggcactttgggttatcacttgggtcaaatgctacccaaataatccctgccagcatgggtaagagatctggctgccatgatcaatgacaaaaggcacattatttatataggcttctaccgatctgcagatgggagtgaatccaggcagcaaaaggaatctgaacttgggtcacttttcttgtttcccatttgcaaccgttccacaaacattgcccccttaccatgtgcaacgcctgtgccatatcctggcaagagggccaggaataagagatgtgccttccaggagcccactgtccagcaggagacaaacattgatggatggtgacaatagggttcttagacatagtggtgcttcctgaccctgaggcccacattagtctggtttatgattttaaatttccagagtcagaaatgtttctgcgcaatacatattgcatgtggctgacttgtttggtcttttcagacaggtagagctggacacaaaaataatatagatttgactgctggttccacttgagaggttctggcctcagaattcagttgtaggagaacacatcatcataggccaagaggagagagcagggagaggggccctctgttaggagccgtgtcatttcttgtatcttatcttctggttacaaaggcaatatggtgcctttggtgggagaagggtgggggaactgagtcatgccacttgacggtgattttattaaacaagaggctactaaatagggaaacagtatgtgggaagaatgggagggctgacattttctccctcccctggactcctgtcagagccacctggtcagagcctgtgatttcagccacctgccttctgcttcctagattaagggtgtcaaccttcagtccatcaatcattccaatttgggcacagttttatgagtgtgaggggtttctggagagagagtcaatgaaattgccaaaaaattccaagaccccaaggaaatattaagcccctattgtgttgatttaaacggattttatccatcacagtgcaccagcattgagaatatcttataggctgatggaaatggcctgaaggggagaacactgataattctggagagagggagagaggagctgttcaggaataaaatctcaaagtcagaggctggcctccagcacccatgtggtgggtttggcctttgggaaatgacataaataatggagagaagcggcgcacacggtacaaatgcaggcggggctggggcacgcaccacagcaggtgcgaagggcgaacgctgggtctcctccgccttgtcagtactctggaggtctagttgctacttgtgaccaagtttttgatcaaggtgtaaattccttcctagaggggaggggaaggatcactgtgctttctttagcttttgagttactcttaactccatgaagaaaagggcaggctctgcccctccaagtgtggtctgtggcactgccaccagtcagagaactgcttgttatccattcgcaacaagagctgtcagctctaacactaagcacattgattcagctggctttcttgttaggagacttcttggacgaaggaaactgctgtgttcccttacaacctgaggctagctcttgatctcacctctgactgctagtctagacctcaaaggcagcccatctctgctcagttttgccagccaagaatcatgaattcatgcaaaggaaagctagaaagcataagctgtgctgtttttaaaatagcccttcccattagacttttatacatagatcatcagatttggggctcacaaattccttttgtctgctgatagatgggccagggagggtagcagtcagtgagggtaaaatgggagagaggcactgtgatcatagggcggggagagaggtggagagttggttagaaaccacggcggttgggtgggggaatcttacattattaagattaaatttaagaagcaaacccgaagtcagtgtcgtagctcccccataaatgcacctagactgatggatggtgactagaataaacatccctactccagctgttaggacagtcagtacgtccacatcttctatactgtcgcaaaaggctgtggttctgcagtggcttcttctgggtctgtgtttgatcacaagtttctgggacctgacacctcaaagtactttttgttctggttttcttaatgcagcactaaatgtaccccgttgtaaacaggctgggccccattttatataatatgtacctgaattttcatttccaaaaagcgtccagactctttggaaaaacacagttggtttatagacagagctgttgatcttgacagtcagtccgttgcctctttggctgtctgtgcagtatctccccaccaccctctccaaccgggagcttcccaggggtgtcgagagaccacaggcactcatttagcacctgctgtgctgatgctggaagaagatgtaaaatgtccggcacatacatatagattttaagttacaattgtggggatgttgtaccctcaaaattgttgcaagatagcaggacctgaacaaacaaccagacaaagctggatgacaggcagggtgcaagttggtggacaaaggggacattgcccatgtcaagcactgactgggttcaaggctctggctagataatggggttagggaagttgggggactgaatatgcagcacagtcatcatccttcagggcttttgattggtagagctgcagacaaagaccccacattcagccatcagtacgtaagagattcagcgtcagcctgagggagtgcagacagccgggactgcgaaggttccatcagggaacatttatctgaccttgaagaagggtgaagttgaacagatggagttggggttaggcaattaggattgcagagacatcaggaggtggggaggaacctggtgctattttcgaaggatgggaaggactcctctcagcctagagggtgaaaagtgggagggaaagaaagcaaaagctgagatggaagaaggagcctattggcttctttgaaggacagagggagccctggaacatcctcttcattccatactcttttctactatagagcctgccttgacttccccacactaagcaccacccccatgacaaggagccagtgtctctgccacgacgctgtgcctcacggtgcctgtgtccccgtaagccattatctacccgtctgtgtcgtctacactgagagttctttgaagacagggacttgtctcagtcatcctgccacaaggcatggcctttgtaatacaggctggacttgcgaggactggagagcattgctggcccatttgaaggagcacagaaatggaaatgtgtgcaatacctggtgacagtgctctttaagtggggtgaatggagattctaaggaaggagtccatcagatcgtgagggtttgggatcatccctctgggtaccaggacaaggttgccaaaatgccttcctctgccctgtagatatcctgcttggtttggtgccactcaggaccgtgagtgtgtgtgtgtgtgtgtgtatgcacacgtgcgtgtgtgcgtgggcgtgcaccttctctcacacataaaggtgcacaaccaccctgctgtgcccctttccaccagtggacagtattgttacttcccctttggctttcccaccctacctgggtgccatgggtgcggcagggactcggattcgcccctatacggtccgtgtggtgggtcattcatacatgctcataaacatctgccctcgcctgctctgtccaggggtattttagtgacgcctggaacacgtttgactccctcatcgtaatcggcagcattatagacgtggccctcagcgaagcagacgtgagtatgcacctggcgtggccgccacctgtgtcctctctcctctgtctgtgcatactccgctccctgccctgcagtggcatcacctggacaagtcacagatcccagtcacttgatctgaaactaggatttcctaatgagagctgtaggcaagacgtgtttcagggtagagccttatcccagggccttttgtagacacaaatcaccttttggaggacaggcctttttgcagcatttaccctggtcactagtaggcaaggtaagataggatgtctctaattgttttcatttgctgtgtcagaagtgatacccacagtggcgtatctataacatgtttattttagggggatgtttcaagtcgccgtgtggcgcgatgctagaatgttccccttttgtaacactgtccttttcttcttttttcctgtggtgcttcctctcctctgtggcttctgaatgcttgccctaacagcactatttcactgatgcatggaacacttttgatgccttaattgttgttggtagcgtcgttgatattgctataactgaagtgaatgtaagtagcaaactttgtgtcctatatcatggttgttttcattaagtctgacatagaagagactagaggccctgcccttaaatctccacacactttagaaatccagacacaaatttattttgaaagactaaggataatttgtagtttcctctatctcaccccatctctatctccttcccctgaaaaagagtggggaagtctatgtagaattgccttttggaactagaatagtatttcaaaagatctaattaaagttataagggctgggagttaattgtgtgtccgtgtgaatgttgtcactcaccagtcgtgtgaccgtggaagtcatccgagtgctatgtgcctcagtctttccagctgtacatggagttactgatgtgcaccctcgtccccgcaatggttctgtgagggcacaggcaggagaccccacagccagctatgccctgagcctgtggtggctgctgctggtgccctcacctgtaccgtgtctgctctgagtctgactggtgacactggtgaacgtcccacacccaaagggtgatgccagccagtggaaggctgcttggggccagggaaaagagggccgagtgcaaaccagggagagggtgtcagtccgcctttgttacatccagtagattcacttgagggggaacaagtgcagtagtggcattgtagatggagtgaaccactctccctagaagcactctgagcacctctccccctgcaaaattaagaagcgtgagaaagggagcccctccttctgcctggctccccttgggtctgacccatgctagaccggaaggcctcaggcaggcagaaagggccctgtctacctgatctgttcccagttcatcagcaagtcttagtgggcgtccagtgtgtgtgccgagcctgtgcagagcctttcgagagagtgggcggagcacggggagggactgttgtgtggtattggcttttgctccacaatgtccagcccaccccctgcccctgatgctctgcctggtgacatctgcaggattgaggattataaggtccatcctggtgcccagacagcctgcatcacacaaggactgtgaaatccctgtatgccacctatctgggtccatgctgatcctggcgtgtgaatagtaagacagccaccagcctggcagtcctaagacctggcagttgcagccctagttccaaactgacttggattccagctccctcatgggccaagtggggtgaataacatctgcccccttgctgcagatatgttatagtgataaaatgatcggaatattcgggaaaatgcttgctaaaaaccccaaagttttagggagatacaagttttgtattattctaagtgtagattttccctgtaataagtaaaacagactgtcagacgtgactgtgcccatgagggtgtgatttaagcctcgtcatgccacgctatgaccaggcactcagatggtattttgctagacctaggtatacacatattccaacttctaaagcccagacatgtaaattctacttcatgtgaaatgttccatgtgtcagctataaaattgccattcagatatgtaaatgatgcttggttgtaaaataagctggtgctaatgggagaacagcaggtccctaactgggctgccctgagctctctccgaagtttatggctagacatctgccaccttaatcatctcacaacgcaaagtgcttacaatctactcggaggtatatttacatgaaaattctggaacatacccttctgtgagccagagatggcctataatggaagcgaaaatacaataaaccagcagcagggcagatctccctggactgctcagcacttcaagtgctgtgcaggtggtgggtgtaaacacttagcttccgggcaccaggatgtggccaaggtctgtccacctggggacacccagctttctcacgcctgacctgcctgctggctggcaggggtgtagcacccatgtactcagggacagcacgcgcccggcttcctggctgcctcacgtgtgctgcaggctggccctgctcctcccgctgcccctgtcccctgtggcccagctttgctcatcagtgtatcagtgttgctgtgttcaccttgcaccagtcaggaaaggggcaggtctacgctgaagtttctagttagcatttgacattggggtatctgtgcaacacaggctttcagggggccccttcttggcatgcaattaaactttcaaaatcacctaggcagacactcccatagtgtgctttcagtcagtgacctttttcctggtcagctgtggcctgagaccagatatattcctcagccatggcaatgccagttccctaccccaggccagcagaacaccaccttcagaaatctcagtgtctccttgctgggccttggaacagaggggatgctcaaggccaccttcacatttattccatctttcaacacacattcactgggcatctatcacttacaggctctgggctaggctgtggggaggcacaaagataaaaaaggactgggtgtccttaacctctggtgtaaatacatgacagtgggactgttggttctgacaccccactcccctccacatgtagttcccctggggagcagtgcacatcacatccttggtggccttgtcccctgagctgaggggtcagctgtcagctgggtgtgaacacctttggttcatcattggctggttgtagctgccataagtcatcattgtttgcaatgtttaacctgccatgctctcttccccaaactctgttgatctttcttttctgttgcctaattgattttcatgttggttttatttttagaaaattgtagcggcaagtatatataagcatatatacggtgaagtccttaaagcaaagcacttctaaagaatgtgtgcttgtttttggcctctccacctttggttttcactgcgctccacaggacgtgctaaggattggttgcaatcatctaaattgttccccatcccatagattgtcatctccagcctggggccatcttggtcagtcacacttggctctgtgacttgccaacatagtcttccagaatgaatgatctggctgagaaatgattgaattcagcctgcgtttgtattctttgcaaaaacgttttgggtagtcctttgcatggtcctgcctgcgcacgcaccagcctgcttcatcctactgtccccctcccatgtccccacaccccgctcagttcctggtttggcagcactcatggacttatctccatcacatttggtcctaacctcaccaggctgctaaaatgacacactgtgactgctgggctccctcttgctccgtccctctttgatgcctgtttgttccttgaatgatgaaatgacccagcaacatactgtccctaacccatggatggctgtcactgacatttgtctcttctcattatcattagtgtctgggaggcaaaacacttgtttagaagctgtatctgccttattattacttactttgaaggagcaggtaaaaagtcattagggagctcactctcagagatccaggaatggtccctgccttttaaggtatgctgtttggaccaggtggctgacagtctcactcatcttctttttctgaccccacagtaaggttgtgtagtcccccatttcatatgtgaaccctttcccaggagccagctcagctgggcactgggttgtggacacagacccagcaaccccaaataaagaagccctcctcccagaggtgttacctgtgagctcagaaatagtcagagggaagactggcttctccgcaatgcctcgggttacctggcccagctgttctgggatgctggtttgcttcctatctgaattagaaagctgcatcctctcagctcttccaagcacagatagaaattaaaacagaaaatgaaatggactgatttcattgatttcacttgggaacctcagggtctttttgacttccacggttgcagggggctgccccagagcctatgtggtaagagcctgcttgagagccctgtgggaagaggctcgagggaacatcagcagagccccaggaatctaaggagctttctggaccctgacatgtagtccggcctcctgaggctaaggggctgtctcctgtagggttcccagctgaagaatgtgacatcttagggtgggaaggaactgccaagtttgtcttgtccaagccctgaggtgacactggaattccgcttattgaaaactgattagtagccccttgtggccatgtttggaaagctacctagtgaagagtccttccccagtctggtgtcctctaggggtgtccagcatagcgtagcccacttgcgttccagctccaccagttcccttcatgttgaaacctcctccatcccttgtaggggagatggggatggagtctaatcgctctctcttcatccgtgtactgttccctcgtcaacccagaaagaacccactgttcagccacagcagcctgagtgggcttttctagtgaccccactctgtatggccgctcgagatctaaagggcattagctggtataggccacctgttaactactcgggccagctttaccctggcccaggactggagttctcagctctggcagcatatttgaatcaccaaggagcttttaaaattcccaacatggaggtctggcgcagtggctcatgcctgtaatcccagcactttgggaggccgagataggcagatcacctgaggtcaggagttggagaccagtctggccaacatggtgaaacctcatctctactgaaaatacaaaaaattcggcaggcatggtggcgggcgcctgttatcccagctactcaggaggctgaggcagaagaattgctgatatcctgtaggcagaggttgcagtgagccaagatcatgccactgcactccagcctgggtgacagagggagactctatctcaaaaaaaaaaaaaaaacaacaaaataaaattcccaacatgcagatacgccccagatccattaagtaagaatccctggggtgggacctgggcttcagagattttgttaaagatccccaggtggttttagtgttcaggctagtatgagagctggcctccccttttcattgggctgacatttgtcatttgggaaaagccatcctcagggttctttaaatttgtaagatattttggcaacttgcactgtccccccggggctgccagtcacatcctcccctgaagcagccccccatgcccagtggtgtgtggtgggaggggaggtgtcgcaggcgcactgagggtgcatgaagcctggtgtgctgtttgctctttccttcctccctccctcgcatgttgtgctgccctctccctttacaaatgctgtctcctcttcccttttgttcttttaaacagaatattcatggtttgaagttcatagtccataggttgtcagtttcaaagatatcagttgaagagatgtacacttcgaaattcagttcggttgctgactttcacaaactctaaggaagggggccgtggatggcgtatcagacttgaagcagaatagggagaggcccgcaggagggtcttaggccagactgtggccaggagtgtcttccctgaccaacaggccccttactgtcttgcaggtctgatacataagttgtgcacatttcagaaggataactgtagagccgtctctctcgtgcacactgcctggtcccctgaacacaggcaagcagaggtgcacatgcgggcacacttagcatgcacactcacaccccacactccagccagagagggaagagtggaaccttcctgtgcacagccttagtgagaatgatgtggaaaatgatgagaactttaaaaaattagttccttcatttgttaaggtcttaagttgaaaaacattgtctgtccctttaaggagctgatatttcttttgagacgaactaatagaagagggaaataaaaatagcaatcctgggtttttgataaacctgtggcagagttcccattctgagcatcccaggagaagcaaggaccccttttaaactctgtcagaacctgttcctcttgggttcattgtcacattactgaatttcagtttttctgtgatatgctgaaaccccttattttctgtgaactttgtagaatttccctttggtctcaggaggtagcccttgatgctagagaggcttcagaactgagctctacctttccccagatccccagggaggaggccctcgagaagtgagcacatccagacgtgcacacatgtcccttaactttgcagacacactgtacagaaagcgtccttgaagcccctaaccggaagagcctcatttctctctgtcggctcctggtgacaccactgaggggaaaagagaggctggcacatgctggctctggttccgctgactgttgctgtttaatgtaaagatgcctcctggtgctggctggagtttgcttccaactcctctgtgttctctcagacactttctgaacactcaggtagtgctaggcaccatgctgggcacggagtggagtgaggcaaggcccctgccctccctggggtgggggttggggggcaggtaagcaccagtcattacagattctgcatcctggggccgagggacaggagcacagccagaccctggaggaggtggagctgctgaaccacaggggagctggtcctccactgtttcttccaaagactcatacggacctgcactccctcttatgtgaaagctgtctgagctgtggggcaggcagcgagggtttctgtagggaagcctgcctctctcctcctcgccctgactcagtctgtccagcttttcagcagccctgcctaagaggctgttgtcagacatacaccacccaggcgtttagtctcataggaacagagtgtggtccaagggggtttgtggcccgcaggcaggcaccactgcttgcccctctgctagagacattctgttcctcggggctaggaggcctgctgcagagcggttagttcctgagacccacagccctgactaagccaagagaactagcctcctcgcgagaagcgggggcacactctgcatctgttgaggtcttgcagcactgcctttactggatgcctgtcagcctgggcacagcatgtccccagatgtgaattagaaagtggtactgtgtccatgcccatgtccatggctgcctgccctcaagtccacctccaaggagagccactggtattttctcagggagggagcaggtgtggtgtctaaagatgggaaccacacatttttttaaagggggaaatgctctctggaaccattgactccttcctggttcattaatccattttcaatctttgatttcttaaagccaactgaaagtgaaaatgtccctgtcccaactgctacacctggggtaagatcagtgactagtccccaggggctgggccttttccttaagtttatttgaccatgtcgagttttccactggtttttctgtattctccatgattgtccttccagaacagtgtctgcagtggtttgcattcatcatcagtgtccagtactcttgaccagcccagcgttctcctctaacacagtagaatacgtggacatgcatgtgctgtgtggacgcagttttccgagctctgtgttgttagcatgtaactcttcctttcatatcatgctttttaagatgaaaaggccctagaatcacatcttcagttcttacctctgtcacctttgcatctgttgctgtttttctgaaagtgttgcatgttctactttccattgggtttgacctctccatgataacccttcagaactctgaagagagcaatagaatctccatcacctttttccgtcttttccgagtgatgcgattggtgaagcttctcagcaggggggaaggcatccggacattgctgtggacttttattaagtcctttcaggtaagagccatgccaaggacttctctctttgtctttgaagatcatatgtaagtcagtgattgtccccatcctagaggacccaggctccccctgtgtggccactctgtggacctaaatcaatagaaaacatggaatgctggagagacccaaatcagcatttcttgggtcaatcacatgggattacttgcctaaaggaaacagaagagaaagcaggaaggatccgtagctgagagatctgtagcatttccaagactgagagaggtgtggggcctgcagccctgcagtgcccccgggatgcctggtggtggtggtgagtgccaggtcccagcagactgcctggaagcccaacagcctctctctgacaccttttcctcataaggctacaacagtgctgtgtctgttggctagtctagatacaaatcagaaaccaccacctgggccagtgcactatcactgggttatcctgcacctggaagggtcacagagttcgggatgtttgggcatacaccatgtctcatttgtcacctctgattctccaggctggcacagctcggttctagactttcccaagtagaaccagcttttcccgtacctgccagtaccctgccccagacattctagccttctggactgattccatttggaagagaaggtgtgggaaatatagattcttagtaaaaggtggacccatgtagggaatttgtggatatctacaagcattagaaagtgaatcctgcatcttcattttttaaattatttgactatttttcattcaaaagttataaatgtttacaataacaaatgaagctgtccaaaggtatataaagagaaatttcaaacttggccctcacccacccctggggtaaccagtgttaccctcccagtaagcatttgtccctagtagatgggattttcacaggtaaaagggagaagggacagcaagcggggtggtgcaggcactcacaagggaagtcacagatcctgctggggagaatgaggttggaggaaggtaaagtgggggcctcaggcaggtgagccttgaacttgctaaggcacagaatcctcgacagttattattcatttaaagtaccaaaacttgggaacaaactgctataaaaatagataattcagaggtaatgttatctcactttttaaagaaattcttaaagattcaatttgccacagataagaaagtcatgttccagagcagcagttcataaaagcagagaaactgtgcaaacaaaaatcgtaaacatttggcaatctaggaagaaaatgcacgtaggtatgttgaggaaagcctgaaacgaactctgtgggaccctgctgagcagtccagctgcagggagggccaggctggcaggcacaggtcaacagctggcacaggtctgaaggtggctgagcacctgtgagccactgactttctgacaagctctctcggatagtagagaaagcgggtgctttaagcatgtgttcccagaattaagcctaacactctgggcaccctgtgcaggtagacgtgttggtcacatgtgatgaggtaagacagcagttgacattcagtgaaaggacgggggatctgtcagacactcgtacttgtatttggtgtttatgaagggagccacacttggcgaccccccagctcactccttttcttccctggcccagccccccaacttagcagttctttcagaaggtgtacatcttaagagaggtattttgcatcctacagccacagccagaaagtggttcttcccctctgacccagtaattccactcctaagacttcaccttaaggaaatacttcagcagaagcaaggtggttttgcataaagatattcctttgcgacattatctacaataccgccccccaaaacatacccacaaaagaaagtggaagtactctaaatgtccagtgttctggaatggtttgatcaattataatttcaccccaaaaatccagtaatgaatttaaggattatgagagttacgtgtctgtgttgaaaatgtttagggttaggctacagggttaatgaccgtggaaagcacatcctgcctgtaatattgtaacactgggcgtgcatgtggatggtgtcttcaggactaaagtagttgggcagggctgggatttaaacggttcttcctcactgtcgatattctttcacggtaacacgtggaatagaaaggaagcatgtggccactcatgggtcttctcaggctgtggcgggccgtcacggggacagccggctggtgctgagccaagtgccttttctctcccaggcgctcccgtatgtggccctcctcatagccatgctgttcttcatctatgcggtcattggcatgcaggtaagctccagccatctcgccctcaggggccctttcactgggtagccccaaatctgtggcaagatgtaccctgaccaagtgaagtagaagcattgtgatttttcagccaaatgcctctgctgaagcctaggaagatgagaaagacaaagctgcttagtagagagctccaggggaggcccaggctcagatgaatgtggagaggttagaatgcaccaggaaaaactgcatgtcatggcagaagaattatgctttatcataacaaagtgaaattcacttgaaactaactatttccagatgccaagactgaagagagaagcaagtagcccctcgtgggtcttttcagtctgtgccgagccgtcgcgggaacagaaggctggtgctgagccaagtgccttttgtgaccattgttgtgctttagtagctcacctttaaaaagaggcatgaaactgggctcttctgtgacccaagcagaggggctgcaccctgtttcccagttcctcctgggcatgggaaagggactgggcctgcctaacagaggagccctaacatcaagtgggcagtgggatgggttgtgggtggagggaggcagcctagtctaagaatggaggcagtcgaagagcccaggtggctgtagatctctgctggcaggctccttgcagattctccacgtgtgcaggtgctgtctttcaggtaaaggagggatgtaagtcagaaagaagtaaagtgattctatgatttttggggcagagaaatggtagtgcttttttcttttttcttttttttttttaaaatcctgaaagcatagaagcatttgcagatctctgggaatcttaccaggagttatgaaacaaaagtcagcatacttgagcctctgtgattcagcagcacgtggtgctatgtgccctggaaggtcttttatcacatatgttctcataaaaaaaagccatctcagaactgcaagctgcatggcacacacaaccccagattcacccagcaggcgtttgtaagcatctgcaggtttctctagaatgtcagtctgctccctaaatctcacaagtaaaactctttagtaccttcccattgccctgaagataaagcccactcttctgcccggggctcacagcccctgcctgttgcctcctgcccttgtctccagcctggtcttttatctgtctgctcatcacacgttattttcattccctcggtatctatgctgtcaccctgctcctatgcacatggtgctccctccacccgaaacactcttcgcctttcctatcacctgatgtatctttcagttctgagtttacatgtcacttccccctagaggccttccctgacccagccccccagccttcagtagatgagcctgtctcacgcttccctgtgtgtctggaccaccccagcatcatcactggggtttgatgttgcctggctacctttgtgtctcccccaggggagatccgcgaatgtgagaccgtgcccctctggagcaccacgttcccagtgtgtaacctgctgcctggcacatggttgtgcctggcagatcttttttgaatgagtgaagtgccaggtaccatgagaaaaccctagctggtaaagatcaaacctgagttagttctaaattcacatacggattttttttgcatgacgaaatctattctctttttcctgacaacttctccacctagatgtttgggaaagttgccatgagagataacaaccagatcaataggaacaataacttccagacgtttccccaggcggtgctgctgctcttcaggtgactgcaactggcttgggcggtgctcctgggcaggggggtccgctaggcgtgggtccagagggacggaggacacaggttattaaagcagtgtgcctttctcagttgattgtgatggctttttgtttttgtttgttctgtattcttaaacacagaccctagcatttcaaacacaggaattttgctggattgttaaaactgctgtggtaatcccgattgtggctggcataaggtttattcatttgggagttagtagggctacttaggccacctgaaaaattgtaggatgtacgtttatgcatggaggcatgcacttgaacacgaccaggaagacagaaacttagcaaaaacgtcaaggccttttgcacagccagtggggaacatcctaagatgtatgatttcaaattttttgggattgcttttaacgtcagttaattaactttgtaaaacaagctgccctcatagtgagaaaactttctagagatcatgaagtatttctaatgactctagtgactgacaagtcatttgcaagttaggtggtttccagctctgccttcaacaaaattgaacagagacttaagttgttaagtattttggtcattaaaaataatcaataggccaggtgcagtggctcacgcctgtaatcccagcactttgggaagctgaggtgggtggatcgcttgagcccaggagttcgagaccagcccaggcaacatggcaaaaccttgactctactaaaaatacaaaaattagccaggtgtggtggcaactgcctgtagtcctagctactggggaggctgagcccaggaggtcgaggctgcagtgagccaagatcacaccactgcactccagcctgggcaacagagcaaaaccttgtctcaaataataataataattaattactgttaattatacaaatgtttaaagtagagaagacacaaaaacaagcatccatttatatgcagacagttagcgcgcttgcatcagatgatggctgtaaatccaagggaattgcagcaggacctccagttactgtgataagttgcacgtgaaaatcagtaggaatttcacatttccattaattcaaattggattttcttcaaatgacttaggttttgctctaattatgagtttttctcccctaagatctaagcttcaaattccttctttcccccactaaagcccctttgttcttcatctgaaaaaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctggtaagtgagcaacacagctccccctctcaatttacagatgcttatgtagcagtcagcgttcacacaaatggccttgccctgtcccatcgcctgaggacaattgatgtggatgagcactctggactccacttggcagttgagggcttttgtttaaccaggcgtgtgtcactgccgccacctttgtaagcagagatttggtgctcactaatcggcttggagcaattaccaatcaccttagcttcttagggttcctttctaaaatttcaaagccagtgcatatggtggtgacctaagagtgtgaattatttggtgataatgaaattataaaactgcaatgtgtttcagaaggccttccttccccaggacttaattaaagccattccagaaagctagaatcacactcttttcttaaacattctccaaatagaaagtttttacaacttctcttggagacatgggttcccatgtttcatgtccatgtcattagaaagcctgtgctcagttctaacgcaatccagctgcagctgaagttcttcctttcctatttgctttttcagatcatcaatctgtttgtggctgtcatcatggataatttcgactatctgacccgggactggtctattttggggcctcaccatttagatgaattcaaaagaatatggtcagaatatgaccctgaggcaaagtaggttgaaaaatatttgatttggcgtgtgtgggtggattttggaatgtcagctttttttgtggagtggactgaaagttcgggccagctggtactgttcctggaccttagattgtattttacttccaggggaaggataaaacaccttgatgtggtcactctgcttcgacgcatccagcctcccctggggtttgggaagttatgtccacacagggtagcgtgcaaggtgagtgtcctgtgtgcgtgtctgacagcctgtcttgtagaagcttgcttcatttaacaaacacttgttaagtgacacagccaggccttctgtcagttgctagggatgcagcaatgaataatatgtggttcctacctctggggaaatctcagatttgtaactctttggacaccctctcaggaaccatcagaagaggaagggaattctgtaatttgtcattgggtggatggtagagaaggcgacatttcagtccggtccagaaggaacacaggagtttgtcagaggcagggagggctcagaaggaggcaggagaatggacatcgtaatggcaaagggtgagccattgggtcatcctttggctaggacataagaggaagtcagaaggccccaggtacaagctgagccttctctgtcctgctgaggtccaggagaatggggaggaaacgtgaatttcaggttcccatgttaggaagttggctgttggcaatggagaagtagacctgaggcagggggatcaaccaggagagccagaacgaaggcagcagaagtgggaagagataggagcagtcgcttggagatccacttaggatgtggagtggggaggacttggtggcctgggtgaggggagggggagtgctaggagagcacatctcccagcctcggcattgggggacatggtgctctgtgttccacacgtcccctctgctacagagctttgtggccaccacaggaaatggggcccctttgctggcacactaggctctagtctctcagggatggatgcagatctcccagtgcaacgcagttctgtgtttccatgccagagcacgctctcaggaaccctcagtgagacttttccttccacagaactcacggtgtagcaccttacatttgttgcagcgacaaaaaagattttcctttttcaaggaaaacgcaaggtttgcctcttgaaactctgccttctagaaattcatacagtctgcatagcaactagttcttgctcctcatggatccaaggagatcctggggtcaggcgtttttaccactccaggatgctgagccagctctagacagaaaccaaggtagcagaacagagtctaaaatatgtttcagactctcaaagaaatcccttgagccagactcatgttccctgccctgaaaatccagaaagccttctaggcaaggccttagggtccttgcctctcttcaggccggactctggatattgaaacagagcttgacttttttttttccataaacttcccagtactggcctcttttctgctttccaagaacagtgtgggatcccgttcactgatgtcttcttgtgtttaaatttccagacccttttacataaagctttcaaatgtccttgaggcacagtcatccattttgctgactcaggaacttaccaggaaaagtgaacaaatgtccagggttccctggctgcctgtgctggttttgaagagggtgccggggttggtaggaggactaggaatttgggtgggatggacttatgcagacacaagattccaaatcatcaatatggaagagaaagaaaatcttttcttttggaacatgctgttaatgaaaaataagaagtttttaaatattatcaacatcaccattaatttagtgcttgccatttgcctcacacaaaactctttgtgtccgtgagtcctttaatccttgcaagttcccatccattgggcatgtcatctgcatttacaggttgaagtgactggggtccagagagggtgtacctcacccaaaccccctccaactctcattgctggtgttaaagggatcaggatatagaagaggagtggggagcatggatcctgctctgaaagaccaaagcctgggagaagccacataggctcatgcaaaatgccacaagatgtacatgatggtctaactaggcaaggtctgaaggacattccctgagttgggaatagtaatggatcccgtcggttgagaacctaagtcccaggccctgtgcctggcccattgtcttttacttcctttaaccctcacaacagctttaaaaacatgcttggagccgggcacggtggctcacacctgtaatcccaacattttgggaggccaaagcaggaggatcccttgaggccagaagttcaagaccaacctgggcaacaaagcgagacctcatctctaaaaaaacataacaaaacaaaaacaatgtgcctggaatggaggtctgaccctaagatctccattgagattagtgaaaaaaaggagaagactgtttgaacagtgaagtttcacggtttaaaaaacaaaacatcatctgcgtgttaacatttatatttcatgactaaacctttgatctttgtcatcccagagtcccctaagtggtaggttgtattaatcagggttctccagagaaacagagccaataggatggatatggaggtgtatatgtatgtatgtgtgtgtgtgtgtgtgtatttgtgtgtatatatgtgtatatgtatatacacacacacagaggtttatcatggggaattggctcacgtgatcatggaggctgggaagccccatggtctgccatctgcaagctggacctggtgttggtgtccactctgagtaaagtcctgagaaccaggggagcccatggtgtaagcctcagtcaaagggcaggagacaattgatgtcccagcttaatcaggcctatagagagagaattaaatcttcccccacctttttgttctctgtgggccctcatcaacagaatgaggcccacccacattggggagggcattgctttactcactctacccactctaccaattcacatgctaatctcatctggaaaaaccctcgcagacacacccagaaatcatgtttaaccaaattggcatctcgtggcccagtcaacttgacacctaaattaaccatcatatgcgtacccccaaatggctgttgaatggaattgagggttgactagaaaagagatgagtgataaacggaaaataaacatccaaaaggatatggtcgtggtcactcatttgcattctacaaagaaaccttcctttctgtttacagagattagttgccatgaacatgcctctcaacagtgacgggacagtcatgtttaatgcaaccctgtttgctttggttcgaacggctcttaagatcaagaccgaaggtgagcattccctgccagcaagacaagatggcaggaaaggagagagacatcacatcccatcttgccttcctcatctgggccttttcttggccaaggggaggccctggggaaggggctggcaagtagaatgaagatgtccatgctgggcttgccggctggcccctgcctcctgtttcctcatcctttatctccttcctttatgcttcactttgtcccagaatgttttgagttgactcatactactgcttactacatagcaagggaaacaggcagggtatcggagcagagacgaagccatcacaaatgaactcactccaaccatccctaactagttgtatgacctgcagtgagggatttcactggtctgagctgtagtttctttccctatgaaaaggaaatacggggatgtctaggaggtcctgaggatgaaatgaggtgatgtctgcaaaagctcctttgcagtgcctagcacacagtcagcacttgagaaatatagtgggatcagcatcttcccagctgagagaccaaaccagaatggccttcacagccatgctcagccctggtcaaatcctggtaaaacaggcactagagtgtggccattggagctggctcagtggtgacttcagaggtggaatggagagcagattgcaacaggctgaggagtgaccaggaggtggggggaggtgggaggtggagacctcaaggagagctgactctctgaggcactggtggaggagagggaagaggaggcagcaagggactcatgctgagtgcaggcaggtgacttcttacaaccctagagcccagggagacttgatccagcaaagccagcctcttccagcctaactaacaggggcgccttgtagcatgcttgtctgtacctggccccaggccagcattgttaagggctccagaaggcagaatggtcctctatactgacatgttagttgaaaagacaagtgtcagctcatataataaaaggccaaggttatgttgtatggatgagtacatatagtaggaattgagagtcttatttgggtgaaatttaggctggatcttcaaggaaggaggtacgatttggaacaacccatgaaagagcagaaggcaaagacattctgggttgggaacaatggaaagcaagtagtaggtctcagctgtgggagggcaggatggaatcagagtgggacaggccttgaatcccagggtgaaccgtgtttgttcccatggtggagggacttcccactgggaaggcatgatcgctattgctgaatataggaagtgtgtttgcccctgactggggagagcctggtgggagtggagccccatcagagggcagcatgttcatccaggtcaggctgggacaaggctgtgcaagcagaggaggagctggggaacagaaatgaggcttgcttttccccttttgttttttgaatccagggaacctggagcaagctaatgaagaacttcgggctgtgataaagaaaatttggaagaaaaccagcatgaaattacttgaccaagttgtccctccagctggtggtcagtgcagtctatttcctaagtagtccttggccagtgctttggttttaatgctagtgtctccagaaagtccagagagtgtttgcaaaatgctttatgtatcatttagagcattaaggccaactgataaagaaagccctttggccatttggtgtgattattttgggggtgatatgaagaacattccagacaaaggagaggcttcagtgaaaaaccaaaactcacatggctggagcagggattttctttttggtggaggaattaatgtttgaggacaagattgtgatctcaaagtgaaaagcctatattttttgtccaaaatgaaatattcaaaactagtttccaattacccttcagtatattgttgaaaatgtcccatgaaaaatagacagctttcaggaaattgtatttttgaaatgttcttatcaagactgaatttactaccgtaattaccaaaaatgtccttttaactaacaggcatgcttatttccttttgttatttatcacaaaataactaaccttctttaaatttttatatatataaaaaacatctatatatatacacacatacagtgtgtgtgtgtgtgtgtgtgtgtgtatatatatatatatatatatatatatatgcatactggctttgcatttttatttaagtacatgtggacttagacgttgagatggttgtttttgactgttctgtttccaagttttaaaggtgcaggatctgttcacccagtgccaccacaccagcattctagcatccttgggccgggcacgtgatgagcctttggtgtgtttcgtgaccagcgaacttttatagcgtcgctgccgccacggctttcgagactggtctggctcaggtctggtagctgacttcaggacccaggccaggacggtgaccgaggccctgcccctgagaaggtgatgagctctggctcttggggcgcagacagagcagcatgccagccagctctgctccttagcatgaagcgagaagcaacgtgagcttttgttgctgaaggggttacccgtagctggcacagccacaggctcaaagctggggaagatggcccagaaagaaatgataaaaggaagacaaaccaacaacaacaacaaaacaaaacaaaagtcctcccacctggagggccctggcttcccacaggagaaccgatactgcacatttaaaacaactccttggttttcattcttttctttttagctgcacacctaagagcttgcatggcttacatgaaatgctttggaaaaattgtaacaatgtgcttgagcttttcctgcagcctccattcctttcacctctcagtctttcagaatattctgaagcaattctgttttagggtggtggcatggaatcagagttatctcttgccaactgtattcccctacgttgtttctttaaatacagatgcatgcttcagaatagtgggctatgtctgtctatgtaaaccttccccctgcgagctgaggaccccgctcctccctcgctccacctcacatctctcttggaacgccaccttcatcacaaccagccagactcccacattgatgcccatcctcgtgaaatgccctcggagggtgtcatttgcattagtgtgaaacttcatttcttttcattttaccaaaagaaaagtccagaatttagctcgccatcgaagctcccttcctttgaaaagctgatcaacttttagctttatcagacttctagtagagtagaaatcttcttctttcttggtccaataactggacctcgccttttctctctatttcttaaaatggattggagtttaggatgacaggttttaatctattccacaacggcagcgagaggcagtgtgaggcacaagaagagagaagtggggccttaggagggatgcaaggctttgcaagctccctgcctgtgttgagtgatgtgcccagtgcagggcttatccgggctgaatctcatgtgagtgctgtggccacgaaggaagttccgaaggcagtggccatcaggctttggtgcatagactctggaagagttgccggacagggcttggttctccacattcatcatttgtctgtctttcctcttttatccttcagtaggcccatgtccccaacctttcctgcatcacagcatacttagaaaaggatatttgcatacccctctgggaacagatgtggagttcttgaggctgagggcctcagcatcccctacaccatcacctggtcaagaagcaggagactgagtaaggccagcctccactccaagtggctgggactggcagatgtggggtgctcaggaagccccttttagccctggtgatagaactgagtcagatgcttgtcttgggtggcttcgctagtgtgctgtgaggtgtggcctggctcctcatgagcctgatgatgagatcaggaatgagctgtggatctgtggatacatgtcaggcttgcttcactcccagtggcccgggggtctccgctgccccctcaccatcagtgctgagccgcctcatctctgcctctcagctcaggttctcacctctgctcttcagccttcccgtgccatcttgtgggtcctttcccttcatttcagaagctctctctcctccccaggactctcctccatccatgacctggatcctttgctcctttgccctgaagagcacactgagctgcctccattgccttcttttcagtccggagcccagatggcctccttgtattcattccttctcttccttcctgttctgtcctgctgtagctttgacttttcttgttcttaggaactcttccttgggcccagtctcctaattagcacagtgtctcaatggagaagacgaagtgacccttgagttctctcctgcagagctctgggtgggtctgcctctactctggaggctgaagggagatcagagttaggcctgtatttgctagaagcatcagggtggaatggggtgtgggtcttcttcaggtagagccagggcgttttctgggccccacagagaagacacagagccctggaatatagaggaaggctgtggcatggcaggccaccagagactctccctggggtccctggagtcattagccagacaacagcgtgtccactttttgtgtgcagcctgggaaagggatacacttgcatggtgtgagaggcagctctgaagaagcccagcagccagtgtggctggagacggccatctctggagaggtggtatgaaggataggatcccagactcaaggagcacactgtcctgtggtaaggtcccggcttgactgagctgggcaagtcatttagccctctccatctgttggagggggtggtggtgagcagatccaccatgtcagagttgtgaagaggccatgagacccacatggaattcttctgacacagggcttggcatctatagatgtccaacagtaggggctggctagagccagagctgatattccaaacataccctgagcaaatggggaggctggagagtacagcgaggggtgaaataccaggacctgagtggtctctgctcacctcctgccttcttgcctatggaccttgcatcattagacaagccgagacagattaggaaccatgttttacatgctactcagagtctttggcttatacctgggtggcccctacaccactccaggactatcttagcttaggtttagaaggaacagaacacttctccaggccagaccacctgagacagccttctcacacagtaacactgagtggcttctgacagggaggcctggagaggcagcccaaggaggcccgggcatctccagtggggaccacaagatgttggcagcacctcctggatgggcactaagtgaagcccaccccgggtacattagtgaaggatgatggttctccatgtcccccagcccatcaagcttcaggatccatgtcaatggatgccaccgtcagcacattttaaaataagggtgactctgagggctcatgatcaacatcaagtgcccagcacttaagacagcctgagccaggtggctgagtgctttacctgcttcctcccacatcatcctcacggctcctctgagaggcttatccccactttacagatgagaatacaagctcagagaggttgagccccttgcccccacatcagcatgtagatcttgcaagggtggcctggcctaaaagccagctgctctgtagcctttggaccagcaaccattcctccttccagcctctgcaagttgtggtcagtggcccccagggccccacatggccccacacacatgggacggagtactaaagtggtcacaagctttacccccaagagacacagcacactgaagatttggtagcaagcagccgtgggagagccatggggcacatttacacgtccaaagtggtttaccatgagacagccagagcctctattctgcctcatgcatcacctttaaagtcatcagcagagttctgattccccaaccatacacgttggaggttgtttctgaacaaagcaaaaataagcccagctcaactatgaggttggttggagctgtcactacagtgcagaaaatgagctgttcagaattacaaaccaagaaatggtatatggagcttattggtggagaatagggggcggggagctcatgaaaatctgaatttgcagtcacttttctaaaccttcctctccttctgagcatgtatgtcacctttctaggtctctatcttgagacatcgggatttggacggttaattgcccttgataagtttatggtagttatacatgcaaatccctatgcacaggggtgaaatgtggcccgtgaagcctctttttgttttgtaatttttattttaagtaaataaccaagacagcatttcatagtgttactaatatgctgctctattaaactcataacaaatatattattttctgcaacctagagtatcagttcatttaactgacactaattttgagccttagttgctttgcaaaaccttgctttttgctggtttgagacccctgtgttatatgctgagacctcggtgccttctgcgccggaccgcccacccgccccactctgcccctgcccctgccccagccagaagcaagtgtttaggctcttggtctaatgtgctgattcgggagagctctgtctggtctctccgtttagatgatgaggtaaccgtggggaagttctatgccactttcctgatacaggactactttaggaaattcaagaaacggaaagaacaaggactggtgggaaagtaccctgcgaagaacaccacaattgccctacaggtgaattgttgtctcattttgttttctcttttgactaacgattttacaagcttatttgaaatactagagagctgcctattcatggttgagcagtaccacaaggattttgtttaaactgagatactacacactcccccaaatgtggactagccatttctgggccacaaggtaagtgcttccctccccgatgcctaccccatagagccctgcacctgccactacccacgcggcagggctgccaggacggagaggagcgagcgctaccctcgcaccccagcccctccaggcagcatcctccaagcaggcacccaccttccccacagccctgggctccagggttctggctgcccagtgaatgaacagctttccatctgaacgcaagtgctttgttttgtttccgtttgtttcttaccccactgcttgttggtttttggtccatttcagtaacatccatcacctcctagtatgtattctgtgtgtgtgtgtgtgtgtgtgtgtgtgtatgtatgtatgtgtggtgtgtctgtctctgtatgttgtctcctgatggccaggaggccagctgtgcacatgctatgctctcatgccccagccagcctctggtccctctccctcctccacctgggccctgctgcaggctcctagagtgtggatgtggctttcaggaacctctggtaccagccagggtccttgcatgcgaggaatgtagaaacctaggaaagcccaaagctctgggatgggaagcaggtatgtggaggggcaaggaaggcaccatgaggaccagcaggaagaggggctaggaaggtggtctgtgagtgccgtggatgaaggaggcagggcaaagagggagaagatgctaaggacagggaagagggaaccacagaggctggcaaatcatctgaaacaactgacctctgctgcccagagtgctcataatccatcatggataggataaagaattttttaaaatctatttacgccacaattttatgcccctgttctcagtacatgttaaatttggccttgtagatattgataaggttcaacatggaagagtccttcactcttatccagggaaaaatgcgcagcgttgtgtgttcaaagtgatggtaacagcccaaatgagggcttatctttgatcttgctgagagagagaatatgaatatgaatatgaatatgaatgacagtgaatgagtgaatgacaaacatgagctgtgtgtgtgtatctcgtgggttagtagatggccttgtgtaacagtgacctgctgattcatggtgcaacctctgctctacccagacagctacaggggctggggaaagaggcatatgcgggttggcaggtggaccatgaatccgactgaagacagtgatcttcctgcctctcatcacgtatcctaaaggtagctgagggaatcacaggctcagtcacacagcccattggcatctcaggtggtaggatttgcaaatgaagctttctcacttccaaccaatccagtttgtaaaagtgacagcccccctcctggattgcagttcacagctagcctccgaaagacaaagcaaactgcagagatatgtttgcagattagaagaagtctctggtccatccatccttgagggcagcgtggccaggttgggtgccaggagagggagtgatgaacatgcttctgcaggcttgtccttaaaggagtcccctgcccagaagatgaggctggttagatggtttagttccatttcccagtgccctctgcttgtagggaactgcttattgttctgggagcctaattgggaccagaacttgataacttttctggagggaggaacatagtctgtcatcgatggttgatgtcctaatttacagccagcaggttagctaggtaccatgagaatcttgcattttctgtgagaggcatggcggccacttggatgcagggtcatttatactttttctgaacccccaagacttcccaattagacaatttcagcactttctctagtggctggaaatagtgttttgatgttttaagatatgcacaaacaacacacagctaagtcattaccaggtttcacgtatggggtttactgagtcttaagttgaagggtcaaatggcatgaatgatacagcggcaggttgtgggttaaaagactctttttgtgttgcaataatgttgagggtttctcctaaacgtttttcattttattgtttatagagtttcattttattgatgaaatgcaaacatttccagttagatgataccaacatattttcgcatggctccattgggagctgaagcatcgtctgtaatttatgttgagaatgcagcctggaaaattaagttgtgttcataatcttaatagagaaactgaaaatgtacttgattctgaaacattaaacatagacattttttttgtctccttgaaggataattctaattgcattttggcttcctgtgctgtagaaatggctgtgagtgtgatttgttactccatgtttaattagcatgagtaggctttcgtttctgcgtgatgaaataccgggtgacgatgtagcagttaggaaaatttggtgggacggcagtgggagagatataccaccagtgtaactaggacaaggacacagcctcgggaagcccctgagagtgggcgtggcctgttgagatggaggatggcttgcctcctcccacagcagggtgccccatggctggcagactgcgtgctaatggaaagtggagcatggccgtcgcagtgtgagcgcagaagtgcggacctaggcatgtgcgtgcttgtgctgcgtagggtgcagtctgtctgaacagcttccaggatgggcccaagacctctgcgcccccacccccagggaatgttttttcaaggacacatatacgcactgtggttttgaaccctgtgggctccatctgatctccctgtgttcagaccaactgcaatgctgcctcccacatgaaggggaatggcttgagctcctggatccatgtgtgggaaggagctcggcatccggtgtcttctggcctctgtggtctgaatgagtgtgcagtttccatccttccatccatcttcatcattaaaaccaaccttctctccagcccctctacagagggaaccagagagaagctgcatcaggccttttttaatttcctcttgcgcatctcctacatgccatgttcactttgggttgactcagcatttgctcgtcatccattgttgctacatccgagtgacccacgagtttccacgaggggcaaataaataaaggaacacagccatgcagccatgaaaattctcagtcctcctcccagcagacagcaatgcatgctgaatgtcccatcagaccttctagatgaggacatctgtgcaagttacagacactcattagtccagtgtcttgtggataagaaaaagaccccaaagtgggaaaagttttgttcatttctctttcttttaacattcaagaatttcctttctgcaaaagacatgcactccggtggaatccgaggacactatgtcccccactcatcccagatgggagcctttccatctccattgtaggaaagctttggagggatagtccttttgcctgtttggaagtttggtttaaggaggagaccattatttctagctataaagaattaggttgttaggttgaataattgtaaagcctgtgcccgagccgccagttggcgatgcaggtggttgaggggagatgtgggtggtatataagaagcaaaggactctcagcccctgatgtgccccgcgtggtcttcttagggaggctcaatgcataaagacagaagaaaatgggatcctccacagagatttaatctgtagaagatcaaacacctgttgcctggtcaccttagtctaaaaagtagtggagttttgttttgttatttttttaaagcatgattctacctgaagccatcaaaagcctctttttaaatttttttctttttttaatctaagaggagaacagatgctaacagatgagatttcactggctgattcgtttgtttcagatgcttgaacggatgctttagaattttctgcctgagctacggcaccaagctggttagtcggaaggcgtttgtggctaaggccttgaaagggaaaagtctcaagtgggcttatttctactgaaacagcatttcagaagaaatgcaggaaaaagcagacccaaggccccagggagaccccttccaagcaaagcactcctccggaaggtggaagcggggccgtggctcatctgcggagccagggctgcctgtcgcggacgttgctcacggtggttctttttcgtgaaagggaacgtacaaagcttaacagttttcccttccaagcagagactcagagaaagggaaagagtgagagagagcaaaggaggggggcagctgccccacagagaaatgaaatgaacacaacttcctgatgctggccagtaaaacaaaaaattaaaaataaaaataaaaagattaagcagacctgcctaaggtgggtatctgactccattccaaagtcctgcatccctagtttgcccgaactcccaaagactgacaggcccctcggcgctgagctgacagagttccttttgtatgccagtccgccatgacctcctgagcgtccggccctgctctctgcagagacccagtccagaatacagtgagaagtggacaggccaggaagctcagatacacccattgaaactaacacatacacccgcatgccaaaaccaatccaggcaacacctcaggttccatcttaacgtgtccacaggaaacaccaccacacccaaacctcatctaacattgtccgtctttaattcgtgctcagagccagtctggggatgcctctttggaagcagtgtggtctagtttcaaggacactgggagtcagggaacctgggttctagtcccagtttcagcattcacttgctgcgtgaccttgggcaagacacttaacctctctgtgcctcagtttcccccatctgtaaaatggggttaataatgtcgacctacctcacagggctgttgtgaggaatagctaagtgattgtaaagcactttgaacgtataattgcttattaagactacaacaataataatatcatatgcctgtttactaccagaactttaagaaattcttgttttcctttgatctcttttctgttctgtaccatacttacccattgagaaggaaaattccccccttttaaagaaatctaggcaatgcacaaagatgtcaacagaggtaaccctgcaggttgcattttcacatcttaagaatagcagatttttgcccaagatgttggtcgataagggtgtctgatcttgaattctcagctgattccaagtggtggttggagtctgtacatctgatgctgagcccaagacacccaaagtggccagtttgggttttaagatcaacattcaaagtagccatagtgcagaggtaatgcagaagaatctaaaaaaattgaagtatctgaagtgtatagagaaaagaagggcttatgagcccctttcacctgccctgatgtgtacaggctggaagctgtgtgtgtgtgcgagtgcgtgtgtatgtatgtggggtgtgcggagacaggggaagagagagccagcaaactctggggggccctattcctgtagaagtggacacccttccaagcatcctgggagggcaggagtcccaaaggctaggcagagggtgggagcaatgtcaccagtgggaagtatgctttctgcaggcttgtcctaggtgtgactgacagggtcagtcccagcctcagggtcttttccagtggtgtcttttgtgcctatgacatttgcccttggctgcagtcctcactgtaccgagaggtctaacctacctggacttcagtggacctgctgtcctcattatggaaatgggcctagctcccgactctgcccccatgtgtataagtgtgcagactagttaacatccaggagctcacagtaggtgttgtgggttctcacagcacagtccacagggcccaagggcaggtttgactgcttcgtgctgcaccacatggtgatgtgggggatggggtagaaagccaggaacactccagtgtggccaggccacttgtcaagatgttgaagcacagctgcacctggtatcaaccgctgttaccctagcacctgagtctccttccccactgccagcagcccagcccctcctgagactgctctgtgacccagcagctacaggtctagtgcctggcattgcagggagcctccaggaccctgctgtgatccaaaggcccacttctgctctgattgggcagcacctgggtatattaagttataagaatttatgaagaatgtgatgtatcgtccctgaaagggaagcccgtcagtcctgtgggggtccgtcagtccctctgtctgtctttgacccacccgacgttgagttgattcagtgctgaaggatggcacgtgcctaccccctgtatgtgtcactctgtctcagagggccggtgtgaccgaccttctagatccaagattccatacactcaggcctcggcagaaaggccccaagcgattcaagtgggcggcgtttccatgtgccttctccacgctcctcaaataagtaaaaactgacaagtgaccactttctagatgggacttagggagtgatttaaatggaacaagagagtcttctccacttgggcctggctgtgttgctggggaatggcattggctaaggttggtagccaaggccagcttaggaaagacagccaggaatcaggaaagctgcttccagcttcaactcaaaagggaaagaaggcttcctgaaacttgatttgcagtcaaactgcagagacaccgctgtcgtttctcttaaagccttggcagagaagtgtagcttctagtgtagtcaaagttgtgagagacgactcaagttcattatttagaatcttcacagacacacacagcaaacttggcacccccaacaccagcatccataggctaaactcttcagctcctggatagaagatgagaggcaggccagtatacattgtagggaggctcttctcaaatagcttatactgtttaacaacccaattaaaaattaatccacaggactattgggtactacattctatactctttctgaaagtggggagatctcattcctttgagaataataattatgttcaggagtctttgagaagaaagactgcaaagaagttaagtgatgtgacgtagtagtaaaaggtggtaattatcgtggcttgttatttagtaccattcacctagtgtcctttggcagcccaattgtgtcatgattagatgatctgtgcgaaggagctggctaagacttactaacagttctagggtgggtagaaacccaggtgagttcattctccttggcacctcttagacctaagggacacagctgtttgagatcttggaagggcacataattctaaggcatggtgaaggcaacccattcagacgtcccaaaggctggctcagggaagccataggaaggccatttcttccaagagtggagaaaggtccacagaagagtgggaatcctagatggggtaaaaaagtctacacctgaggaaaaagtagtagtgcctgttggaggatagattgatcagcagttatcaaactttttggtcttcggacccttttatactctacattattgaagacccttgtgtgtcaatatttactgtcttagaaattaaaacggagcagtttttaaaacaagaacatgcaagcacaaagacgccagggtgatgacatcatgcatcaggcagcctttgaaaacctcactgtgctctcatgagaggatgagagtgttgaaggcaaagaacatccttatgttatgcaaatcacagtgacctcatggacccctgacagtgtcttgggatgccccaaggtccccagaacacacctgagaactgctttgggggaatgctactaggtccccctaaaggcagagggtgctggagccttttaatcatctcccttgttaaagaggctcctgtgcagtggcactgccctaactggagcccttctccccctccagccccttcccagtctcagcccactccccggaggcatggagctgcctgtgtccccattcgtctagcatggccgagtcttgcggcctgtgctgatctgcaggtgtgatggtctgaatcagggcaggatagaaagtgtttttaaaaatcagctcccctaagtgcacaactgggaccaaggatgtgtgccaaacaggatccgtttcagggataacttttgatcatttgtcatctccatgctgacttaggaatataagagctctgctagggtagtcaaaagagggttagccttgatcaggtggcaccccacagtcgtgactataggtgagtaagtgtgtgattcagactccaatccagcgttctttcccagtaggtgcagtgactttgcctgggtggtggttgaggtggggagtttgggagaggtaaggcagcccagtgtcacaggaagaacaggcttaggggccaagagtcctcactgagcctttgactcatttgggcacataatttaaccacatgggaataactttggctctcccttcctcccagaatctagtggaatatttgtatgtaagctcacaatgactggtataaagatgctatcagaacagaagttgtgttttacagcttctgctaagcctaaactttacagaatgctctattatcaggaaactggcaagactttttttgattcggttgttaaaattacaacgaatcagattcctgattgcaccaagaatcaaggtggaactgaaacggagagctctcagattgtgtgcaggcaaaggtcatattttagataatttctttaaagtttcctttatctttccaagtgatgggaatagcgcaacccctaggggagcttgtgggggtcatgttacccctgacttttcagtgagggttggaatcactgtggatgactaacagagcgccaggatcccaaccctttatatctgacacaaggaccattcacaatggacacaaaggctgccatcacattatccctggaggagagtggtgacaaaataaggggtgtgcccacgtgtgatgtgctgaggaggcggacggcagcttgcagatgagcaggtttattccataagaacttaatctcattctgttttctaatggaactagtctaaaaaggtcccctctcattgggtatagactgaatcctgctaaagggttaaccagaacttgtcaccagcgagacgactgtgtgcagggccagcctaggctgagtgcagcctgcctgtgatggggaacaggctctgccaggcagggttctttggctggagtctcaaagcctggcgcttgtatcctgaagatgaatggcctggcccagtcccgactagagacatgcatctcttatctccactgctacagcgtaggtccagggcggggctctgggcacttgtgcatgcttgctgtggcgctgtgagggctggcagatggctggtgtgtctgatggagctagcttagggacacaggcagcaaaagcattgcaaatgcatctaggcaggagaaacttaaccctaaaagtgggcaggagaaagaaaggtaaatgggtgttcatatttgatgtcaaaatgtcatcatattatgctattcagaagtgttttgagacattttagttttttttggtaacttaatcattcaatagaatatctatgaaattccaactaaatggtgtctaaaattttaagcagcagtctacaggcaaagcgccaacatttcttttctaaaaattatttatgataacatctagcattttaaaatcaaccagaaactaggcttgattctgtttaatattttataagattggacatcttaaaataagtcaataatgtttatattttatagcaactctgtgtttcttcaaaaccatatttctgctgtgatgttaatggaatgactttatatggctttaattgtgttggtttaagtgctaatgaccacttttcaaattaaaatagtattttgctgatagaggtagacacagatatgagatatgaaagaatagataattttactgtttgtaaagtgtttatcccaagaaaaaaaatgttcttttttttagggctgtggaaaagtaattttttcaagagtctaagatagttttctgtatttctggggattggaacttgtgcctatggaattttgggagcagcctaagctaccttttagcttgatatgtgtgctagaaaaacttcattaccatgttttgtgatatgtaataaattcagggtgctgtgcttaagcttcatgtcaattctagtttgggaacatctgtttccctcactcccagtcgtgggggacagcctgacctggccctacccagaacacatgtgaaaaagtagagtcagtccctgactcttatgaggtctgttttttcctgcctggaacaagcagaatataatcatgatttctgactctctgcttctgtgtctgggaagagcgattcttctctcctcctctaatgtctctttaataaatatgttgtcattatttgtctttggaagtggcaacttgggccacctttcaaccttctccatgatttatgttgcaaacaaattctctgtcccatgtctgttcattgcactatcttgtcgactaaatcctaatcttgtgtatcactgaagatgtgctggagacagtttttgtttctattatgcaattatgttatatgtgtatttcagtgaaatgtcaacccgtcaacagaggatgatgttaaaaattatccaaataaatagttttctatttcttttaatcagacctagtccaatcagttgaatgacagtaaataggattatatgttgtttaaacttgggagcatttctggcctttactgccttgtaatatggattaatgtaccaaatttacttgggggtgttgacttaagtgcattataacctatgtttattttgtggaagcagcagcaggtgtcttaaaccttgtctttttgtttgggagccttagatatgtaaccgagttttcttcccagttgatccaaaatcagaagtgaaccccttgcttagctcaccatcccttgatgatgtaccctaggaagctctgaatgaatgaaatgcggctgtttagtactgccgggtatgacctttcttcacgttcctgcagctgtgctgtgtaagagcttttaccaacatagcattacagttgccttcttgatgtttccatgagaatggcaggtgggtccacctcagaaccaaatgacttcccaggctcagatgtgctgaactcgtggatcctgagagagggaaagtgtgtgtatgtgtgcgtgtgtgtgtgtgtgtgtgcgtgtgtgtgcgtgtgtgtgtgcacgtgcacgcacgtgtatgcacaagcatacccacatgtgcatatgtgtacacacatgcatcctgagcctgtgatcagagggacaggagagcaagaagcagcctccctgaccaccccaagaactgtcttggtttgacccgggacatgactgtctgtcccctataagatctcagcattcctagtcaggaagcttaaagctttcattcccagctcttccttcaccttcagaattcactaaatggaaagatctgctgctctatcttcacagaatggttcaaaccaaacccaacctggcaccatttttagcagaattgtctcaaaggcttggtgcttttgtgcaccaggctatttttataagggcctcttgggaagttcctgtgtgactttacattctaaattatcatcaccagcactggcattggcaactgcaggagaccagttttgagcatccccagaccagtgggacccagccctgatggatctggccagactgcagccaccatcccctcctcctccctgaaccacttctgggcatctgttctaccccatgcttgtctcagggatggtcatcatgcctatctgtccttgccacagctgcccacatgctaagaggtgttgtggaggaaggacagggaagcggtctcctctccgaggacccaccacttagtccagttttcctttgcaaaccaccctgaggttgaagcatttgctgcacatccattgtcttagctgttctccaggcctttagggctacagagctgtggacagactgccagtgagtgaggaggggctgcctggatacaggaccgtagacccagggcagagaggacatgccttcttcagatgcaggactttctgtggaaaagaataaagttgccatacagtccctattagtctttaactcagcatactgttttccttcaaactggtggtcaaaacatcatcattctctcagagctggagcagtaccttcctccatgcaccatgcataagcatcttggaatgcttccctaatgaagtcatgaacaatggaagggcttatcctgggccctgtctcaacatagcagggaccacagtgaggaaggcagctgtgagggcgccaggggagatgcagagtatctgtgacgggcccagagggatctaccaggggtgtcttctggtgggtcttgcactgcctgcaaaggctgataagccactttcagtttgttgtgatcttcaaaaagcggaccccctgttggtgagttctcagcctgcacacaggctacaggccagggtatcctgatgaccacggtggccgggtcggtgtgcgtgtcagtctgctccgtcgtggtccgagtgtgctggtggttgcagtgtgttgtgtcactcactcgttccatggctttttagcagaaccagtggcctgaggactgcttggtctgcttgtgcctctggcacctacacctaggcttcctcatcctagatgcagcaagggagtccacatcagcctccctttagatcggccaggctgtgctccttgccctgctctgggcttggagagatagggctcttgtaggcgagcctactgaagactgtcactgagacaggggcataagctcttggcctggcagatcctagcactagtaaccaggcagtgttccttggaagtgggggttttgcaaaggaggttacggggttgcaggcctcaggcatcctacctaggaccttcttgaccctctggatgcctgaccataccaacaacccttagactgccttcagtgacatcagtcagtgccctggattggcttttggggaagccttcctccccaccgctgaatcaggaaggagcaaagccaggacccaggctggccccagggcccatgtgtggtctaacctgttctgccattttcattgatctaggcgggattaaggacactgcatgacattgggccagaaatccggcgtgctatatcgtgtgatttgcaagatgacgagcctgaggaaacaaaacgagaagaagaagatgatgtgttcaaagtaattattccacgcctagctacacactggccatctggaaatagcagggcaggactccagtttgggcagttaatcatccacagaagagtctggagaatgcagcccatccccagggcctagaggggctttcagaccacaccctccccctcttacagaccctccccaggcatcagcacctcttctagggccaggccagctctttccctgagcttacccagcttcccctcactgcctgcttctgaggagctcggccacagccgctggccctgtggatgagcatcctgagtccttccggcagctgcctttgctaccctcctccttcccgggccagctctttgatctgccagctggctgtcagtcccccagcccagagagcatgcccaaccttggggccaccagccagcccagctgggtataagtcaccccaacttggagcaactggaagagcacactcgagtgacagccgacagcttgctccccagctcaggaaatcggtaaccttcctcatctcggggggaccaactgccacacagtcacattcaccctgatcattgagacactcagattgttttacagggatcctacggagcttgcctagaatttgtttttcatgtagaaaaagttacctaacatagctagtctgcatcaaatacttgttaaattacctggtgttgtctcccattattttgcagagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtaaccttgacaatgtgtttggacttgctcatgtggtgtctgcccgtgttgcgtctagtcccaaggagcaaggcgggtctgtgctctgtgctctggggcatggaggaggttccccgtaggcatttgtgtcaggatctgtgagtgccccccaggtcactgctgcctctgacactctccacgtgatggacctaaaggataagggccacgtgccatcctacatcctgtgtggggtgccgagggaccttaaaacagcagcagccacaaaatccacctctcaattgtgctcacatactgtgcgacaggggttggtgaattgtttctctaaagggtcagtgagtcaatattttaggctttgagaaccatacagtcttgcaccttctcagctctgccgttgcagtgtgaaatatgtaagtgaatgggtgtgtggctgtgcccattaaaatttccctatggtcactgaaatttgaacttcatatatttgcatatgatgagatattttttgtcttcagattcttttttatgtttttcaatcctttataacaataaaacccgttcatagcccatgggtcatacaaggccaggtggcagcccctatgtggatggcgaatcataatttgctaacccctactctaggaggtagcctgatgtttgcattgtaaatttggttggaaattaacttttatcttctccctccttcccatgttatgcctttcctggatagaacccgctattatgaaacttacattaggtatgtgctcattacctgtttttgtgttaaatactgtgatggtatgttaccagctggcctctctgagtgctgaagaatgagaaacacttctttgagccagcctattaaaggttatcataattcatggctgtggactcagaggtcagaggttgttgcttctaagcaaaggcaccttcagatccatatctctgtcgactctgttgccatccaaggactggtgtccacacacaaggtgcaccccatgggctggctcctgcaggcctcgcgatggcactaggagcatccattgtgcatttacaggggcctcagcctgtgtggctggcagctccggctgctctctggggtcaagcttcttgtgggtgctttgcagcatgacccaaacctcctgaaggtcaggaatgggatcttgtcattttccctgtagccctcaagatatgtgtagtatattccactccacatgtattgacctgagttgaattgtgggcggaatgcccattttgttgggggccaagggaggatgggtcttcctgtgtcatgttatgaagtgaagtcgggagccatgtgggcccaagttgggtgcaagaaagtggagaagtcagaggaagtgccatccttcctttggagagaggattgacatcaccacgtccttctctgaggactgaggccaggatgagccgggtttcagggagacttaccacattcctggggcagggcagcctttggaaacatggtggacatgttctgtgacagtttcccctgtggcactgtatccagaactcactcgaccttcctgatttgatacagcaggaggtcagtggccaggaagctcctttgttccaggttctgaagtcacactgggctggagctgggggactagaaggagagggagggatcagagcagatgccctgggaacccagggtctttttccctaggtccatttttttgttctgttctccaaattgcacctattcctttggctccaaggcctctggacacaatggtttgacaccaacattgtgcagggcactgagagagaccctatcctggcccgcaggcacaccacacacacagacacacacacggtgctgttgccagaagccggaacagtccagtgctgcctgaggcaggtgcgcgctgggagaagccaggagcacccgggcagggttgccggccacaggcagaggtgcagctgcagcaggaattatctgccgcctgcccaggttctcagatcctctctcccaactgcaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggtgagctgctctggctcctgtggagagcgggaggccgccctgccctggtgctcggcccactccggaagccagggccaccggcagctgcacttgggcttcccctaaaaagcaaaatgggagcagaaactccaggccagagggagagtggagctggagaaagagagccgcagagaggcagggtgagggctattctttcagacctgttgccttatttccactaggggcctctgaggccttttagtgaaggcttgggaaatgggagatgggcctgcttcgtggctgggttaatgcctttccaccacccgtctttggagagatcagtttttgctgaattaacacttggagctctggcggccccagggctctgtgtggacggcggcttggccagcctggagctgggccaggtcctcatgcacagcacctgcctcctgccacttcaaggggtctctcggggagatgaagaaatgaggggtcactcagcagaggggtccatcttgcttctgtcctacagaaagaatgtttgttagtacaatgggcactctgctttaggaggcgtagcaggcggcacaggcggatgaaaatcgccctccaccctcttctctgaaccgcacctcactgtgaccaggggcccagtgaagtggaagtggaatggcagtgaggtggcttctggcatctgagccacagcctgaccctcaccctctgctcccgcagcccttccccgtgcctctctcaaatgcctgacttctgaaaccactgactctgagccagatgaactcgtgttcccttctctagggcttttgctcacactgtggcccctgcttggatgccctcactccgtctgctggcctcatcccccctgtcgagggcctgctctagggccttgctttttatttccatgactggaattgaaatccctcccccaacccccagaaaagaaaacctcacgaaccgcatgagttcctctcttccagcactggccctttccagctcgcatttgatttctgtgtgctcatggcattttctaagcccattgagggtggggctcatgcttcatgcatcttggtgtccttggtgcccagcacctggcagagggaaggcactcaggagaggggctctcacggaggaaatgagtgggtgagagcctggctcacaggacatctgcgatccacatttgccctggagctgagggatcaaaactgccagcacatccctcagcacaggcctccagtcctgtaatggcccttggtctccatctggaatcttccatgaaactgaggccagccttgttctcagccaatcctactgtgtccaagggaggaggcggggagaggagtatggatgtcagtctggcagggttgagtgacagagcttgttacctagaaccttactgccctcctctctgacctccaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatgtgaggccagattttttgttttgggtggaacctcccggggaacagtgtacctctcccccaacccccgctctgggggccggtgatggatgtgtgctgccaggtcaggatccttagtcctcaagaccagcccccagccagagagtgtgtctgctttccttcctttctcatccatatctcacgtgatagagctctagcctcttcagtgctatgcttgactctctttgagaagagagaggctgtggggccctaagattgcacgcacacatctggtaaggggtgttttgcatacatagcattgtctttgaacctgggaccatcctgagagggaggcaaaccacacacatgcttttgctgttgtcagccctgctgcactctgtgatggggtgactgagcccccaaaggggaagagtgggctcaagtgcagagctggctgtgccgcaggcctgtcttgcaaaaccccatgcctctgagggccacctgggcattctggtgtccatctgtcctcaggcccctccaagccttatcctcctccctcatctctgctcctcctccctccctcatcttccctcctcctcctccatcttccctcctcctccctcatcttccctcctcctccctcatcttccctcttcctccctcatcttccctcctcctcctctatcttccctcctcctcctccatcttccctcctcctccatctttcctcctcctccctcatcttccctcctcctcctcctcccgcatcttctcctcctccctcatcttctcctgctccctcatcttccctcctcctcctccctcatcttccctcctcctccctccctcatcttccctcctcctccgttcctccctcatcttccctcctcctccctcatgttccctcctcctcctccctcatgttccctcctcctcctccctcattttctctcatcttccctcatcttcctcctccttcgtcttctagcatcttcctttatcttcctcctccctcatctaccctcctcctccttcttttccctccccctctcctccctcctcctccctcctccctcctccctcatcttccctcctcccccttcctctcccttgccttccctcctcctccctcactttctctgcttctccctcatcttcctgtcaagtctgtcagtgccctctgctcacggggcaggttctggacttgttggtccccttcactctggggccaggaaacccatcccacctagaggggctggggctggggctggctgcttccacctgctttccctctgcagcggtgggtggcaggagctggcggatctgggtcatcctgagcaaggaactccagctgggggaagaggtgcagccctggccccttccagcccttggctgaacagtttcattttggacatgtgggcattttgctgatggttaaggactatccatttctggaatttctgaggaatgaagcatatttttgaacaggactctaatcagtaaccaaaaatagccgtgacacatcggcttctgagtctgccaactgcatatactataaagagcaccactgggaggtgcccagggccctctgcctcactccaactgtcacagccccactggggagtgtgaccagacccatttccatggttaatatttaattcctcagccctgaacacatgcagctaaatgaagtcactcctttcccataaatactagatgaagcagatgcaggtgaggccgggtgatggccctcgcccttgtgagttccactgccttcctcgggcctcggcctttgtctactgcctacttggccaagcaagcaagcacatgaatcccaccagccacagtgccagagaggagctgagtgggcaggagtggctgtgctcttgattcataaggtggttttgctttgctgccccgcagctcagaccttggacaggaagaacatttccctcctccacctgtgttctcagctgcagggggattccctcctcctccagagagtgttgtgcagagcacatgagatggtggggatccctggagcattttagaaatggaaaagcaccacatacaggagagggaccgctgctctcctttcccagcccccagcccggccattcgatctggaaacctatgctccacagcacagttggcccctgggtggtgcgtggagggaaggctttctgatgaggcagccgtgtgtgtcccatgtaggcaactgaaccaggaggccccacagtgcgcactgggcacgagagaccaggactggctgtctcgttcctctctgctgggcagtgcctagccaaggactcagcccggtctcttgtgtgcagccccagtgtgcctgggagtcctcccctggctaggccctgggctttccaatagcggaatgaggggcatgtggagttttgccagggctgagaaaggaggccctgtgatccgagaaaagcagcggtcaagataggagccatagaaatgccttgtaaacgataggtgtgctctcgacagaggcccctgcaaggggtaggaggtttctgggaggaggctgctggctgtgtcttagggccccagaattcagactgatctcccgggcctggtgccctgtgaagctgggagctgtggattgtcttgttaacctctgtgtgagcctctgttggaagagctgttagcaggacaagcattttcttaaaattagaggtgtcctttgtttgtattcagtgctagagaagctgaatctttcccaacaaaaataatttgcttattacctggtcaagctgatcagtgcaggtaaagtccctccctttaaaacaggtgtaaacacaggagccccagcaagatatgtcagctgctggggacacttagggtatctggaaggtgacagtgggaagtgtcgtggggttctggcaggacttgtgttcttgcactgaagtgctgtgcgctccccacagtatgcagcgccagggcttctgactcggatcagttgccctatgggctgccttcactcctcctcctgagaacaggcgaacgtttaaaagtagtaagttctctttgggaggctgaggcgggtggatcacgaggtcaggagatcgagaccatcctggctaacacggtgaaaccctgtctctactgaaaatacaaaatagtagccgggcgtggtggcgggcgcctgtagtcccagctactcgggaggctgaggcaggagaatggcgtgaacccgggaggtggagcttgcagtgagctgagattgcgccactgcactccagcctgggcgacagagccagactccatctcaaaaaaaaaaaaaaagtagtaagtttgtactttaaaaaacatccctcactggggcttctgccttcatcctctcctactaaagtttggagacctcactacctaatctttctcttggacaaaccgcatgcttcttcctgggctcgttgctgagcatccggggccaccctgactctgaaagacggtgtcccggcagagaacttgcttcacagctgtgtgatgccctttgctttcccagcccaccggagatcctccttcaactttgagtgcctgcgccggcagagcagccaggaagaggtcccgtcgtctcccatcttcccccatcgcacggccctgcctctgcatctaatgcagcaacaggtgagcggcccacctggccttgcccccacacctaggggcaccccacataggacccccatcaggtcactcccttctccttggccttaagcaccaggagggaaggagagaatcttcacctacagtctagttaatctttgtaacaatcctgtcaaatagctatggccatgagtcccatgctgcccaagctcacacaagtgactgctggcatttgaatccagggagccagctgccaaagctggcctcactgcccaggtgcctccctgcgatccccaccacctcttcctggcattgaatacagagcctgatgtgatctgagctcagggagtgggggccacttggctgattctgaacaagcggtgcagcccttcattttctctaagaagtggttccttcattaagtttatgggtccctccatgggcagggccctgtgggtactatgcagggttaacctcccctgcctacaaagggagcagtctggggagaacagtttgcccacgttgagggcggctgcacaggcaagagggtggggccggagcccactcactagggctttccctcaaggataacaatatggcgctttttctttctgaaaatatcacatcagagatgccattcattcgtgcacgacagggtggtgggcatggacctgtgctgtttacagacagcgttccccgtccctctctgcagagtgtgaaccccaaggtgcatctgccgtggtgggattgtaagaccggggcttgtacccagtgctttagcacatgccaaatgccggctctaggatgcattactccagagcaaagagaaccagctgttttcctataagtgctgggaagtggtagtttcccctgaatgtacttcggtatttaaacccagcatgaactgggtggtgtgttcacacccacagcttgttgggcttccctgattcttcattctgaagcaatttcatgaattagcaactgatacctccttgggaaaagccaaaggaaatgcattatggattcggggtaaaagaaagcacagtctgctagaaaacaaagtcatcaccgcccattcattcagcgtacttcagtgtgcccatgtcctttccaagtccttgcctggactgcccctggcgagcgcagcgccggtgcttggtctgtgcgcagaaggtttgaggcccggacctctgagaacctctggtctcccaacagtcccctctttcctcagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtgagtacggttcttggccgtggtgggcaggaagcaccaggagcagcagaggtgcaactgtaacagcaggaagggcagtggtgggagggcggccaggctgtgagctaggctgcctcaatcagacacttctgagcagcaggaatgtacctgaagcatgagtaaaaactggtcaccaccactggctgcagtggcttacgtctgtaatctcagcactttgggaggccgaggcgggtggatcacctgaggtcagcggctcaaagaccagccttgccaacatggtgaaaccccgtctctactaaaaatacaaaaattagccgggcgtggtggtgtatgcctgtaatcccagctactcaggaggctgcagcaggagaactgcttgaacccgggaggtggaggctgcagtgagccgagatcacaccactgcactccagcctgggccacagagcgagactcttgtctcaaaaaaaaaaaaaaaaaaaaaaaaaaaacaaaaactggtcaccaccgtcaattctcataaatgagctgtgctggcattatgggtgctgttccggcatatgtttctagtttatactaaatgtctttccccagtgggtttcactcttgttgggccatgtgtagttttttagctccaggacattttcaaagccatttacactagttattatgtatgaggtctagaaaacatgattgagctgcatccccaaagcacacggtgcagttaagttagcactggagttgatttttctgtcgtccccctgccctgcaaagccttataacacccccatgccatccatccctcttttctgtacaggtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaata

SEQ ID NO: 36961 - DNA, 129489 bp, Homo sapiens
atttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggtaagagagggcccgcgcgcagcctgcagcggccaggcgcgccggtcaccgccccaggcctgccccgcttggctctgtggtccccacccgccgaggccgcccccgcccgccgattccccgcacggccttccgcgccgccgccccggacgcccgcccggccgggatgcgactcgcgatgccgcacaagccgggcggcccccgcccgcctccagccggctcctcctggccgcatctccagggcggcggccgcgccacgggccgtttgggcgagaaagccaggcagggacggggcgggcggaggtcaatgcacagctccagagcccggcgaccggcgcccgtgggccgccccgcctcgggcctcgcccgagcatcccggagcctcagccccgtggtcctgcttagcctcctcgaggattcgggatcattacctcggcggttgtgctgcgctaaccaaagcccccagaggtggaggggaggtgcccagagccgcgcgagcccctcggtgggtgcccctgtgggaggaggttgcagagctaccgtcttcagtgcactgcttcggtttgggggagggcaggtgttgaaaggaagaacagataatactgtctacctctaacagtttactatgaagaaaagggaatcagtggtctgttgggcctgaaagcatcttacacaatagaggcaaagggttgtccttctagagcaccccctcttcttccaccaggtactgagtagatagatgcaggcccccagaggaagctggaggctggagatcatgaacaagctcatttcccataggaggtggggagggcagcctgaaggttactctgcagttctcttcggcagaatcggaagcagcaggctggcatttgtgcatgagctaagtgaggacaaggagtctaggttttcagccactgcacacaggctctgtggcctgcgaccggtcctatcctgcttgatgaactaccaggagtgagagctgctttctgttttggtagtgggttcctcacatttgggggttgggcatcacagactgaccttgggctcaagccaagtccaatagaagcaagttactttcctgtagatgttgacatctccaggaaggctgggcatatagcaagtcctgggtctatggcgattcttgactctcagtctcatcttctggcctggtcgagggcctctccttacctcaaggtcggttttgacttttccagagggggaacgtctttgggggagccctgcccctttgactttggctctgtggctgttctggtcccatcgactctggaggtggggaaagcggggcaaaaaaaaaaaaggaaataactggagacagacagcctgcatcaggttcctgaatcagctctgctgagtattggctgggaaacttgggctccatggtttgcaaagagcttatacctgtctcatcccacttggtttgcccaattccctgggaggttgatggtcggtagtgccacccttacctgtgtggaggaggaaatggcagttttgggagttgagtaactgtgtaaggtcatcctgctccaggagatccagggacagcccctgcccaagtcttctgactccagatccagtattcttcccacccctctcctgaataaaggaaaccttgatttaaatcttcccgtggaaggctggccttttatttacttcttcagggtggtgaatagccaatttatacatgttgtcttttttcacccagcttctaacagttactagattttttgttttttgagacagagtctcactctgtcacccgggctggagtgcagtggcccgatctcagctcactgcaacccctgcctcctgggctcaagtgattcttgggcctcagcctcccgagtagctgggactacaagagtgcgccaccacgcctggctaatttttgtgtttttagtagagatggggtttctccatgttggccaggctggtctcgaactcctgacctcaggtgatctgtgatctgccctcctcggcctcccaaagtgctgggattacaggtgtgaaccaccgcacccagctggaaaaagttcttgtgcctcagcctcctgagtagctgggactacaggcgtgcgccaccacgcccagctaatttttgtatttttagtagagatggggtttcatcatgttggccaggctggtcttgaactcctgacctcaggtgatcctcccgcctcagcctctcaaagtgctgggattacaggcgtgagccactgctcctagcctagttactagatttttgtatagctttagacacttccatacagtaagtgtgtgctttttgtttgtttgtttgtttgtttttgagacagtctcgctctgtcacccagactggaatgcaatggcacgatctcagctcactgcaacctctgcctcctgggttcaagcgattcttccacctcagcctcctgagttgctgggattataggtacccgccatcatgtctggctaatttttgtatttttagtagagacggggtttcaccatgttggccaggctggtcttgaactcctgacctcaggtgatctgcccgcctcggcctcccaaagtgctgggattacaggcgtgagccactgcgcctggcccgtgtgtgtgctttttcttacccactgtaaaccaagtctgctatctcaggttcacaattgcatattgtttctttattttttggagatggagtctcactctgtcacccaggctggagtgcggtgacacactctcggctaactgcaacctctgcctcctttgttcaagtgattctcctgtctcagcctcccgagtagctgggactacaggcgtgcaccaccgtgcccagctaatttttgtatttttagtagagatggggtttcaccatgttggccaggctagtctcgaactcctgaccttagatgatctgcccgcctcggcctcccaaagtgctgagaattacaggcatgagccaccgtgcctggccaattgcatattgtttctaagtggctgccttggccagacgactggtgaggaggatgcttggctgcccctgctcatgagtgagcaggtgagcctcaggtgcagagcgtgactgccaaaggagtaggcgggagtggtggtaggggtaggcctgtgaagagaaggctgtggttccatcggcttgactcagagaaaccgcaggacactggagagtgactgtactaggatggggagccctttaaggacatctgagctgacaccccaagttgaaagaggagcctcctggcctagcacagccaagcccatgaatttaacaatgctttactggacactgccaagaagcatagcaccaggagggaaacgtgtggaaaatgtggcccctgccttaaggggtcacagtctagcaggggtgagaacgtccaaattcccaccatcttagacacaatggtcacatgttctcagttcagacattgttgaagggataggggcttttttttctttcttttttttttttttttgagagggagtcttgccctgtcccccaggctagatgccatctcggctcactgcaacctctgccttcgaggttctactgattctcctgcctcagcctcctgagtagttgggattacacacgcccgccaccacgcccagctaatttttttgtatttttttagtagagatggagtttcaccatgttggtcaggctggtcacgaagggaacagaatttttaattgcatcaatttaaattcaggtgggtagccacctgtggctggtggctatcttttggggagtgcaatatgtagagaaatttaaacatcaatttactagtaggtctgtggggggcagggtgttcctaaaggaagctccaaggctttctggggactgtagccagctctggaataaccatgctgatggagggggaccttggcatggacaccacccagcaggcagataacttggcatgctttatttataggtagatgtgtgaaatctacaaggtttttttgtgttttctttgcttgccatgctcttagatgcagatctaccaggaagtttcctgagatcaggaattgtgttgtaccatgtggtaccatgaatgcctagaatagtgtctgaggtctagttgacaggtcaataaacagcagctgagtggctatgagtttcagtatgttatggggttagaattatttcccccaagggaaaagacaaagaggggctctacctttgtcttttttttttttttttcttgagacggagtctcactctgttgcccaggctggagtgcagtggcgcgatctcggctcactgcaagctccgcctcccgggttcacgccattctcctgcctcagcctcctgagtagctgggactacaggcatccgccaccacacccggctaatttttttttgtatttttattagagatggggtttcactgtgttagccaggatggtctcgatctcctgaccctgtggtcctcccaccttggcctcccaaagtgctgggattacgggcgtgagccaccgcacccggcctttttttttttttttttttaagagagtctcactctgtcacccaggctggagtgcagtgacaggatcttggctcactgcagcctctgcctccccagttcaagcaattctcctctcctcagcttcccgagtagctgggactacaggcacccaccaccacactcggctaatttttgtatttttagtagagacggggtttcactgtgtttgccaggctggtctcgaactcctgaccttaagtgatctgcccgcctcggcctcccaaagtgctggaattacaggtgtgagccactgcaccaggccgggctctgtctttggttttataatggaattaatgaaaagaaagaacctggccaggcgctgtggctcacgcctgtaatcccagcactttgggaggcccaggtgggcggatcacgaggtcaggagatggagaccattctggctaacacagtgaaaccccatctctactaaaaatacaaaaaattaggcgggcgtggcggtgtgcgcctgtagtcccagctgctggggaggctgcaggcaggagagtggcatgaacccgggaggcggagcttgcagtgagctgagatcccgccactgcactccagcctgggcgacagagtgagacttggtctcaaaaaaaaagaaaaaaaagttagctgggcgtagtggcgggtgcctgtaatcccagttacttgggaagctgaggcaggagaatcgcttgaacctgggaggcggaggttgcagtgagccgagattgtgccattgcactccagcctgagcaacaagagcaaaactccgtctcaaaaaaaaagaaaaaaaaaaaaacaaagaacctgatttacagaagccacactcagagcttgtattctggagcattccgcaaaatgatttacagtgctggctctcttgctgctgggatgtgtggaccctgggtgaagatgcagtctttgtaacccagagagcctgtgcgtggggaggcctttgtctacccactgtccaacctcacgctgtaagtgggccacttagcctggcattgccctggaattggcacctgcagctagctggctccccagttctggtcagaccagaagtggctttctcctgtgtgacccacctggcctgtgtagcctgcaccagggggtgaccccataggctgtcttgccatcccaccccttggcctctcactctcagagccctcctggggagggggatcaaggatgtgcctccccatccttggacccctgcatgggaataactggggaagtctgttacaaatatgggttttctgcatgtgaacagtacttcagcagagagtcaacaagatgaagattgaggagataatggggaaacttgaatagtcccttgataatgattttaaggaatcactgcttttttttttaaggtaggataattgttttgtagtttgcttttttaaaccagctttattgagatagatttagaatgcatacacaagaatatttgaaacgtacagtttgctgagttttgatgagtgtgcacactgagtagtggcgggcccagttgtgatgtcgaatatttccaaactcccaaaattcccctactgttggcccctggcaaaaagatctgctttcactcactcgctgtgcctcttctagaatttcgtgtcgatggaaccggatcgagctcagtgctgggcctcgctcctgtgtccccgtagccctgtattaccctgttccctgcacactgcagtttctcttcaccaggccacagagacttgggatcttgtgaatgaagttcacaaatgcagatttcaattcatttaggacagaaacgtgaagtcacttgctatttaatgatattaggaatttggatgatattttagatgagatctttgttttgtggtttttatttttatttgagacagggtctcgcttagttggccaggcaactaagtggtgcagtggtgcaatcatggttctctgcagccccaaccttctgggctcaagggattctcccacctcagcctctcgagtagctgggactacgagtgcacgcctctgtgcctggctaatgttaaaaagattttttgtagagacatgatctcactttgttgccgaggcaggtcttgaactcctgggctcaagtgatcttcccacctcggcctcccaaagtgctggaattgtgggcatgagtcaccatacccctcctttaggtttttcacaaggagcttttatctttgagaggaaatgcagacatatttacgatgtcgtactgggaaatccgggatttgctgcagaataacctggcatggggagcaggtgggagcagagaccagaggtgccctgagctgactgttttggggctgcttgatggggacataggggttcactccctcctccctctactcttgtaagcatttgatgtttaccacaatgaagaataaaaagaaaaccaggctcctgagcctccaccccagagctactgcctctaactccaggggcggggaaggtcagggaggggtaggcccaggaatctgcattttcctcggccctcctggagcttgagggccactgtcagaggagggccaggcacctgccgtgttgtgcggtgtgttggccttcctcggcttccccgcagccttccagctctcccggtgcctgtgagccaagacctctctgcccaggtggaactccgcccaggtggaactcattcttctacttgcctgagggccagcctgagtggtgcgaggtttaaggtcctggaggtgggaacccttatgagtgttgcttgtggccccacccagttcatcctctcccgcagaggggtggtggccctgtcctgtttccctgtctgtgagttcaggccgagtcatggattccttgcatcactggtcttttgtagagaacatcctgtgatccagttccggaagccgaggaggcggcttgccgggggctggtgggggaggggcggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggtaggatgactgggaatattttgtgcccatggtgtctcacttgcgacgccgactgggcagccagggccttgggccgcataacttggaggagttttggggagggtagtagggtcgggtgttggatgagctgtgtgttttgctggattgaaagtgcccacttaagtggccaccctcagtggagacctggcatgttcttcccctagggacgagcggaacacccgggctttgttggaggaggtgacctggcaaccctgggctgtgggaatctgggcctctgcagatcaaggctcctgcaagccagcagctgtgctggctcacagctggcagctggcatccgtgccctgctttgtccctaggctggatgttgagctgtgattttagaccagaaggttggtgcagggccagagggagctgttcctgcacgattggctgatcctaacagtgcagtgttgagctgcttacagatggcttttgcatactttatttctcctaaactttacagaaactctgttgagtgggcatacatacctccccctttgtgccagctttattgggttatagttcacatgccatacaattcattcactaatgtgtacaagctagtagatttcagttttatgttcacagagctgtgggatcatgacctccatcaattttgaaaggggtggtaggaggattttttgttctcctgacatggagctccccaagcccttgggacctttgtagtcctaagagtgtctagtatgctaatgagagaactggtggctgggggccctagatatagcttcaggatgggagctggtctccagaaaggccaagggaggattagcgggttagcgctttcaaccttaccttcctataccgcagaaggtagtgccagactttacttgaattgtaggacacccacctagtgtcggagagttggagaagtggggttgaaagagacacccatgtttgttattaaaagcatgagtaaaaacagctcgcctaggaatataatttttgggtcatatggtaattttgtggttattctcttgaggaattaccagactgtttccaaagtggctgcaccatttcacattcccaccagcagtgtaaaaaggattcaatttccccatatccttgtcagcacttgttattatccatcttttgaattctagccatgctagtagatgtgcagtggtatctcactgtggctttgatctacatttccctaatgagagaagatgatactgagcatcttctcatgtgcttattgaccactgtgtatttttagagagctgtctagtcaggtctttcctgtattttccaattggtgtaattgtctttttgttgttgagtgatgagagctctttatatattctagatgcaagtcccttctcagataaaattttttaattaagaaaattttccaattcaaaaaagttgtcagcctgggcaacatagcaagatctgatctctattaaagattaaaaaattagccagatgttggctgggcgtggtggctcacacctgtaatcccagcactttgggaggccgaggcgggcggatcacgaggtcaggggatcgagaccattctagctaacacagggaaaccccatctttaccaaaaatacaaaaaattagccgagtgtggtggcgggcgcctgtagtcccagctacttgggatgctgaggcaggagaatggcttgaacccgggaggcggagcttacagtgagccaagatcgtgccactgcactccagcctgggccacggagcaagactccgtctcaaaagaaaaaaaaattagccagatgcagggtaggtggggtgtgcctgtagtctcaaccactcaggagattgaggcaggaagattgcttgaacccaggaagttgaggctgtagtgagcttattgcaccactgcaatccagcctggacaacagatcaagactcttgtctctcaaaaaaaaaaaaactgtgttaaaatacacataatatataatttaccgttaaaaaaatctgccatcaggccgggcgcggtgactcacgcctgtaatcccagaactttgggaggctgaggcggatggatcacgaggtcaggagatcgagaccatcctggctaacaaggtgaaaccccgtctctactaaaaatacaaaaaattagccaggcgtcatggtgggcgcctgtagtctcagctacttgggaggctgaggcaggagaatggcatgaacccgggaggcggagcttgcagtgagctgagattgcgccactacactccagcctgggcaacagagcaagactccgtctcaaaaaaaaaaaaaaaatctgccatcttagccgggcatggtggctcacacctgtattcccaccactttgggaggccaagctgggtggatcacctgaggtcaggagttggagaccagcctggccaacatggtgaaaccccgtctctactacaaatacgaaaaatagctgggcgtggtagcccacgcctgtagtcccagctacttgggaaactgaggcaggagaatcacttgaacctgggaggcggaggttgcagtgatccaagatcgtgacattgcactccaacctgggtgacaagagcgaaactctgtccaaaaacaaaaaaaaaacaaaaaaactgccatcttaatgatatgtgtatatgtatatggttaagatggcaggttttgttttgttttttaaattgagacagggtgttactctgtcttctggggcgcatgtggtggtgcagtctcggtcactgagcctctacctcaagtgatcctcctgcctcagccacccgagtagctgggaccacaggcatgtgctaccatacctgggtaatttttgtagtttttgtagagacaggatttcgccatgttggccaggctggtcccaaactcctgagctcaagggatctgcccatctccgtctgcctcctaaagtgctgggattacaggtgtgagtcacagcgcctggctaccatatacgtatttgtagccatattttcttgctctgtcacccactacgtctcactatgtttcccaggctcattttaatcatttttaaatgtccagctcagtttttttgttttgttttttgtttttgagacagagtctcgctctgtcgcccaggctggagtgcggtggcacaatctcggctcactgcaagctccgcctcccggattcaagcgattcttctgcctcagccccccgcgtagctgggactacaggtgcccgccaccacgcccagctaatttttgtatttttagtagagacggggtttccccatgttggctagaatggtcttgacctcgtgatccgcctgcctcggcctcccaaagtgttgggattacacgcgtgagccaccgcgcccggccaagtcttgcactttcgcccaggctggagtgcagtggcgcaatcttggctcactgcaagctccgcctcccgggttcatgccattctcctgcctcagcctcctgagtagctgggactacaggcgcccaccatcacgcccagctaattttttttttgtatttttagtagagatggggtttcaccgtgttagccaggatggtctcgatctcctgacctcatgatccacctgcctcggcctcccaaagtgctgggattacaggcgtgagccaccgcgcccggctcattcccttccttttaaagactgaatcatgttccatttcatggatggaccacattttgcttattccatcatctgtggatggacacttgggttaatcccacattttagcttgtgaataatgctgctatgaacacagcagagaccccgtttttagttctttaggatatattcccagaagtggaattgctggatcatatggcaattctattttaaatctttaaagaaacgaccatactgttttccacagcggctatgccattttacatttccaccgacagtgtacatgggttctggtttctgggcatccttgtcaatacttgttattttctgtttttttttgatagttgccatcctaatgggtgtgaagtggtgtttcattgtggttttgctttgcatttccctaatgtttagtgatgttgaatgtcttttcatgtgtttatttgtcaactgtattttttctttgtagaaatgtctactcaagttgtttgctgatttttgaatcaggttttttttaaaactgaaaattaaatatattgctaaactgtttgtatatttattcatatacttgaacatagacatgtataggtgtatatattatgtgcatgttatatacatatccttgtgtatctatataagtatccatgtatatatttttcaaattttcatcagtattctgaaactgaagactatagcttttggtgtttgagaaagtccgtgtccatttttgcttctattgtttttgacacataataattgtacatatttatgggtatagtgtggtattttgatacatgaatgcaatgtgtatggttggtttttttattgttgcgttttaggagttctctatatattctggacactaatccctcatcagatatatgatttgcaaataatttctcccattctgtgggatgtgtttatactctgttgatattgtctgttgatgcacacattttaaagttcttatgacatacaatttgtctgttttcttttgttccttgtgcctttgatgtcatagccaagaaatcatcaccaaatccaatgttgtaaagctttagccttatgttttcttctaagagttttatagttttaggttttacttttcggcttatgatccattttgagtttttttttttttttgtatatgctattaggtaaaggtgcaactcattcttttgtgtgtaaatatccagttccttagcaccatttgttgaaaagattgtctttccccattgagaggtcgtcttcttgttttttttttttttttgagacggtcttgctctgttgcccaggctggagtgcagtggcgtgatctcagctcattacaaccttcgcctcctgggttcaagcctcagcctcctgagtagctgggattacaggcacatgccaccatgcctggctaatttttgtatttttagtagagacggggggtttcaccatgtcggtcaggctggtcttgaactcctgacctcgtgatcctcccacctcagcctcccaacatgctgggattacaggggcgagccaccacacccggccgaaaggtgtttatacccttgtcacatagatcatttgaccatatatatcatttgagtttatttctgggctctctgttctattgattcttatatctgtctttatgctaatgccatactgttttgattattgtagctttgtggtaagttttgaaatcagaaagtgtgaatcttccagctttgttctttttcatgattgtttggctatttccgatgtgatttgcaaatatttttttccactcactgggttgtctttttactttttctttgctgtgatgcccaggctagagtgcagtggcatgatctcagttcactgcaacctccgcctcctgggttcaagtgattcccctgcctcaacttcccaaggagctaggactacaggtgtgcaccaccacacctggctaatttttgtattttttttccagcagagacagagtttcaacacgttggccaggctagtcttgaactcctgacctcaagtgatatgcccacctcagtctctcaaattgctgggattataggccaccacacctggcctattttctttaaagagttttataggatagatgctgtggctcacatctgtaatcccagcactttgggaggtcgaagtgggaagactgcttgagctcaggagttcaagaccagcctgagcaacataggaagaccccatctctacaaattaaaaaagttagccaggtgtggtggtgcatgcctgtagtaccagctacttgggaggctgaggtgagaggattgcttgagcctgggaagtcaaggctgcagtgaagtgagttagagaccacagcactgcactggggcctgggtgacggagtgagaccctgtctcaaaaaaaaaaagttacatagctttagctcttaccatttaggtgtttgacctatcttgagttaattgttatgtgtgatgtgcggtaggggtccagctccatttgcacgtgtggacacacctctttataggctggggagcaggcattagaggtggagctacttgcttgccgtcacagctggcaagtggaggccaaagacagccgctgcatcctttctttgaactcttatacctgagggtcatttatctctgacctggaggacagaaacagaaagcccttgagcaggctgagcgcagtggctcacgcctgtaatcccagctctttgggagaccgaggtgggcggatcatgaagtcaggagatcgggaccatcctggctaacacggtgaaacccctctctactaaaaatacaaaatattagccaggcgtgatggcgggcgcctgtagtcccagctacttgggaggctgaggcaggagaatggtgtgaacccgggaggcggagcttgcagtgagccgagattgcgccactgcactccagcctgggcaacagagcaagactccgtctcaaagaaaaaaaaaagtccttgagcaataataaaactaggactctagggacattacttctcaggggcaggccacgccgtgcacctgtccacatctgtttccctccccttgctgaacaccagcccctgccctcgccagcctttctgtcctccttccctcctcctccccctaaatgttcatctgtggcttttgcctgtcccatggcacatgataggctctcgctgtctgggcctccctgggggtaggtccccacaggagaccttaccagggccatgccagacagctcagatgtctctgtgccctgccttgaatcctttggcctcagggctggaggttcagctatggcaggtcaggggctggcagctgagctgtgtgaggctgggagcttctctgagccttgggagagtaaaggaaaccaagtccctgattcaggagggccagagcattcctcttgctggctgtgtgcccatgagcccgggactgggagaaggcccaacggtacctgcccccatgggacttgttggctgggacctgggaaggcccgtggtctgtgtgctttgctgtaaaatgtatcactgggggactggaccatctgccgcagtctggcgctatcgaggagcaccccggccaccagcagagggcatgctgatcatagacactgcccctccctccctcccctcccgacaatctccaggccaccagttccagtcttaccttgagccactacctctcgggcacccagggctgctctggtggaattaatttgaacagtggtggcattgtagcgagtggatgctttggccttgtaactggtgccgttgtttgtttgtttgtttgtttgtttgttttgacgagtcttgctctgtcgcccaggctggagtgcagtggtgcgatctgggctcactgcaagctccacctcccaggttcacgccattcacctgcctcagcctcccgagtagctgggactacaggcgcctgccaccacacctggctaattttttgtatttttagtagagacggggtttcaccattttagccaggattgtcttgatctcctgaccttgtgatccgtccgcctaggcttaccaaagtgctgggattacaggcgtgagccaccgcacctggccattgtttacagtaagtgccaaactttgatgtttgtgtgtttctttgctgttttgttgctgtgttcactcaggtgtcgcttgtatttagaactcagcttttacaatggaattgcttttgatactacactttggtgtctcaggaaactacatcctgcatgattgatactctgtgcttcctttaatgacaggcaaatctcaccttgtcttgtaccttataaaagccaggctcttagaagtggtgacactcataaaccagcctgaagttgctgaattgacccatgttatctgacacctattaagattctactaagattcttaattcacccatatccagcttgaatttttacttgattttgcatttaattgcttccatgtacctactaagtttttacataatgtatttttttattatttaaatagagatggagtctcgctatgttgtccaggctggtctcgaactcttgggctcaagtgatcttcccgcctcagcctcccaaagtgctaggattataagcgtgagctaccacacttggcctttacatgtatttttttaatgtctttaatggaatataggattgatttaattgaagagtacatttagctttgtacaaaactgccaaactgtcttccaaagtggctgtgccattttgcattctcaccaacagtgaatgagggctcctgtgctccacatcctcaccagcatttgatgttgtcagtactttgggtttaggccattctgacaggcatgtagtggtgtctcagtgttgttttaatttgcagtttccaaatgacataaggtgttgagcatcttttcatgtgcgtatttgctgtctgtatatcctcttatatcaggcatctgttcgggtctttggccctctgccgccaccctcccaccttattattatttatttttattttttattttttagacagagtctcactctgtcgccatgttcgctctgcctcccaggttcacgccattctcctgcctcagcctcccgagtagctgggactacaggtgcccaccaccacgcccagctaatttttttttttttttttttgggatggagttttactcttgttgcccaggctggagtgcaatagtgccatctcggctcactgcaacctccgcctcccaggttcaagctattctcctgcctcagcctcccaagtagctgggattataggcacatggcaccacgccatgctaatttttgtattttttgtagagatgggattttgccatgttggctaggctggtctcgatctcctgacctcgtgatccacccgcctcagcctcccaaagtgctgggattacatgcatgagccaccgcgcctggcccctcccaccttatttttaaagagtcttgctctgtcaccgaggctggaaagcggtggtacaatcacggctcactgtagcttcaacctcctgggctcaggtgatcttcctacctcagcctccctagtagccttgactacaggtgcaccctactgtgcctggctaatttttttgttggtttgtttttgttttagaccaagtttcttgctgtttttcctcaggctggagtgcactggcgccatctcagctcactgcaacctcctgactcccaggttcaagtgattctcctgcctcagcctcctgagtacctgggattaaaggcgcctgccaccacgcatggctaatttttgtacttttaatagagacagggtttcaccatgttggccaggctggtctcgaacttctgaactcaagtgatccgcctgccttggcctcccaaaatgctgggattacaggcgtgagccactgcgcccagcacctggctaatttaaaaaaattttttttttttttttgaggtggagtctcgctctgttgcccatgctggagtgcagtggcacaatctcggctcactgcaagctccacctcccgggttcatgccattcttctgtctcggcctcccgagcagctgggactacaggtgcccgccaccacgcccggctaattttttttgtatttttagtagagacggggtttcaccgtgttaaccaggatggtcttgatctcctgacctcgtgatccacccgccttggcctcccaaagtgctgggattacaggcgtgagccactgcgcccggcctaaaaagtttttttgtagagacagggtctccctatgttgcccaagctgatcttgaactcctgggttcaagcgatccttctggcttagcctcccaaagggctggaattaatctccaagcagggattgcaggcatgtgccaccacacccagctaatttttggggtttctctacgttggccagactggtctctaactcctggcctcaagtgatccgcccgcgtctacctcccaaagtgctgggattataggcatgagtcaccgcgcctggcctcttattgttgagttttaagatttctttgtatattttagatacaagttgtttatcggatatatgttttgtaaacattttcctcagtctgtggcttgtctccattatctttttttttttttttttgagaggagtctcgctctgtcgcccaggctggagtgcagtggcgcgatcttggctcactgcaagctccgcctcctgggttcccgccattctcctgcctcagcctcctacaggcgcccgccaccacgcccggctaattttttgtatttttagtagagacggggcttcacagtgttagccaggatggtctctatctcctgatcttgtgatccgcccgcctcggcctcccaaagtgctgggattacaggtgtgagccaccgcgcccggcctgtctccattatcttaacagtgtctttctcagagctgaaatctttaaatcaataaagtgggaacttcagccatgtaactgatcaggatgaacaggggaagccatcgttttcagcagatgccaaacttggtttttctcctctgactcttgacgtggttgttcccttcaactggccgagacctaggggctcactgatgccggggtttgtcctaggttagacggggagtctgtggaatagtgtagggtgtcccagccacggagaactctcagcttggcagtttaccctccatttacaggtgaagacactgaggccctccaggcgcagtgacctaggggtgtgtggcaggtggggcagggaccccagtagagtgcagacctcacctccttggccatttccacctgcccctcatccaccatgtggcctgcaggtggtgcgtggcaggttgtggtgcttgatctccaggatgttgggcaaggcagagtccttggcccccacgctgtggagctcagcttctccccacaggccccaagcctgtgtgttcagggcatcctccttgacatttggagagtgagactcagggtggccgtactgacccactggccccatactctggaagtacttagggcctgctggtctgcccactgagggacatgccttcagtccccatgggcctgtgggagggctttaaccagtgcctggctgggcagggctcttagtcttagtgactccctaactggagctcccagggccatttggccacctccctcccgcctctgtttgggctgagggacgtgggcgcagctgccagcatggggaccaggcctctgtcctcaggtgacttcatcgcacctgctgccaccttcccttgcagaaattggcagaattccaggaaacttgcccagagtaagtgcctcaagtagaaacaagcccaatgcatttgccatggatatttaattctctaaaaggcagaggtgggaggtgaaagagatacttatttaaacagagttatacaggaataatttctataactgcacatatggaaagtattcagtttgatcagttttgacctaggtacagacagacttcctttcattgcactttgcaggtcctgcatttttttttttttttttaagatggagtttagcttttgttgcccaggctggagtgcaatggcacgatctcggctcactgcaacctctccctcctggattcaagcgattctcctgcctcagcctcctgaagggctgggattacaggcgcctgccactgtgcccagctaatttttgtatttttagtagagacggggtttcaccatgttggtcaggctggtctcaaactcctggcctcaggtgatccacccaccttggcctctcaaagtgctgggattataggcgtgagccactgctcccagccaggtcctgccttctttacaaattgaaagtttggggcaggcgtggtggctcaggcctgtaatctcagcactttgggaggccgaggcaggcggatcacctgaggtcaggagttcgagaccagcctggccaacatggcgaaaccccatctctactaaaaatataaaaaattagctgggtgtggtggcatgtgccgtagtcacagctacatgggaagctgaggcaggagaatcacttgaacctgggaggcagaggttgcagtgagctgggatcatgccactacactctagcctgggcaacagagcgagactccttctcaaaaaaaaaaaagtttgtggcaaccctgcattgagcaagtctattggcaccatttttcggccagcctgtgctcatgtagtgtgtctatatcatattttggtaattcttgcaatatttcaaactttttcgttatcatttttgttatggtgatctatgaccagtaatttttggtgttactagtgtaattgttttgagacatcacgaaccacgtccatgtaagacagcaaatgaaattgataaatgttgtatgtgttctgactgccccactgaccggctatttccccatctctctcccttttcgtgagctccctcattccctgagacacaacaattttgaaattagaccaattaataccctacctctagtgttccagtgaaggagagagtcacacatctctcactttaagccaaaagccggaggccaggcacggtggcacatgcctataattccagcactttgggaggctgaggcggttggatcacttgaggccaggagttcgagaccagcctggccaacatagtgaaacgccatctctactaaaaatacaaaaaactagccaggtgtgttgacatacgcctgtagtctcagctactcagaggatgaggcagaagaacctcttgaacccagaggtggaggttgcagtgagtcaagatcgtgccactgcactccaacctgggcgacagagcgagactctcaaaaaaaaaaaaaaaaaagccaaaagttagacatgattaaacttaggaaggcatgttgaaagctgagataggctgaaagctaggcctcgtgtgccaaacagttagccaagttgtgaatgcaaaggaaaagtccttcgaaggaaattacaagtgctgctccagtgaacacatgaatgataagaaagcaaaacagccttcttgctgataacggagaagaagaattttagtgatttggagagaagatgaaatcagccacaacattcccttaagccaaagcctaatccagagcaaggccgtaactctcttcaattctatgaaggctgagagaggtgaggaagctgcagaggaaaagcgtgaagctaacagaggttggttcatgaggttgaaggaaagaagccacctccataacatgaaagtacaaggtagagcagcaggtgctgctggagaagctgcagcaggttatccgaatctggctgagatcaccggtgagggtggctacacaataggttttttcttttttttttttttgacacagagttttgctctgtcgcccagggtggagtgcagtggtgcaatctcggctcactgcaacctccacctctcaggttcaagagattcttctgccacagcctcccgagtagctgggtctacaggtgcacgttaccacacctggctaatttttttatttttagaagagacaggatttcactatgttggccaggctggtctcgaactcctgacctcaaatgatctgcctgtctcagcctcccaaaatgctgagattacaggcgtgagcccctatgccctgcctaggttttcagtgtgggtgaaacagctttctgttgaaagaagataacatctaggactttcatagctagggaggaaaagtcaatgcctggcttccaaggacaggctaggtctggtgactcacgctgtaatcccagcactttgggaggctgaggcgggtggatcacttgaggtcaggagtttgagaccagcctggccaacatggcaaaaccctgtctctactaaaaatacaaaaattagctgagtgtggtggcacttgcctgtagtcccagctactcaggaggctgaggcaggagaatcgcttgagcccaggaagtagaggttgcagtgagccaagattgcacctgccacagcactccagcctgggtgacagagtgagattctgtctcaaaaaaaaaaaaaaggacaggctgactctcttgttaggggcttatacagctggtgactttaagttgaagccaatgctcatttactattctgaaaatcctagggcccttatgaattatgctaaatttactctgcctgtgttctataaatggaacaacaaatcctggatgtcagcacatctgtttatagcatagttttctgaatatttttaagcctgccgttgagacctactgctcagaaaaaagatttctttcaaaataatactgatcaggccgggtgcggtggctcacgcctgtaatcccagcactttgggaggctgaggcaagtggatcacgaggtcaggagttcaagaccagcctggccaagatggcgaaaccctgtctctactaaaaatataaaaattagccaggcgcagtggcaggcgcctataatcccagctactcaggaggctgaggtaggagaatcacttgaactcaggtggcagaggttgcagtgagccgagatcgcaccactgcactccagcctgggcaatagagtgagactctgtctcaaaagaaaaaaaaaaatcaaaataatactaatcattggctgtgcgtggtgactcatgcctgtaatcccagcactgtgggaggccaaggtggttggattacctgaggtcaggagctcgagaccagcctggccaacatggtgaaaccccatctctactaaaaaatatacaaaaattagttgggcatggtggtgcatgcctgtaatcccagctacttgggaggctgaggcaggagaatcacttgaaccagggaggcggaggctgcagtgagctgagatcgcaccactgcactccaggccaggtgacagaacgagactccatttcaaataataataataataataataataataataataataataataataatactaacactgctcattgacaatagacctgataaaccaagagctctgatggagatgcacaaggagattaattttgttttcgtgcctgctggctttagtccatttgtgtggctgtaaaggaatgcccgaagctgggtaatttatgaaggaaagagctttatttggctcatggttctgcaagctgtacaggaagcatggcaccagcatcttcttctggcgagggactcaggccacttctacttacagcagaaggggaagggaagctggtgtgtgcaggtcacatggccagagaagtgagagagaagggaggtgccaggctccttttaactattagttctcccagaggctaataaagtgagaactcactcatgaccacgaggatggcaccatgcccttccagagggatccatcctgtgacccaaacacttcctattaggtcctgcctccaacattgggattgaatttcaacatgaggttagggatcctcatatccaaaccatagtggataatagcacctattaactcaacatccattctgcaacctatggatcaaggagtaatcttgactttcaagttgtattgtttaagaaatgcattttgggcctgtaatcctaacactttgggaggctgaggcaggtggattgcctttgttcaggagtttgagactagcctgggcaacatgttgaaatcctgtctctacaaaaaatacaaaaaattagccgggcgtggtggtgggcgcctgtagtccaagatacttgggaggctgaggcaggagaatggcatgaacctggaaggcggagcttgcagtgagctgagatcgtgccactgcactccagcctgggcgatacagcgagactccatctccaaaaaaaaagaaaaaaaagaaattagctggacatggcaacatgtgcatgtagtcccagctactcaggaggctgaggcaggagaattgcttgaacccaggaggtggaggttgcagtgagctgagattgtgccattgcactccagcctgggcgacagagtgagcctccttctctacaaaaaaaaaaaaaaaaaaaaaaagaaatgcattttgtggggctctggctgccatagtggttcttctgatctgggcaatgtaaattgaaaaatttacattggaaagcattcactattctagaagccattaagaatatttatagaccaggcgaggtggctcacgcctgtaatcccaacactttgggaggtcaaagtgggtggatcacctgaggtcaggtgttcgagaccagcctggccaacatggtgaaacctcgtctctactaatacaaaacgtagctagatgtggtggcatgtgtgtgtaatcccagctactcaggaggctgagtcacaagaattgctttaacctaggaagtggagaggttgcagtgagccaagattgtgccattgcactccagcctgggcaacagagcaaaaaagaaaaaaaaagaaagtggtttcttaagatggaatgtagtcttggggaagatgccatgaacattgctgaaatgacaagaaagtaatggcaatggtgggccatctggagcaacccctgccctcacgccaggtgcagtggggtggtgcaagcagtggtggcaggagcagctgtgggagcagcagtggcagcagcagtggcagcagtgggtcccctgtgccctgcattccccgggcagctgactgcaccgcccccatccttgcacagccaggcaggacctgctcccaggcctggagccttgccgctccagaccctggctcagtgtcagagctcttacccgctctcactgtggggaggggtgtgcagaggaaatagtcagtccctggagtctacccctgggagtctcccagagcccactgccctgggagccaccacaacggggccaggctgagttgcctgctggtggggaagcagcatgattgggcatggaggtgcgggcagagaggggccccaaggtggagctgggcctggggtgatgctgcacctgcatatggagtgtgggggctgggcctgggatgcagagcttgggttatgcttcagggccctggggcgggaagtgggagcggcattcactttggggacctggactgcggtgcagccaccgcacccaccctgctgatggtgcccttcagactttgggcaccaacaggcatgggagggaggccaagtgggggctgaggataggctggcacaaacagcctggatgccatgaacagtggcgagagacagacaggctcctgggtagaaggggtctggtccccagtgaagcctcaccttcaaactggggagggcctgaagcctgggggttggctggccagtcccgaggaccagaggggaagcttgtggtgctttttgctggcccacccatggaccagtcaacacacacttcctccactctgaggcccataaaaaccccggactcagccagactagagcagaggacagaaagatgacaggatgaccagctgcaaagaagagctaccctctctgctgagagctgaacactcactgggatgacctggctgtgactcaataaagctcctctttgtcttgctcactctccatttttctgcgtacctcattcttcctggtcacagggcaagaactcgggacctgccaaatggtgaggctgaaagaactgtaacacaaacagggctgaaacatgccccttcttgccacgttgccagtgaagggaaggaaagaagagctgtggccctttggggagtccagacctgggagctccctgagtcagggttgtgactccctctttggggccctgcagttcctggcgtcaccaagcttccaggcaccacagcattcccgtgtgccaaccaggcaagctgcttgaggtgcgcttggtccaggtgcagccttgcagagaaccagcacctgtgccagcatctggagctgcctgccctgcagcagcagctggcatgtctgactgtgcagtggccgtactccatgctcactcacacactgctcgctgctccacaccaggcttgtccttggcaggcatgggagctccaggctggtagcatgagccaagcgcagcctgccaggctgagtgggtggaataagcccagtgggccccagcaaaacttaggcaaaggtgccacaagacacagaggtttctggccagaaaagggataccccaaagatcccataacaaaaggatttagaatattccataaacttagttgataaaacaacataggttttaagaggactgactccacttttttttttttttttgaaatggagtctcgctctgtcgcccaggctggagtgcagtggtgcgatctcagctcactgcaagctctgccttctgggttcacgcaattctcttgcctcagcctcccgagtagctgggactacaggtgcctgccaccatgcccagctaatttttttatatttttagtagagaaggggtttcaccatgttagccatcatggtctccatctcctgacctcgtgatccgcctgcctcggcctcccaaagtgctgggattacaggcatgagccaccgcgcccggcctgactccacttttgaaagttctactgggctggtctaggagatcgagaccatcttggctgacatgttctccccatctctactaaaatacaaaaaattagcctggtgtggtggtgcacacctgtagtcccagctactcaggaggctgagccaggggaatcacttgaactcgggagacggaggttgcagtgagccgagatcatgccactgtactccagcctggctgacagagtgagactctgtctcaaaaaaaaaaaaaagtaagttctactgtgggtaaaatgctatcaaacattgcatgctacagagaaatctttttttttttttttatttgagataggctcccactctgtcacccgggctggagtgcagtggtgcaatcacagctcactgcagctttgacctcttgagctgaagggatcctcccacccttagcctctcaagtaactgggaccacaggcaagtgccaccatgagtagctaattttttaatttttatttttagagacagcatctccttatattgcccaggctggtctggaactcctgggcacaagcgattctcccacctcggggtcccaaagtgctgggattacagacatgagccaccgtgcctggcccagagaaatattttgtggaaagaagggtcaattgatgtggtcaatgtcattgttgtcttattttaaggaactgccacagccatcccagccttcagcagtcgccatcctaatcagtctgcaggccgggcggtaatcccagcactttgggaggctgaggtgggcggatcacctgaggtcaggagttcaagaccagcatggccaacatagtgagaccctgtctctactaaaaatacaaaaaattagctgggcgtggtgacgcgtgcctgtaatcctagctacttgggaggctgaggtaggagaaccacttgaacccgggaggcagaggttgcagtgagccaagatcgtgccactgcattccagcctgggctatagaatgagactgtctcaaaaaaaaaaaataaaccccaaaacaatatgaatcagtctgcagccatcaacatcgaggcaagactctgccagcaaaaagaataccactcactgaaggctcagatgattgttagcattttttagcaataaattttttttttttttttgagatggggtcttgctctgttgcccaggctggagtgcagtggtgcgatctcggctcactgcaagctccgcctcccgggtttacgccattcttctgcctcagcctcccgagtagctgggactacaggcgcccactaccatgccgggctaattttttgttttttagtagagatggggtttcaccgtgttagccaggatggtctcgatctcctgaccttgtgatccacccaccttggcctcccaaagtgctgggattacaggtgtgagccaccatgcccgattgcaataaagtgtttttaaatgaaggtatatacttttttttaaggcataatgctattatacacttaatagactacagtgtaacttttacgtgcactgggaaaccaaaaaaatcatgtgacttattataaagtgcaatgtgtgctttgttgcggtgatctggaaccaaacccgtaatatctctgaggtatgcctgtgtgagcctgtgaagccttcaccacaatcaagaccgagactgtgaacagacctgtcaccctgctgaggccctctgcttctctggtccctccctgcccccaggcaacctctgatctgctttctgtcactatagtttgtgtttcctccaagtttataaacatggacttgcacagttctctttttgtccagcctcccttgctcagcacgattacttggagattcatccacatggttgcatgtatcagttattcattcctttcctttttttttttgagacggagtctcactcttgttgctcaggctggagtgcagtggggcgatctcagctcactgcaacctctgcctcccgggtttaagcgattctgcttcctcagcctcctgagtacctgggattacaggctcccaccaccatgcctggctaatttttttttttttttttttttttttttgagatggagtctcgctctgtccccaggccggagtgcagtggcgtgatcttggctcactgcaacctccgcctcccgggttcaagtgattctcctgcctcagcctcccgagtagctgggactacaggtgagcgcaaccacgcccaactaatttttgtatttttagtagggatgaggtttcaccatgttggccaggatagtctcgatttcttgacctcgtgatctgcccacctcggcctcccaaagtgctgggattacaggcgtgagccactgcgccaggccaaatgctgggcttttttttttttttgagacagagtctcttgctctgtcaccctggctggagtgcaatggcatgatcttggctcactgcaacttctgcctcccggcttcaagggattctcctgcctcagcctcccgagtagctgggattacatgcatgcaccatcacgcccagctaattttgtatttttagtagagatggggtttttccatgttggtcaggctggtcttgaacgcccgacctcaggtgatccacctgccttggcctcccaaagtgctgggattacaggtgtgagccaccacacctcgccgataattgcttttagatgttacttttgtattttcctaatgtctaatgatgttgaatatcttttctttttttctagaggtggagtctcgtcttgttgcccaggccggcctggaattcctgggctcaagtgatcctcctgcctcagcctcccaaagtggtgggattacaggtgtgagtcactgcatctagccttttttgagacaaggtctcgctctgtcatccaggctggaattcaatcttggcccactgcagccttgacctcccagctcaagtgatcctaccacctcagccccctgagtagctgggaccacaggtgcagctgggaccccctgagtagctgggaccacagaaaacccacagggtcggtggcttttctccccatgtggggagatgagagattgtagaaataaagacacaagacaaagagataaaagacagctgggcccgggggacaactaccaccaagatgcagagaccggtagtgtccccgaatgcctggctgtgctgttatttattggatacaaggcaaaaggggaggggtaaagagtgtgaatcatctccaatgataggtaaggtcacgtgggtcacatgtgcactggacagggggcccttccctgcctggcagccaaggcagagagagagggagagagagagagacagcttacgccattatttctgcatatcagggacttttagtactttcactaatttgctactgttatctaaaaggcagagccaggtgtgcaggatggaacatgaaagtggactaggagcgtgaccactgaagcacagcatcacagggagacaggcctccggataactgcgggcaggcctgactgatgtcaggccctccacaagaggtggaggagtagtcttctctaaactccccgggggaaagggagactccctttcctggtctgctaagtggcgggtgtttttctttggcactgacgctactgctggaaccacggtctgcctggcaacgggcgtcttcccagacgctggcgttaccgctagaccaaggagccctctggtggccctgtccgggcataacagaaggctcgcacttgtcttctggtcacttctcaccatgtcccctcagctcccatctctgtatagcctggtttttcctaggttatgattatagagcgaggattattataatattggaataaagagtaattgctacaaattaatgattaatgatattcatatataatcacgtctatgatctagatctagtataattcttactgttttatatattttattatactggaaaagctcatgcccttggtctcttgcctcggcacctggatggcttgccacccgcagtgctcaccaccatgctcggctaatttttttggatttttggtagagatggggtctcaccatgttgcctagaagagtctccagctcctgagctctagccatctgcccacctcagcctcccaaagtgctgggattacaggcgtgcacgaccgcgcctagccaaaggtcatttgtttttttcacattgagctctgagagatctttctggagcctggatgtaagtttctgaccctaccagcttcctctagcatgaggcagtgagtttcggttggggagagggatgtggcctcccattctagggcatgtcgttgcggagttctccttgaattctctcttccgagtgccctctgatgagctgggctcagtgtgcttttgagttctaggtgcctgtctcatttcctaccttctttctatatgcttggctgcctgggtaggtatgggagggatgggggaagaggtgctgccatctcttgacttttttttttcttttttttttttgagacggagtttcactctgtcacacaggctggagtgcaatggcacaatcttggcccactgcaacctctgcctcctgggttcaagcgattctcttgccttagcctcccaagtagctggcattacaggcgcccaccaccatgcccggctaatttttgtagttttagtagagacagagttttgccatgttggccaggctggtctcagactcctgacctcaggtgatccgcccgccttggcctcccaaagtgctgggattacaggcgtgagccaccatgcccagcccacctcttgactttttagcttccagatgcctttgaaagctgcagaaaactgggtcttttccccagaaaagtagaaaccagacacaacctcgagcatgtttttagggatgctcacagcctactgagccagttctactttgttttgggttagagatggatgccacatctgcagatctctgccaagctgtgtgtgtttttctttagattttgggagtgcctttctgtggcaaaggtaagagcgtttcgagggctcctgccatgtgtcacccacatggccagtgcttatgtagggaggggccacagcttctggcatccagttgttagtagtttatttatttatttatttttacagagtcccgctctgttgcccaggctggaatgcagtaacgcagtgacgtgatcttggctcactgcaacctccgcctcctgggttcaggtgattctcctgcctcaccttccctggtagctgggattgcaggagcacaccaccatgcctggttaactttcttttcactagtggtggggttccaccgtgttggccaggctggtgtcaaaactcctcacctcagatgatccgcctgcctcggcctcccaaggggctgggattacaggcgtgaactactccaccctgccttgtttgtagtttataacagctttcctgagctataactctattgagtctaccctttttgattgtacaattctgcgtgaaccttaatggattcacaaggctgtgcagccaccagcacgatttaattccagaacattttcatcacccccggaattaacctgcacgcattagcagtcactcccatttcccctcctccagcccctgccccccaccagctgactttctgtttctgtagatctgcctgttgtggacatttaatatacatggaatcagatggcgtgtgaccttttgtgattgacttctttcacccagggtggtttcaaggctggtccgtgcattactgtggatctgtaggtcttcattttttatggtcagataatatctcattgtatggatttatcgtattttgtttacctacccatccgtggtggacaccgggttgtttccatccttgggtggttgtgaataatgctgctatgaacatttctagacatctcgttttgtcaattaaaatgatttttaatttactagatgggaaatagcaccttgtagttgtttaactttgagattatttactcataaggctaagctatctgagaagtgcttcctctttgcgggaccatctggttgtggcttgaatctgtgttgctgtggaagcctggtaggtcctcactgatttggggtgggtggtgggcctagcacacctggactgggaccagctggaagggttgcttagggaggcagcaatgcccgcctggagggatgaggccaagtccaaagggcacagtattggggcccaggctcattccttgagttccatttggctgcagcttctggagggagccgacaggagacgtggggagacgatgctcctgcttcggagaagcttgtcactaaacgtcctcagaaaggaagtcgacagggcctgttttggggagaaggccaaacagtgagttgggagctgagaggaactatgggctatttggggtcaggggagggaagtgtgtttgggaggacctgtcctgtgtgccagggtgggagacgctgtggcttcaagaccctggccctgggatgccggctactcaggaagatgggccgagatgggcagccagggggctgaggaggctgatggcccgggcctgggccccggcaggctgcctgggtggggagggctcagggggcattttcagccagggttagctgccaggcttgggccagactcagccctctgacctcccctccgggcagacattttgggtcggtgggatccctttagaatcctctcctctgctggcttctagacattaagcatccctgggcgggggcagcaccagcctccctgtgggacccagtgcgtgtggggtttgtaagctgaaaatgactttttctttctttttgcacataggtgagaggacttgtccttttaggacttgttatttttgcacataggtgaaaggacatccttttagtaataatttacctatttaacttttaccagagtgacttcccaggctcagtgcctgccagctggttagatagaataagcccaggctctggcagtttgataagggccttgataagggccggctgttccagtgggagtggcctaatcagccctctctgccctaactttctctttcacaactaaacatgtgaaacttgcccagaggccggcgggtgcagcctggttgaggctgtgcggcctgcactctggctggggactttccatttcccttgctggtcacaggattcctgggaaagcagccctggtgggggcagcattgggggaggttgtggtgataacacatcccgcctcctgcactgggcctcctgtagcctgcaccctggccgctgtgattgtttggcctctttctttcttcctgacacccagtagaaggggaggcggagtgaagagagtacgggttggggggcacagggcccacaggtggcagccggcagcctaagagcccgcgggagtggaggaagggtagtggagttgctgagccccaagacaggcatggcatcctctgaagcaggggttgggggaaggaagagggggagtggggaaggacaggggtgtggcctgaggagaggggaggctggaccgcctgtccactttgcttcagccagggagctggcccttgggacaggctttagatgccagctccatcagcaggatgcaggcttggacctgctggagtccttgctggcctgtgaccttcctcccctgtctacatttcagggagctctagaaggcggcagtggggccagacctggctttggctgagaccctggagaaagactagggggtcttgtgccctgtcagagaaggcagagcctcatagccgcttccctgaggccgctcagcagcggcccctctgccttcctgatctcctggcatggcagccagaagagctcacagaattacttcttctgtaattatttataaagcaaggtttccatgacgaccggtttctggtagacgctctggattggcgaggcagcctcttcctggccagattgggcagctcaggaagctgggggtggggggtgctccccaccaagcccggtgtggcagggagctgggacagtcctgggtcaggcaaggactctgtgatgcttccctgctccctcgcctttctctgcatctgatcctgggatgtcctagccaccatggctttccagctgagcaggtactgccagtcatgggcatgtctaggccgtgcaggggccactgtgggtggattgtttagggacatttggaagggaagggtgggtagaggggactcggcccctgtgcccagcaggctggctggtgtcatgcagccaggaagggcagtagggcacccacctggcctggctcttactgacccccaagattaggtggtcagccgaagctgggataggaagtgcaggcctgcgtgagctggggtcccctgacggaccagggcactcccctgcctgctctagtccccagggaggaaggcacctggttttctttccagccttgctcctgtggcttccctctgctcccttcagctgggctgggttcactgcggtttcccagcgctgctgagcttcctacctgcggtggagggggggtctgtgggctgcacaaggagcctcctgggtcagtcccctgcccctggccaaaatggaggctgggagctcagggccattgttggcctcttcccccgtcctgcttgggggcctgcaagtgctgctggaactttccttggcacagcccttcctcccacccttccctcttctggagatgcagtggcgtgtctgtgggttgaagggacttcgccggaactgccttaggcagcaagtcaaagaggagaagcaggggccagactctgtgactcacgcctgtaatctcagcactttgggaggccgaggcaggtggatcaactgaggtcaggagtttgagaccagcctggccaacatggtgaaacccccgtctctactaaaaaatacaaaaattagccaggcatggtggcacgcacctgtaatcccagctacttgggaggctgaggtaggagaatcacttgaacccgggaggtggaggttgcagagagccaagatcacgccactgcattccagcctgggtgacagagcgagactccctctcaaaaaaaaaaaaaagaggagaagcagggctgcttgagcttctgtttggcagagtcccccatggaaagaggaggcatttatgtgtgcttgtgcctggactttgaggccccacacccatccacgtgcctgttttgtccctcaaggctgcctggtgtgaggcccccgccccccatgccataaggagacccgcttctcctttccttccgggaagggcaacccctgtcccttgtctactcctggccaaggcagcctctgctgagctcctgaaggaagctccgagtgtctgcaggccccaggtggtggcccccagccatgagtggcatctgcagccctatgactggggacagtctgcccagacacctctgtcccacccagctttccagctgaggtgagggtggagcacacgcacctggtgcttgacctctggtttgaggcctttgtcagaagggggcagtaatgagccgcctgccctgcaggccccgtgtgggcctgacctgcctataccccagacccttacctggctgtgcaccttcaggtgggcactttagcttccaccatggagtaaaggaagcaaggctcacctacccctggttaccctgggtttcacgtagtaatgttttcattttagcactgactttttttttttttgaggcggagtttcgctcttgttgcccaggctggagtgcaatggcgcgatcttggctcaccacaaacttcgcttcttgggtttaagcgattctcctgcctcagcctcccaggtagctgggattacaggcatgtgccaccatggttggctaattttgtatttttagtagagacagggtttctccatgttggtcaggttggtctcaaactcctgacctcaggtgatccacctgcctcagctcctaaagtgctgggattacaggcgtgagccactgcgtccagccacaaaagtgtagtcgtcgtcgtccttttttttttttttgagacacagtctcaccctgtggcccaggctggagtgcaatggcatgatcttggctcactgcaacctccgcctcctgggttcaaacaattctcctgcctcagcctcccaagtagctgggattataggagcctgccaccacgcccagctattttttttctatttttaatagagacggggtttcaccatgttggccagcctggtctcaaactcctgacctcatgatccgcccgcctcggcctcccaaagtgctgggattacaggtgtgagccactgcgcttggccagcactgacatttttgtgtcagagtcagagacactggtgacactcccagctggtcgtgtgctgggctgtggaaggggcaggcagggttcagtgccctgcagggctgctgccaaggtcaccgcacaggggcctgtccagggctggccaggtgtgggtggcaggtgctgagctgggctgagggtgctgagcggggctgagggtgctgagctgggctgagggtgctgggcagggctgagggtgctgagggtgctgccgctgctgcctcggggctcccctgtgccactcagtgctgctttctttgggagcatcagagacctccgggcatggccacaaaccaggtggcaggtgacaaccggaagcagtttcctcaggctggagaccagcggtgggcagggccatgctcccgaaggtttgacgggaggctgctcccgtctctgccttcatcttcacctggacctcctgtgtctcatgtcgagacttccctgttcctataaggacaccagtcattgggttagggcccttcctaaggcacggcgacctcatcttgattgtatctggatgcaaagaactcttttcaagtaaggtgacattcatagtttctgggggttcgttctcaaacacatcttttgggggacacaattcaacccagtactcaggctccatgtggcttaggtgggactccaccttgagaggaccccagggcacaggaggcatggccagccctcaaggtgaggccagggggcaggagcggctcccctccctgccaggctcccctcaattgttccaggcgcctcactcccgctgcggaacaggctcgggctgtcctgcgaggatgtgggctggaccccagggccgctgctgtaggcgctcttgggatgagtgctggccggcctctggtgtgatgagatctgagttttgagctgtgccttgaagcgttttcaaagaacacttattaatttgaaagggttgagatggtttaaaggcatccaaaagacacaggcatctcaccgaggtccctgcccagtagctagtttcttcctctgggggccatggaggcctctggtttgtcacacctccttcctggaatggtcgtccctgcgccccaggtggtcaccttgctcccatggctctgtgccttgctgtttttcacctgacagctggtctctgagaaggttcctcctcctcgtgcaaggctgagcaatattccaatgtgtggctgttgcttttatgtccttatgtggacatctcggcgctggcccatgtcctgcgttatacacggctgtgcagtgagtacccttgcagtgcttcgtttaaccgtgtgtggaaacagctgtggggtaaatttctgcgagtggaatcctgggtcagggtgtccctgtgcatctggggtttgggtgggtggtgccgggtgccctctgtgagtgggtattcgcttacactcccctatttgtgaatggttccctgtccttcacaaagggtgggtcaggcgttgctgggacaggtagaacggtgggaagggccaggcgtgcctgctaagcagcagtgctctggcaggtgcaggtcggagccccgcagggcagtgagagttgaggcggaaaagttcccaatccctgagagctccagatgccttactaggagattgagtctttattctgtagatgggaaaggccctggaaggtatggataagggagtgacttggtcctggggctgtgcagtcggggccagttaggatctcagccaaggcaagaggcaagtgcagaggccatggggggtgaggggcagtgcagaggccatggggggaacaagaggccagtgtagaggccatgggagggctagaggccagtgtagaggccatgggggggctagaggccagtgtagaggccatgggggggctagaggccagtgtagaggccatgggggggctagaggccagtgtagaggccatgggggggctagaggccagtgcagcggccacggggggtgagaggccagtgcagaggccatggggagtgagaggccagtgcagaggccatgggaggtgacctccccaaacagtgtctgattgtgtggttcctggacttcagcctccccagcctcccctcctttcaggatggatccagactttgtctcagccctgaggccctgcatgacagctgcgtccctgtctcaggacatcgcttcttcacccccttttgggccatgcgccagctttgtggggttgctttctgtttctggagctcgctgggcactcctggccttgggccccgaacattccctctcctcgtagccttctcggacctctgctcctggctcacccttcaggacttggccaaggtgtcacttcctctgggaagctttcccagagattaggtggggtggcgcccttctgggagtggctccttgacccatgtgtgctcagcttcctcagagcccttgtcatcagctggatgccacctccagaggggacaccggccgggagtggggtggctgagagtgggttggcagcatctgcgtccattagccttgggccccagcacctgccactcatgctacaaggactggacagacatggttctgatctgggacaggagcagctggaacagaaaaagggtggggctgtgggcccgggtgacattccagacctgcagtcagcccgggtcactggctgccaggacccggcaggcagaagatagagcgggggatgtttggggccaggcccagagaaagaaggcagccacgtaggaaaggccccaccctgggcagcttgctttctttccttgaagtttctggggtcagaggagggggaagaagtgcaggattagcgtgttgggggctgggggaggaataacatgtcagactcagcagtaaacagtcctccagaactgggccaggcctgtgccgttgcccgagctggcctgtgtctttctttatttttagataatttttaaccccaggaatcctagagatagacaaatgtatttctttcttttcttttttcttttgagacgaagtctcactctgtcacccaggctggagtgcagtggcatgatctcagcccactgcaacctctgcctttcaggttcgagcaattctcctgcctcagcctcctgactagctaggattgcaggtgtgtaccaccacgccccgctaatttttgtatttttagtagagatggggttttgccattttggccaggcaagtcctgaattcctgacctcaagtgatccgcccccgcctcggcctctgtaagtgctgggattacaggtgtgagccaccgcgcccagcagccaaatatatttcaattttttttttcttttgagacagcatctcactctgttgcccaggcttgagtgcagtggtgcaattgtggctcactgcaacgtactcttcccaggctcaagtgatcctcctacctcagcctccctagtagccactgcgcccagcctgtatttcagttttttaatagtaaagaggggccgggtgcggtggctcacacctgtaatcccagcactttaggatcacctgaggtcaggaatttgagacagcctgggcaacatggcaaaaccctgtctctagtaaaaatacaaaatttagccaggcgtggtggtgcatgcttgtaatcccacttactcggaaggctgaggcaggggaatcgcttgaacccaggagacggagtttgcagtgagccaagatcatgccactgtactccagcctgggtgacagaatgagacgctgtctcaaaaaacaaacaaaatagtaaagaggaacatgaagtgctttcggtacccgtgtctttattagaaatgggatcacgaacgaggtcaggagatcaagaccatcctggctaatacggtgaaaccccttctctactaaaaaatgcaaaaaattagccgggcgtggtggcgggcgcctgtagtgccagctactcgggaggctgaggcaggagaacccaggaggcggagcttgcggtgagccaagatcgtgccactgcactccagcctgggagacagagcgagacgccgtctcaaaaaaaaaaaaaaagaaatgggaaaacgaagtctccagtgagacgcagcagcttccctggctccctggctctcacccctgcctgcctttagacagaggcagtcatgaccctgtcctgggatggacacggttggccttggccaggccatggggcggggcctgagagagtgacagagctgtttatgggtcctggaggctggctggatccagcggttcctgagctgtttggaaggaatgagggaggtggggaggggaagagggaggggccaggtgtggagcagctggtggtggtatgcaggatgggaaggaatcccagctgaggctgggactcactggctgccctggcttggagggaaggtgtctgatttggggaaagggagaaggggtaagtgagttgggctttgagccttgtgcattggaggtgacagcacagtccccaggcaggagtcaggtcctgtaggggagagggttgtgtctgaccttgagggcaggggctggcttcctgggtggtcagttggggagttaggatggtccttggtgcaggacccaaggtgccgaagaaaggcggccaggcccgtggtagccagctggcgtgcggtctgcagttcctggcatgtactcctgatggcacagcgccaagtgccgagtcctcactttgttgccaggtggctccaggctcttcctcggggcctcaggcactgtccctggtcttctgtcttaaaggctacccacatatctgtcctgtcttcagtgcccaccgcatgaaagcacttcctccgctgctctgcagcccttggcccgcgtcttctctccctggccttgtgtcattcctgggggccagcctgctgtgtgtggctccacttcacagacaggcaaagtgaggcctgcagcagtcattcaggctgctctggaggctggctctgctgctcctgggaaatgctgggctgatgtttcctcactgctctagaaccaggagctgggccctgctctccgcacccacccacagccttggctagtgcccccaggacaggcctgtgtggaaagtgaccctctgcccgctgcagctggtgcggggaaggcccttcctactaagtggaaaacaaagggaagaggctgatagaatcattttgtgacttataattggctacctcataactcagacaaaaaaagcccaaaaacctttcatagagtaagttcaatttttaaaaacaaaggtattttaaaatgaacacttgagaagccaaatgaggtttcttgtgtgctctggggatcccccggccactgtgtcacgccgtgccggccgctccacaggcaactgtccctgagcctcccacggaaccttgggccctgcctgacctcagagccagaagccagttggcctaagtgggccctggtttgcataatagactctcacccagggtggaggggtgacactggggatgggcagctatgggttgctgggggacatctgtggtcatttgctctagaagtggcatcctgtggccagatggtgggtttcttggagcttccaaccaagttggctaaatacttaccaaaaagggaaaaattctcctagttaacgtgtggactatctactgtgtaccatgtgtctgccagcgctgttgtggagtgagtgtgcgatctgcgtgatctcccagttaggcgaggcagtgttgtcattctacccattgtacagatgagcacatggaggattgagggttctgacagcttgcccaggttacctagcaagtaagagccagagccaggaacgctcttggagagtgacttgctcagccttggagctgctagagaagcagagaggagatgcagacctggggagacgctgctcctggggcccccacactgtccagcaaggctgggcaggctacacaagctgcaggtggatgctggaccctggacctgtgcccgctgcctgtcactcgtctccaggcctcggcctgtgaaggcggctttcatcagctgggtgctgtctgggaaggtgccaggcaacttgccctggcaggactgccaagctggcttgttgggattccagagatttcgtggagctcccacactaccggctgctcacggcaaggatgaagttgttcctctttggggaagtgaggtggcgtttccattccttctgacctgggaggctccttgccttcaatccagggcctgattccacactgcccccgggacccacagaggagcttagcgcgcagtgggcaggcgctcacctgctgacagggcctggggtcttgaagctgcgactcatgtttagttctcagaacagccgtggctacctggcttctctgggactcctgacgggggtggtggtggtcccgggaatttgctcctagggtcacagtctgtgtgttggtcactgggaaccccaagggctgatcaccacctccctgccctgtggctttgcttaaaggtcttcaccatcagcccttccctgccagggcagtccagggacatgtggcttcagggggagaaagtgcccctctgccctccttctctctcatggaaacagcatctcagggccccttccgtggcctagcaggtggcaccccaccctgacgaacacaccacctaggaagagcccaaacattgggaaggttctctttcctccgggagccattgagccctttggggaccttctcccctccttggattgtcactgttgcacaaatggcatcctctccagaggcctcatcctgcttctcctctgccctaggatcatgcggccagatgatgccaacgtggccggcaatgtccacggggggaccatcctgaagatgatcgaggaggcaggcgccatcatcagcacccggcattgcaacagccagaacggggtaagggtctgggccccatacctctgggccctggaggccgcaccagtgtgagttcaggacaggagttccccggggagccaggcctgcagccttccctccccttgtgcactgggccttgggaactgtgggagaagtggcccaagtatttctgcaccggaccctcagagctatgcttggttttggcctcagccaggaggtgtaggaacccaccagagatgaagcgtcaagcaagctgacaggccctccctccaccactccccgccatgccgagtcccccgccaacctggccctgatcagaagcatgccccgcctccgtggggtggagtttattgtgatggccaacagctgagacataagaggccagacagcagatgtaggagaggtcccacctctgccctgaccaaccctggtggccatggcaccatagcaagtgccgtggctctctgtgacttggccacttcctggctttgaagctcacaggcctggtaccactgtgcccacaatgggagcagctctccacctgccccaaaattgtgtagctcgggagggccctgtgaccctaaagctggggacaaggggcacggtgtctagtgtcaacctcagggctgctgtaggacattcagccatccccagccctggggaggggacattttctctgaagggcggctgttggggggaagccagcccttgggtgctgaggacagggcgtctgccttggtgccgcagctgcagcctctgcactatggggctcggtcagcacaccttctgtggcctccagggaggcagagaagaggaagactcagccccagcttggagagtgggagtgtgaggtgcaggtccccaccatgggcacgggcataatgccactctatcaagaggccaagtggaagccacgtcagagaccagggaccagcggaggcactgtgagctctgagccacactgttgagatgcaggaagtggctgctggctctgtcagcctgggctgccggaactaagaccacagcctgctggcttgtgaacaatggaaatgcatttctcacagtcctggaggctggaagtccaggatcagggcgccggcagatttcgtgtctgttgagggcccatttgtttcctggttcatagatgtcacatcacttcctgtgtgtcctcgcttggtaggagtggctctctcaggcccttttataaggacactaatcccatttgtgagggctctgtccccattctctcatcacctcccaaagaccctgccttctactaccattcccttgggggttaggatttcaacacagggattttgggaggtggggacagccatgcagagcatggcacatgcattcagcctggaacagtgggtagggtgtgtttcagtggaggagtggaagctgtgtgtgtgtgcgtgtgtgtgtgtgtgtatctgcgtatgcatgtgtgtgtgcatatgtagaatgaaccaagccacagtaagtgcggatggttggacgtggatgtgggggatgtcgtgtggtacaggttcaggagtgggtttgctggcagtgcctggtttaggaggggctcgctggctgggctgggggtagattgattctttggacccgaggctccggtgcagctcagtcacgttcagagagcaccctctggtggctgtggggagggtgggcctgagcctgagagcctggggcaggggtgagggccaagtcccaagttcctgttgcacccttccagagagagacagtgagggtccctggcaggagagcatggacacagggaaggaaaagtccccaagatggggaggaaagatgaaggaggggcttgggaggccagagggtgatgctgtcactcagaatcgtggaattattttgctgccatttggtcagcacttgacattctgcaaagctccagaatgcttcaggagctaaagtttagctcatggaatcctcacaacaccccggagaggcagctgttcttgtcttgtttttttttttctgagacagagtctcactctgtcacccaggctagagtacaatggtgcgatcccggctcactgcaatgtctgcctcccaggttcaagcgattctcctgcctcagcttcccgagcagctgggattacaggtgtgtacaaccacacctggctaatttttttgtatttttagtagagatggggtttcaccgtgttggccaggctgatctcgaactcctgacttcaagtgatctgcccacgtcggcctcacaaagtgctgggattacaggcgtgagccactgcgcccagctgctgttgttatttttattatcccagttgcatagataaggaaactgaggtacagagagattgaacacttgcttgaggccacctggggaggcagatggtaggtctgggctgtgactatacctcgaacctgtgctttgaacacttgcccctccttgctccttctccggatctggggctgctggagggacagttttgacacattggcttggagaagcctctgggaggctggtccccaggatggtgatccagaaattctaggcttaggagggggtctctgagttccaggcagccccagggcgtgggggtgagaacagtcccagtgcctagaagggctttgctggggccctaggtggggcaggggacccccgcatccacactcccctggtggtgccttccagtctgtggctggaagtcccaaggttctgtctctggctggggcctcttggccagcccatctggatgcctacttggcctgcttggccttgatgtgcaaaaaaacgacactcctgtccttgccccaggcttgcttctcccagcctccctcccctcagtaaatggtctctgcagcaccccggtgctcaggctcaaagcctggagcctctgtcagcctctctccctcccaaactcatgaggctctgggagcagatcccactgctctaccttccaggaagtccagatctgagcacaacccccaggcccacccccactttgggtccaatggtgctgctcttccgatcacccgatcacctgatcactgcagcagcctcctggcaggtcaccctgctggtccctgctgcctggtttgttctccagcagtagccagggagatgtggagtcagggcacagtgctgcctgctcagagccctccagatctcctgtttcgcccaaagccaaaggcacgtccgcacgagtccctgtctctgcctagcgcggctcggggacctcacctcctacatctctttctcaactctccctctggccacattggcttttctgcttcttctcggacttgctgggtgcattcctgccttgggcctttgcactggctttccccagatatccacagggccctgccctctcctcttctaggctctacataaaaatgttggaatcccagcactttgggaagctaagatggacaggtcacttgagctcaggagtttgaggccagcctgggcaacatgatgaaactttgtctctacaaaaactacaaaaattagccaggtgtggtggcctgtgcctgtagtctcagcttcttgggaggctgaggcagcaggatcacctgagcccaggaaggttgaggctgcagtgagttgagatcacatcactgctctccagcctggatgacagagtgagaccctgtttctacaaaaacaaaacacagcgtccggccatgcccctgatggcctggctccctctctgcttccagctgctgctccactcctgacctgctgtgcttgtacagagtggtagccccacgagggcaggcaggacttctgcccttggtttctccagactgagcatagagcgtgcttaggcatcatctgatgaatgctgggagctcgggcctggcaccgtcaaccgtcatggagagcgtccaccgagtaagcgcttacgatgagcccgcggccacgctggggctcacccttcctctccctgtgtagtcttcccagccacctgctgagacaggcactgttcttaaccctgttttacaagtggggaaactgaggcctagaacagttaggtggctttccagacagctgcatcctcagagctgccgtcagccagaagacggccggggctgggcatggtgatgagaccgcaccctctctgggccctcactggatgccgggcatggtccacgcacttgacgtttgtcaattgccttatccccgcatgtcagagagagacagctatccctgcctctcctgggcgtttcctaagcaccgagttcttcccattcgttatcccctcgaatctctgcagcagcctgttgggaccatttattatctgtgtttacagagactgagacgtggagaggttgtgtcgctgcacaaggtcacagagctagtaagcagtagagctaggatttgaacccagggcccagagctgttcttttaggctctgcctctgcagctgctgtcctggctggaagccctgtggccatgaggaacccagtgcctgtggtttgctgggatgcctgtgcctcacgggccgtgtgataccagttgcttttgagagcgtggcagagggcacttccgggcaggtgctgatcaggagctcgtgtctctgtcccagggcagggtggggcttttcctgctcctgcagtcctggaagcaggaggtgtggggctcatccgaggcactggctgctgggagatcttcccatggaacgcaaatacttgtcagtccatgtattgaagttttggatcacactggccttcagggactccctgggcctggtccagagccctgcccgctcctgggaagcagccgcccaccagcaaatcagagccgtcctgggtcccggctcctgccatctgtacccatcagacacacagagccacctctgcagcctcccaggctgccagatagtaaaacaaaatcctcccacagggtctcctgatagtgaaatgggaccgtggcaagactcctgtgtggatgcctgggagacattacttttcttcttcttttctttttttttttttttttttttttttttgagacagagtcttgctctgtcgcccaggctggggtgcaatggtgcggtctcagctcactgcaacctctgcctcctgggttcaagtgattctcctgcctcagcctcccgagtagctgtgactacaggcatgtgccaccacacccggctagtttttgtatttttagtagagacagggtttcactctgttggccacgctggcctcgaactcctgaccttgtgatccacctgcctcggcctcctaaagtgctgggattacaggcgtgagccactgcgcccggccctacttttttctttagtatgttaagctgggagagaaccaagctcaagggtcatcagtggccttctgccctatgaaggacaggcttgaagccatcaccaggtgtccccgtggcactgtggggaaggctactggatggttctgtgtgaggggtgtcccgagggacagcacagagaggtgcgctctgccttcctcctgcctcaagtcactctttgagtgaacctgcttttgtgcctcctctgagcgacccttggacctgcccctcacatcctggcctgcaaggcctggcagcctgcctctttggacctttgtccatgtctcccactgcgtccctgtgttctggtggctccccaccacctccccactcctgctgctctttcctctccctgtggtaccaacgctccccctacctcctcctgcctaacacctggtcttttaggcctcagctcagatgcctctcatctgaagtcacaccctgccttaacatcgttgggctgtccccatcgtggcgtggccccatttacttctcgtccgtccccccagctagaacccaggcttctctgacccacacccctctgtacacccagcactgagaggccccacagatgctgccagaaaccagctgcagagcagggaggtggaaggcctctgccccggaaaagcatgcgcccataggtctgtttgatctgtgtcagcatagcataccgtaatgtacttaatcaccctcaaacaacacacacttggcttcattccacttttaggtcttgcagacagtgcttggctccttccaagatgggcattgccctgcccagaggcggtgcctaattcttgcctggctctgtgcagccctgccctaacagcctttggccaatgggtggcgccatagccacatacattgacttgggggtgaaagagacagttccaggcatcgctttactgtgacctgttgtgagtagggcagggtttgctgggggacaagcccgtgcaaaccagaatggggaagcatcgggccacccttgccagctctagaacttttcttgcccagccccagatgcagtcacagagtccctgcgcctgtgtgcaggagagtcacctgggaaagggctcagacagaggctcccagcctacctccaaagaagcaggtgctgggtttggggtgggccccggagcttgcatgttaaccccacctcagtgagtcctcatgtaggtgggtgagctgcatgtcggtgctttgggggcggcaggcggtaggtgggagagcacagacgcacacaccagggcttgaagtgactgccacatactctgtgtgctctgggacgcttgcctaatgtggcaccccttgtcggggtgctgtgaagatcacctgggccagtgatgtcggagctggcccaggcccctccctcacctgctccctgcccgccctgggaagcctgagggctcctcagtgtcatgctgtcaatgtcctaaggaagtgattgttgcagtagaaagtcatggcagtcctctgggaaatggagactcacattccccatggctcaaacacaaggtcatcttttgtgtcatttattcagcaaagatgagaaataagtcaattctgagtgttggtcaggatgccgtgaggtggcaaaggccaggccagtcactgctgttccgagaaacacttaggaccatatataaaagtatttgtccttgggcccagaaaataatcccaaatgcagaaaacggtttaagtgaaagggtgcccatcacagcattgtttgtaatgagaatcaactgggggtgccccacatctctaacagaagaagaatgttcaattccacctggctagcaattgaaagtaattttctaaaaaaaagttaggtgtggttgcatgtgcctgtagtcgcagctactcaggaggctgaggctggaggatcgcttgagcccaggaggagtttgaggctgcagtgagcatgattgtgcctgtgaatagccattgcattcctgcctgggcaacacagcaaggtcctgtctctataaatgataataattttacattggagtgctatgaaaaggaagtcactggaaaggataaggaagtctttcagacacagccaccgtctgagtgttcgtgtctctcatgtgttgaaattctcacccccagggtgatggtattagggggtggggcctttgggaggtgacgagggtatgggggtggggcttcatgaatgagatcaatgtcttcatgaaagggtcccgagggagctcatttgccccggccaccacgtgaggacacacgagaagcactgtctgtgaaccaggaagccggcccttaccaggcatggaatctgcccgtccctgatcttggaatgacccaagtccctggagacttcccccctccaggactgtgagaaataaatttctgttgtgtctaagctgcccaggctatggcattttgttctggcagcccaacgaactaagacccaaagctacagaggatgatccccagggtagatgaagagagaaaagcagggtgcagcaccacctgtccatgtccaccatctgggagccccaccatgtggttgtagatgcggagtccgatctgacacatgggacccagctgccaaggggtcctgtgtgacaggagacgaggtggccagaggtagacccagcaccataggcttttttgttccttttacattttgaatcatgagaatgggtcgcctatttgaaggataaataacattgaaaaaaatttttttttttgagacggagtctcgctctgtcgcccaggctggagcgcagtggtgcgatcttggctcactgcaagctccgcctcccgggttcacgccattctcctgcctcagcctcccgagtaactgggactacaggcacccaccaccacacccggctaattttttgtatttttagtagagacggggtttcaccatgttagccaggatggtctcgatctcctgaccgtgtgatccacccgccttggcctcccgaagtgctgggattacaggcgtgagccaccacacctggccacttttaaatttttaaaaagaatagttgggccgggcacggtggctcacgcctgtaatcccagcactttgggaggatgaggcaggcggatcatctgaagtcaagagtttgaggccaacatggtaaaaccccgtctttactaaaaatacagaaattagccaggcgtggtggtgcacatctgtaatcccagctactcaggaggctgaggcaggagaattgcctgaatcctggaggcggaggttgcagtgaaccgagattgcaccactgcattccagtctgggcaacagagtgagactccatctcaaaaaaaaaagaatagtgattgcaaagagccatgtcacaacacgggcagattatttttcccatactgaatgaaaaagaatcaaggtgagagtgtatttagtgttttgttgttgttgttgtttttgagatggagtcttgctctgtcacccaggctggagtgcagtggcgcaatctcagctcactgcaacctccccgtcccgagttcacctgattctcatacctcagtctcctgagtagctgggattacagatgtgcaccgccacgcccgggtaacttttgtatttttagtagagatggagtttcaccatgttggccaggctggtctcgaactcctggcctcatgtgatccgcccacctcggcctcccaaagttctggaattatagtcatgagccaccgcgcccggcctaaagaagaatagtgattgcaaagaatgtgtcacaacacaggcagattatttttcctacgttgaatgaaaaagaatcagaaggtgagggtgtatacttagtttttgcacagctatattagactaaaactgtgaaacgagccaggcagacgaacaagtgagacaacaaaacccaccccgattcttgggaaaaaagcctggaaagacagatcccaaaatagtaaccatggttatctttgaatgggaggagtgacgttccccttctttctacttttctgtatttcccaaattttccataatgggtatgtatgcatttgttcactttatattaagcaaataatgcatgcctattgtgagaaaatcagaagaaaggaagaagcagctggtgatcccatcacttggggaatcgcctgcagcagttgctttgggctggactctgcagggctcctctacatccctgtgcttttgtgtttaggaatgcgcggtgctaggccgggcgcggtggctcatgcctgtaatcccagcactttgggaggccgaggcgggcggatcacgaggtcaggagattgagaccattctggctaacatggagaaaccccgtctctactaaaaatacaaaaaaattagccgggcatggtggcgggcgcctgtagtcccagctactcgggaggctgaggcaggagaatggcgtgaatctgggaggcggcgcttgcagtgaggggagatcgcaccactgcactccagcctgggtgacagagcgagactccatctcaaaaacaaaaaacaaaacaaaacaaaaaaacaaaaaattagctgggcgtggtggctgtagtcccagctactcggaaggcccgctgtagtcccagcgggcgcctgtagtcctagctactcgggaggctgaggcaggagaatgtcgtgaacccgggaggctgagcttgcagtgagctgagatcttgccactgcactccagcctgggtgacagagcgagactccatctcaaaaaaaaaaaaaaaaaaccgcggtgccaataaatggtgatacattggttgctttcacagtggggaatgaaagcaaaggcaaagaccgtttccagggggcatgtcctgggtggggctctcggggctgggctggctgacctgggctgacaactgcctctgtctccacaggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtacttctgggagcgacagtgttgactggagcagtaagggccgtggctacacagctgcttccctcctgagggcagaggacgctccagggcctggccccttttccaccaatgagacctctctcacctcccaccatggccctgggagcagctatgtccattgccctgattttgcagacaggaaaggggcacagaggggttaggaaacgagttcagttacccagagcaggactcaaccctgctgtctgggtccggcctgagcacatcatgctgcctgtcctgctgcccgtggccagctcatccatggcaggggctgggcgcgggctgtgaggccggtacgcaccatccacccctctgcaggtctccctgccctgcttgccctcctcaagcgtagggaggtgttggctccagagaggacagtgcttgctcctgggagccccagaaaccaggctcagatggaagctcactgggtgaacctttgcctctgctttcatctgaatattctcctccttggccatggtaaccatggaaacccccttccccttcccactgggcgctgcaggagggggcggctccagtgttcaccagctcacgcttctttttatacccaggctggggacgggaggtgagggggaaggcgggcctcttcccctgcccctggtcctctccctgccacctcccaggtcaccagtcctcccatgcagagaggctgggccggtttcctcctcttccccatgcctgttcctcagcagtggctgccccgtggagtgccagctcacagccatttgaggggcttgagtcctcttcctcatgacgggccggtagcaagcacgattatgcatctagaacattctgaggacctcagcagggttgattagaatggctgtgtcagcccagctccggcaggtgggcagatggagctgagcaagggcctggggtggaaggtggtctgcgttcccattgcctgctgctccctcagcaggcacctctgacatcagagggaccctggatgctggtctcaggatgtggcccaggaaggggtgtatgggcacctcccacaacaggagcagcgcccacgactcgggagaggctcagggctgggtgggttccccactttaggggccttgggggttccctgccatctcctgtgagatcgcagctcttctccgactgtgctgggggtggagccttggccccttcctggagaggagggatggcctgccgcgctctcctgcttcctaggaccttcctgcttgtgagggcccagtcagcagtgccctttgtcattgcaggagttggtggcttcaaaaatgccaggaagggatctgctttgcagattttctgccatgaaagccccctttgtggtccatcagaggccatagcctcagaggaagccctgaagagcaggtttctttttttttttttttttttttttgagatggtgtctcactctgttgcccagtctggagtgcagtggtgtgatcttggctcatcgcaacctctgcctcccaggttcgagctattctcctgcctcccaggttcaagctattctcctgcttcagcctcctgagtagctgggattacaggcatgagccaccatacctggctaatttttgtatttttagtaaagacagggtttcgccatgatggccagggtggtctgaaactcctgacctcaggtgatccagctgcctcggcctcccaaagtgctgggattacaggcatgagccaccgagcccagccgagcagtttgggatgatggggagagaggcagggagacagaaaggcgttctcaggctttcagcatggctgggacccgctgtccccacagcagagagtgatgcaggccaaaggtcaggggtactgagcttgaggaactccctagatcctgaacttccctttcctggccgcttctgctggcccataatagatatggaaccgatagtggatgagcaaatgaatgaatgaataagtgaatgagcagaggcgaccaggaagaactgggcatcagtgctgagacatgctggctgatggggttttgatgaggacgacacaatctgacatattcgtgaggatccctcgctctttaggggctgagagggggagaggctcctgtgcagagccaaggcaggcgtgagcatgagagagcagcccccaccagctcacccagaaggtgctgggagcttctcggcctcccagctgtgtcctggccaccacagccctcggccttctcctcctcctccgaaggatgggctcagagagggacagagatgcccacccctcctccctggggacatcagggctggcattgcgctgtcgtgcgcgtgaggcttggagaaggcaggatacgcttgccagcacatgaaggcttttcccagtggggctgggcggtgccccaggttcttcttcccagcttcagccttttccctgtagcaggggctgggcagggaggccttggagccccaaggctgtagcttttctccatatcttggtcaggccccggagcccgctgttgtctcactctgtgactgcgagtctcatctccccctctgtctcgctcatctcctcgtctgtgcttctgcttctctgccatctctctctgcagtctctattgttctcttgaggcccttctctgtctctgcccatgtgtcccctggaaattgaactcgaaggccccaacagcaagaacagtgcctggcacactgtgggcacacggggagcactggctgaatgggtggtgacctctgaaagataggggtattgcaggtgggggcagaggatgcgcgcggggaccctggcccggagcaggctgagtcataagctgtgtgcgtgacatctgtgtgctgtctccaccccaggagacaggggtcccctgttctgtgtgtcccctttacctgggctgtgctgcctgtcacgaggccgctgagcgagcacaggcccaggcagacgacccgcaaaccttgcctttgaggcagctcatttatctccagcaactgtcaaaatattaagctaactgggatgtgattgctgtgaattgctccagaaaaatagctgggagctcttaagattttaagagatttttttttttttttttttttttttgagaccgagtcttgctctgtcgtgcaggctagagtgcagtggcgcaatctcggctcactacaacctccgcctctcaggttcaagtgattctcctgcctcagcctcccgagtagctgggattacaggcacgtgtcaccatgcctggctaatttttttgtatttttagtagagacctgttagccagcatggtctcgattctgagctcgtgatccgcctgcctcggcctgccagagtgctgggattacaggcgtaagccaccgcagctggccgagagataattttctaatactgccgttgtcttttgatgctttcattaaatgatggagaaaatacaattagcatgtttgcctcatttgctccatggtgttcatttaggtccagagggccactcgagttgtcatggaaaccggcttgtcaggctggctctagctgaatccaacaggaaatctttattcccaaaagcaggttgtcagattcactctcagtcaaagtgcggtggaaatattttcccatattatttgcctgtggttcccaagcactgggagccccacgttcccaaggtgtgttctgtgcggggaggaggggcaggcacaggccttttcttaatgggccccctggggcttgatttggagcctggggctgtgtttattgaggaggaaaagcgctttgccttggggaggcaggttcaggtaactggtgggaagtgagctcctctgggggttttgggcagggccctggggctgctcctgtctccctttcctccattacttcctgcagtttgctcttctgctttatagtgaggatcttccacattgaagaagccacttttatttatttttttaagacagggcctcgctctgtcgcccaggctggagtgcagtggtgcaatctaggctcactgtaatctctgccttccgggctcaagcgatcctcctatctcagcctttgggaccacatgtgtgcaccgccatgcccagctaatttttttttttttttttttttttttgaggcagagttttgctctcgttgcccagcctagagtgcaatggcgccatctcggctcaccgcaacctctgcctcctgggttcaagctgttctcctgcctcagcctcccgagtagctgggattacaggcaccaccacgcccggctaatttttgtatttttagtagagacggggtttctccatgttggtcaggctggcctcaaactcctgacctcaggtgatccgcctgcctcggcctcccaaagtgctgggattacaggtgtgagccaccgtgcccagccaacccagctaattttttgtatttttggtagagacggggtttcgccatgttacccaggctggtctggaactcctgagctcaagtgatccacccacctcagcctcccagagtgctgggattacaggtgtgagccaccgtgcctgacaaagccactttttaaaggcatccttgcagatacttctctgaaatgactgggacatgggagtatggcaccaagttgctgtgtgaccctgggtaaacccctagacgtctctgggcctcagactccttctgtacaagtgaggggtgtacaccagggatctctaggctcctttagccccagcaggccacgagcctctgtttctcagcacggacagccttccctgtcctgcagccccactttgctctgtgggtgggctcagtgccccaaggagtcagcagcctatagcccgtctcttggcacctggaagcttctggtggagctttggatgggctggcagcacacccgagtgtctggtgtgaaggaaaggaagttcctggggtggcaaaaatggagcttgatgagctggctccgctgctctgtgctttgggctgtgggggccctggccgtcccccctgcccctcccctgggctgctctgcctgggcacagcctccacatcctcctgagcctctgcagcctgcacgtctgtatgggccaagtgtctttctgggcttccccgtttggcgggagttcttggcagtgcttagacaggtggatgggatctgcagaagacgttgcgtgtctgagcatcaggacgtcaagttccccagcaaggcacttttgattttgacgttcgatgtcagcagcgatcagttgctggagacttgagccagcaggtgaagcgggctcagcctcgtgtccccgggcagaacgaagggcgtctgcctgcagccaatcagtccttcccctctgtctgggaggctcgttgggagcctctgatgtgttttcataatcaagctccctttctgtcaaaacaccaggaagaggaggttgcctgcagttggtgccctccagggtgatccctgttgggtgttgtggctgaccagctccggaccatccaggcttaaaccacgtggtctgaagtcttctcagcagcccctggaaagggagaactgccccagagtgggtgcgttgggaggggctggggtcctgagctcaagccagttttgggggggcatgccttgtgatgggggtgggccccacgcagcctctctccatgggctctggggtctcttgttctgtttgtccacactcacatgatggcagcactccccagccaggatgctgaaaaggccttgggggcttgggggcttgggggttgggggccagagaggtggtgcacactgtggtgtgtttcaggtactgggaccgggcgctggagcagcacctgccacgtgcctggacgctcacattcccaccccgtctcccgggcgtcacttaatgtgattttcttctcttaaggtgccaaaaagctgaccaataaggccaccctgtggtatgtgcccctgtcgctgaagaatgtggacaaggtcctcgaggtgcctcctgttgtggtaaggtgccctttctacttctctcttgggggcagatggcagagatcaggtcacctcacctgatgttgggaggctcgttcagctaagggtctcaagggagcaacaggccagagctagggcacagggggccaggtccgccagcaggcagtgtcccctctgggctgggcagggcatccctggctccacaggagtttctgtcctgcctccgaggaaacacgggtggggaggagacatgtctgtgtgggatcttctaatgtatgtttaattcatgctgggaatgtgagcgcaagctggcccagaacccgtggacataaacatccctccaacctagggacctttttgtcacactccctaaccagagaaaagacggtgacaggatcgtgatagtgacatgtcctttcgggagccaggaccaccaggctgcgggggccgggccagctgttcccccgtggcccctgcaagctggttctgatctctgcttctgacgcagtggctgtggaaacagttgtcatatgagcttttgtctttctcccttcttgtcccctgctggggtctgtctccttctctgtgtttctctcatttctggcttcgctgtggttggaagcatctttctttctttctttctttttgttttttttgtttttttttgtttttttgagacggaatcttgctctgttgcccaggctggagtgcagtggcgcgatctcggctcactgcaagctccgcctcccacgttcacgccattctcctgcctcagcctcctgagtagctgggactacaggcgcccgccaccacacccagctaattattttatatatattttttagtagagacgggatttctccatgttagccaggatggtcttgatctcctgacctcatgatccacccacctcggcctcccaaagtgctgggattacaggtgtgaaccactgcgcccggcagaagcacctttcataataccagttcattatgttgtcagaggggtcctgccatgggcgggcctgtgggcgaagcctgtggaagccacacatacagactcctggaggggagacgttgggaataaagaaatttaattcgttgcctaaaagtactccctcgcctccttctcctgtgccccaagttcattggcaagtccaaggacagatgtgaccagctcctcccgcagcctgaccctgcggtccacaggccacagcccccaggaagagctcttcttagagggaaggaaccaggattctgagtctctgcagtgtgggccccggcagggagcttttcctccggctgagatatatatatagaatacatttttagaaataataaaactgagaaccagattgtcaggaattggtgcctgctctttttgcttccagacccaatagagacgctgggtgctcttgccgctgccggcagccttggttccctccccagcgtttgccgggtgcaggccacttcccgcctgtaggaggcctggctctccatcttcccgtggccccccggtcaccagggctgatggggcctcggtccctgctgccactgcccatgtgagactggggaggtgctccttgagacctgcttcctgccgtctcttctgtccccagctccgtgtctgaccaggcaccctgccagggtctcctcagagggcagtgaaggtctgggtggggtgtctccccaggtgggtgtggctggctgccgggtccagctgctgtttggcctaggttttgtttttttttaatcttggtgacaggggagccctgtccatatttaatgggaagggcaggctggtggctgcacctttggttttatgagagcaggatggcagcatgccagaatctggccagtgggcgggggctcagggtcggggtgtggagtccgaggtctcatattcccacctgacagtgtcccggggctgctgtgacaaagtgccactgactgggtagctctcaaacaatagaagttgattctgtcacagttctggaggccagaagtgcaaaggtatgggcaaggccctgcgccctccattggccccaggcgaggatccctcctggcgtctccagcgccgggtggctccaggcgtcccttggctgaggctgcgtcactgaagcttctgcctccatcttcgcacggcctgcttaccggagtacgggtcactgggctcagggcccgtcccattctgctgtgacctcattctaactgtttacaactacaaagacctggtttttggagcatttgcattttgaggtttcaggtggatatacattttgagggatgctgttcaacccactgcaccagccctcggttcaacaacctctcccgtctcttgttcttgtggggctgttctctccctgcttcttggctgagatggaagttgtggtcattttcagcagtgctaacttgggggtgattgaagacctaaggagcaggggtcagatgggggctcctggctgttctccgcagaattgcaagcacacccaccccacgttcattcttttctctaagcccttggcgttcagtgagccacatcacatgtaaatattgagacatagcatttaacggatttaattttcagatgctacccagttctgaaatctctcccaggccccatgcctggcttcagcatctgatggtgcatctcaggcgggtgataccgaggggcgggcctggacctgaacacagtcacttttgctgccttgtcgcttaggatcgatgcgccaagagctgttgggtttttggccagtggaggggacgggtagcttctgactcccctggctcccatcccctcgctgcagggacagggtgctttcagcgtggcccctgttagcctcgcctctccttgcccagtaattagctccctccctcccacatcctggaggagctcccagttgctttttcatttcctttgtagagtgggtttgatgagacataaataccaacttggccttgtcgaggagttgttgaaaccattccatggctccgaggcagccggagccgcagatgggagaggctgcacggttctcagctgcagctgttgttcagagctctttgcaccatcttccccccaacacacgctaggcccacgtagtataaacctcccactgatttggaatctaggtctcctgtttttcactggtgggcccggccagaggcctgcttaggaatcccagaaagtacagcttccttccctggctccgatgggcatttatgcccatctgctggtggcctggccacagggctgtcttatattgcatgagcatgctcccgctgacctttctacagacagccatccccgatttaggaaaatgtacgtccctgtatgtatagatatacagatatatattatatatacacatacaaatagagatgtcacatacgtatgcatgtagatatcttgaacacgcacacacacacacacaccacacacacacactggtttcctggatgtgtgcgtctccctggaggaacccagctgccggccatgcgcacagtcgtctagcgcaggatgtcttttctttgctccaccttcctccccagcctgcctgcagctttcccagtgagcagggaacctcggtgggcctgtgatgggcccgaggggccccaggatgaccagaggggcagccgcagccctggacaggctgagtggctgtcgggggtggatgctttggtttttttcaaatgtctgaatatgtgctctagcgaagaggttcacagcctgtctctcagatatttgggccacgctgtctgctgcttcagatcagttgggtttgatgagctctcgggggtgagagttaggtgccagccatcattaaaatgttccagcggttttgttcccagatggaaaggcagcattggggaggaggctgggcttctcctcatggcttgtgtccaggactgggccccatcatttccctgtgcgcctgccaagcccagacaaatgtactggataccatgaggatttattagaccgggggctggctcctttaaaaaaaaaaatccctttaaaaggcatctcttgaggatgctgaagttcacccaccaatgttcctaggtagatacacagcacagactctcttctcacagtcgttacttggccggtggaacattaggacgtggtttatttatggaggaaaaggttgaattatccactgcaacttaaaacactccccacagtttgcttcttttgaacaaacgcttcagctcccttctcagcctcttttgaagatgggttctcaactgaagatgatgggtagttacgccgaggaacggtgaatggtgctgagaccctgcacaattttggagctgagccatgagcaggaattatcgagatgtttaaaactggcttttgaaagaaggcctaacacagccgtctgaagtgaacttgcttaggtcagaggggcttcaacaggcggccgaggggcccagaggggccctgagttccgtggcttccccacaagctcagctggaatggttggttgagtgaatgtgagagcagaagtggaggctaatcagaacagccaggtggtagtcggcccctggccaggccaagggggagggagaaggtcgtgggggatggagcaggcagagggtctggaaccagcctgcggccagcacacaggccccgagggcccctccgagggtcccatccgagtgtggtgcatcccctccagtgtgcacagcagggcagtgagtgaaccgtctgttacgtccaagaaatgcagtatccccctgctgtgtcccgggactcaggagctttggcttttgtgctgagttgttggtgttttttatttatttatttatttttttagacggagtctcgctctgtcgcccaggctggagtgcagtggcgcaatctcggctcactgcaacctccatctcccggattcaagcgattcccttgcctcagcctcccgagtggctaagactacaggtgcccaccaccacccctggctaattttggtatttttagtagaggcggggtttcaccatgttggccaggggtttcaccatgttggccaggctagtctcgaactcctgacctcaagtgatccacccgcctcagcctcccaaattgctgggattacaggcacgagccaccatgcccggcctgtgctgagtcttatagtcacatttatttttaacttctggagtcaaaacccctgtgattcatttggagagccgtgggaggacagttccatcttttactgcccattctctaccaatatataacctgtttgattggccaagggtcagcagggacacacagggttcctgctctgtcatggactttggagagtgggtggggcctttttgaggatccctttattctgtaatgaatcctaggaagcaatgggacagtgcaaaatgattttaagtaacctaggatcagtatggttttaatagtgaaaaagcgggggccgggcacggtggctcacgcctgtaatcccagcactttgggaggctgaggcgggcagatcgcaaggtcaagagatcaagatgagcctggccaacatcgtgaaaccccatctctactaaaaatacaaaaattagccgggcatggtggcgggcacctgtcgtcccaggtaccggggaggctgaggcaggagaatcacttgaacccgggaggcagaggttgcagtgagctgagatcacgccactgcacttcagcctgggacagagcgagactccatctcaaaaacaaagaaaagaaaagtaaagaaaaattgggaacaagctaagtgcccacatagttacaaaaattacgttaaatagatacacggttgcttttaagctccacatacagcaccatagagctttttatatatttgtaggcattaaagcaattccaggaaggatctaaaccaaacacttgacccaggttgtctctctggggagtggagccacatgggatttcactgtttctgtattcttattacttatattaaaacacacatgaacagaagaaaaaatagtcccagttacacaaggctataagggcctgggatcatggccgcccagcgaggggaggaggccgtgtcctgcctgggcctgacctgtctttggtttctcgcagtattcccggcaggagcaggaggaggagggccggaagcggtatgaagcccagaagctggagcgcatggagaccaagtggaggaacggggacatcgtccagccagtcctcaacccaggtaagagccgcggacaccagcagcaggtgccactcctcaccggggacgcataggaggcaggagcaggccgggcctacgtgagcctcatgcttgaggttccccaggtgctgagcatgctctccgggaaccagtttctctggggtccccagggagggctgtcccccagccccgccctgagccatgtagacccctccagtcacacacctggaaggcgacctgcgtgactcagggagtcccagagggcactgtgcgtggggcctccattgccaggcaggtggtgtgcacctgttcacaaggaatttgtttttgttgtatcttttccttgtgttcgctcagtggcttgttcttttcttttttttttttttttgagttggagtcttgctatgtcacacaagctggagtgcactggcacaatcttggctcactgcagcctctgcctcctgggttcaagtgattctcctgcctcagcctcccgagtagctggtattacaattacaggcatgtgccaccatgcccggctaatttttgtatttttagtagagatggggtttcaccatattggccaggctggtctctaactcctgacctcaagtgatgagcctgccttggcctcccaaagtgctgagattacatgtgtgaaccaccacacctggccaagtggcttgttcttgatgggatttccaactcatccaaaaaagaaaaaaacggcagcagctgttcaagcgccacttcttcccggccccactgttcagacattgattggaggaggggctctgccagtaggcactgggctctgtggcatgcccagtttccctgtggtgttggtcccttctgccatccatcctcttgctctcatgtcagggtgctctggctttaacaaaatgttcactcaaaatctaaacgaaggcacgatgagatgttttgcctcaagcaaggactttctacccagagaactccccgcgttcctagaaacaattcagggcagggggccctggggagcatctgtccccctaggaaaagggtgagccctcgggggcaggcaacgagcattacccctctccctactgcacacatggtggtcatgttgtcgtagtggcaggagaactccctccaggacgcactgtgtgcttctctgcctccctgcgatggcctgggctcgtggcacattcgtgctctgtgctgggttccacagggtacctcatgcgggatggcagcctgaggagggtttgctgccccccaccatgccttgggagaccctggtcatggtgggtgtttgagtttcttactcagctttctctgttttgcctccaccctcagcagtggtggaggacctgcctcaagtaatccctttcccccttggatgtgcctgtgatgtgggctccactctggggtccacctgctcctagccctgccgagaggcgccctggcccctgctaacctggactcggggcattgttatggccgctcacctcccttgcttagtccacataagcaccaaaggggactggtgaaaacccagtgggcgcacagatgagagcatggctttctgggcttggctgctggcatgcagcaggagtgtgcttgttttctgggcgggtcaacttgaggcttgaacaggagtttgtgtgtatttggtctcacatgtgtgtctctgactcagtctgtgctccagcctcaacttgccaaaagcggactggttgtcaccttaggccagtgggactgggtaggtcggtttctttactgttggggaaaccactgtaggtttcctctcttttcatgtctgctttttaacaaacaccaaaaaaagaaagaaagaaaattaatgtgtcagtattaatagaaagaatggtgctgctttgatgaaaccccagtaaagagatatctttttttttttttaatttgaggcagaatctcgctctatcctcctggctggagtgcagtggcgcgatctcagctcactgcaagctctgcctcccgggttcacgccattctcctgcctcagcctccccagtagctgggactacaggcgcccgccaccatgccccacttattttttgtatttttagtagagatggggtttcaccgtattagccaggatggtctcgatctcctgacctcgtgatccgcccacctcggcctcccaaagagctgggattacagacgtgagccactgcgcccggctgagatatcttttaaaaataaaatttaaacagccagtttatcaacacagcaatacaccagacaggcctggaggcacgtgctggggcaggcagtgcccaggccgtgcttttgggagggcagcccagcagtcaggtcagacaccggctgtaaggaatgggatgggatgggagcaacgggaggtgtcttaggaaaggcaccaacacagcgctcagggccagacaatatgtccacattcaaatccctagagcctgtgaatgggaccttatatggaaaatgggtctttgcagatgtggttaaattaaggatcttgagatcatctgggttatgcaggtgggccccaaatccagtgatcagtgcccttgcaagagacaagaagaggctatgtctagcctaacacaaaggggtcctggaggagagggttggatggaacatgggggctgcctggacctacctttttgtgagcggtttctggagagagcttggggtaggtgccagaccccggggggtgtgggcagcactgctgggctgactctggctttgagaagcatggattagatcctagcttctgcctttaactgatcctcagggacactaaaattactcaaggttttcaatcagtttaaattcctttactcgtgggattctcttctgtttgccagcctccgattgactgtaaatctacacgtgatatttttcagaatgtgttattcactgtcagtcagagttggcctcctgaatctcgatttcctgattgtatgtgcttttatttttacttttttgttttataaaaatgtatcttcctcagatgattggattagagactcggcttttaaatatttcttaggaagtcccatgtccattctttcttgagcatttctgaacatctgcatctttgactccagtttcctggtagagccggtatctcagtggcatggcttcccggtaccctcgggagcccaggggtgggctcatctgagaccagcctggtctcctgtatggtggcttagcctgagttgggtttggcaggggcgtccgggtcaatggggaacagcagctctgggagaagagtgtgcgtatgtgcttggcactggggtctttctaacaggtgtgacacgtgctatcccatcccgtgggaggaccctccgtctctgccctggagaggccatcttggcctttgacttgcctgctcccagcccctgtccatcccacatcccagacctcatcctagagcaagagttcagactgttgcctagcaacctccacaggggtggcctcgtctttcaggtacctcagagtctgagagttccttaaaagtcctttgtccaatatatacagctataatttgtctatatatatatatatatatatatatatatatattttttttttttttttttttttgagacaagtctcactctgttgaccaggctggagtgcaatggtgcgatctcggctcactgcaacctccacctcctgggttcaagcgattctggtgcctcagcctcctgagtagctgggattacaggcatgtgccaccacacccagctaatttttgtattttttgtagagacagggtttcgccatgttggccaagctggtctcgaactcctgacctcaggcgatccgcccgcctcagcctcccaaagtgttgggattacaggcgtgagccaccatacctggccagaaggcagacctggtcagggactagacctcatctgttccctgcccaggacagctggcactcagaaagggtagctcattcctaactgacaagccccaagctgttgaacacgccagcccactgggccacgaaatgactgggactcatttcaggtgaagacaggtcctttctaggtctggccttaggcaagtaatgtttctcagtagccgaaaaagctggtgggatgaagggtggtcctgacccagaagttgatacctgaggtctcctaagtgtccgatttcattgctttgtttttcttttttttttgagacggcgttttgctcttgttgcccaggttggagtgcaacagcatgatctcagctcactgcaaacttcgcctccctggttcaagtgattctcctgccttagcctcccaagtagctgagattacaggcacccgccaccatgcctggctaatttttgtatttttaatagagaggggtttcaccatgttggccaggttggtctcgaactcctgacctcaggtgatccacctgcctcagcctcccaaagtgctaggattacaggcatgagccactgcgcccggccccagtgtcatttccgaggctttgatgtgcctctgggtcatggttgctaaattgtgtcaccacaaatcatatgttgaggtcctgaccctgagtccctcagaatgtcactgaatgtaaagaaagagtctttaaagaggtaattaagttaaaatgaggtcattagggtgggctggtgtctttacaagaagaggaggttaggacagacacacacagaggaacaaccctgtgaggacacgggggaaggcggcatctacaagcccagcagagaggcctcaggaagagccagctgctgataccttgacctgggacttccagcctccagggctgtgagacgaatttctgccgcttaaggcgccagcctttggtgggcactcttgttacagcggccccagcacacgggtacactccacacacagaatttcaaaccgcctcccctcccttctctcctggtcactgttagctgccatgtgagtttcctcattcctgccctgggcttgccctcatgccagggtgtgtgggagaagtagcatgtcatggagtcagaagcagagtagaggagctcctcccaaaaagccacattctgggggcctccccacccagcccaccctcctgaatatgcgtcaagaggtccttgcatctgggcccctctgggagctggcgtgcagggtcgcgatctcaaagccaaccaacagacccctccaagtgccaaggcttttgggaaggagcccctgggggccccgacatcctgcattgcagccagttcgcacgacctgtggcttggcccaagggaggggatgcctgctctcccacctgctgcttcagcgtgggcctgccagggtctaggggtgtccagaatcagcctgcaattgccgagggcaccttgggcctcaggggaatttagtacaccctgaaacccacaataccacgaggagtggggctctgagagaaggccagaaattggcggcatgaaaagattggaaaagcctattgtttattgacctgggaacggaaggagactgaaatcaaaagcccattaagactcagccttggctgggcccggtggcttacgcctgtcatcccagcactttgggaggctgaggtgggtggatcacgaggtcaggagattcagaccacggtgaaaccccgtctctactaaaaatacaaaaaattagccgggcgcagtggcgggcgcctgtagtcacagctactcaggaggctgaggcaggagaatggcgtgaacccgggacgcagagcttgcagtgagccgagatcacatcactgcactccatcctgggtgacagagcgagactccgtctcaaaaaagaaaaagactcagccttgtgtcaaaaatcagattaaagtgtggtttacacacccacatgtgtcttgagagagtgagaaagggagtggagtggagtgggatggaaaagtaaaaaaaatacaccaggcttgagcgtgacacttggaaagaacgttgggtgtggttcctgtcacatggaactgactggaggcagacagatcagatgcctactaagtttacgaggaaactgaatttgcctggactgaaaaaaagcttttgactgttcaaactttaaagtaacctccccaaacctagacaagcaggaggtgggccgtgggcccctatttcccagtgcccgcttggatgaggccatggtggataaccaacagggaagaaccttccaggaggctgagcaaaggaccatgtagttcctccccaagagtggaatcagagtctaactaaagacccttccccatggccatagctcagaccctggcgggagtcatctctgcttgggccaggggctcctgggtagctcctgtgttctttcctttcctgaatgagtgtgctcttctgttccctcttccgctgctgtataaagggtgcaagtgtaggtaactcatcttcttagttcattggctgcaggaacatgaagaattgcgtgtaaacacgatggagaagactgcatgcatgtgaccagctgctgcgctctgaggtcagcgcagaggccggatagggtttcaggtggtcgtccttgagggtgaggtgctccacgtgtgcaaagaatacaacagggatctggtgactggaggggtagaaccagacagagatgaccaagcctgtctccacacatagcagggccacactgccctgcctgccctgcagcgggtgtgaaaataccatgtctagagtgtgagcagagtgaaatgctgcttccaggcctgacccatcaaaacctcaggtgtgtgagcctcccccgactctgtccctttccaaggtaaccttcaaagctacccattaaaagtaatggagctacgggaccaaaggggcctgaatccccgcatctccaacatttggaggaaatctaccccactaggaaagcctgatttggactttacctagcaggaaatcaacctcactgtgtgacccactagggtttcagggtttatctgctgcagcagtgactatgatcttgactgacacagtgcctaatctgtgaacctgcagtttcaaaatgatgtgaggagcctgaaccaggcccccaggatagcagtgggcgaggtttacacagccataaacacaaaactctccttttcggatcccgtcctatgtgacaagctatttacagggcttcgtgtgtgctaggtgtttacatcatcttcataacccgatagttttgctttcaccatctctggttccagctgaggaaactgaggcaaagggaggttaagttcccatgaaggcagcagagctgggattcaaacccaggcagtccaactccagaacctcccttcctcccctatcctctcttgcttcccccatgccctcagcctccaaactactgcttacgggagcaggactatgggcctggccagagggccagagacatcaagtgggaggcgtttcagacccagggccaagcccctggcctgaccatgttcaccagccctcgcaccctcgtggatggctcagggcggatcttcctggggcttggccagagcactgcctgaccccagaaaggcggatcccaacccaggagccggggctaggtgacctgccaggaccccatctgctctggaagggctggaccaggcttggaagtgaacactgttttcaacgcaagcgccagggatgaggcaggcacttgaacttgtctgaggcagggctaattttgtcataaaccctaaaaatggacagccatgtggccacatagtccctacatggtcaaagctggacagctgacagctatgaatccgaagagctcatggtaattccattttcttttgtcagacagagaaaacaataaggataactgacttttcaaaaattatatattgggctgggcaaggtggttcacgcctgtaatcctaacactttgggaggctgaggcgggtggatcacttgaggtcaggagttcaagaccagcctggccaatatggtgaaaccctgtctctactaaaaacacaaaaattagccaggtgtgctggcagatgcctgtaatcccagctacttgggaggctgaggcacaagaattgcttggacccaggaggcggaggctacagtgagctgagattgtgccactgcacttcagcctgggcaatagagcgaggctttgtctcaagaaaaaaagaaaggtctaccttctagagactggacgttatatgtcatcggctttttttcttaagtgcggcctcttaaagatatttcaggagcagtgcagtgttgggtgactgaagctcctccaagatatttggggctcttgcaagagtgaggtgatagagcagtgaatggggttgggggctggccagagggaacagcttgctccctgtggagctgtacattctcaggctgtggagtaaattacagaaacactgtggcacttcttgtaaaattggaaatgcaagtcagatggttaactagagcctggtggagggtcacacgcagccccgggactcacagctttgaggtgtttcatggctacccctgggcagggccttgcagggcactgatggccccagagagtctcgtcatggcccactaacagaatgggtcatgaatccttgaaaacctctccttcaccaactgtagcctgtttggagaccatagttttccttagagaaatcatagctgaacccggctttggacgccttcgttgactgtgtagacctgagggtggtttcggcattgccagaccattcagctgtgggaatcagcctaccccataactaatctctctcttttgcaattccagagccgaacactgtcagctacagccagtccagcttgatccacctggtggggccttcagactgcaccctgcacggctttgtgcacggaggtaagaaggaagcgccctggccactccattcctgtcccttggctcattgttgcttctctggcagccgtgctgctgtctgacacacttgaggctcttgtgtttggtgaagtacaaacttccaagaagttgtacaataggccaggtgcagtggcacatgcctgtaatcccagcactttgggagatggaggcgggaggattgcctgagcttaggagttcaagaccagcctgggcgacatagggagacccctgtctctacaaaaaaataaataataagccgggcatggtggcctgcacctgtgatcccagctactgggaggctgaggtgggaggatcgcttgagcccaggaggtcgaagttgcagtgagccatgatcgtgccactgcacttcagcctgggcaacagaacgagaccctatctcaaaagaaaaggttgaacaataaatcacagaaatatgctggcaggctgggcgccataggtcacgcctgtaatcccagcactttgggaggccgaggtggctggatcacctgaggtcaggagttcaagaccggcctggccaacatggcaaaaccccatctttactagaaatacaaaaattagccaggtgtggtggcaggcgcctgtagtcccagctactcgggaggctgaggcaagagaatcacttgaacctgggaggcggaggttgcagtgagctgagatcgtgccactgcactccagcctgggcgacagagtgagactccgtctcaagaaaaaaaaaaaaaaaaaagaaagactctggcacccatttttcaaattggtgataaaaattaaacggatgactgcgtccctggggaggctcacatgcagccccgggatctgatagctgtgagatgtttaatgcctgctgagggtcagggcagggccttgcagggcaccgatggccccaaagactagcatcgtgactcaccggcagtgactcgttaataatgtttttcctctaatgtttgcatttattttttcccagtaagtacagatctcttctcaaacaacacaggccttaaagttcgtagcttggcttcccagagtttgggaaacagctggaacgcaagaggatttagctctaggttcacagatggacactttttactttaataatgtgtaattatttttcatgatttaaagaaaatgtagatagcatatcaaacctgtaatttcatggctactgtaattttgaagaagaccaaagtaagcttttaaaaacaagttggttgaagaaaaacgtcaaggagataagatcatagtgaagtggtatcagtgagagcagaagttgtgaaggtgctgtgtggttaatgaaggctgggtgcagctgttcttggtgtactgagctattcatctgtcccaggcataacaggcacttttgcacaatgctgtcatttctaactgcctggaacaccaagttctgttttcttctccactcagaaaactcctatttatccttcaaaacccagctcaaacgacaccactctgtgctggcttacatttatatttctaccagggacacctcaggagcagggattggatcatattctttgtgttggctccagcacccacagagagtcaaaggggcaccttgcagatacttactccatgagtgagaggcaccaatcactttcaggtttgggacattggctctgggcctatgagatggagtctcactctgttgcccaggctagagtgcagtggcatgatctgatcttgtctcactgtatcctccgcctcctgggttcaagagattctcccgcttcagcttcccaagtagctgggattacaggcacgtgccaccacactcggctaatttttgcattttaagtagagatggggttttactatgttggccaggctggtctcaaactcctgacctcaagtgatctgcccaccttggcctcccaaagtgctgggatcacaggcgtgagccaccgcgcccggccctgatgtgagatatgtttccaaagtttgtttctttttctttttcctacttcatgattgttttcgtcttcccactcagtggtggctgcactgctcgtaaatctgattaactatggtcttgccaagggaagctgtgctttataacagcacttccaggcccacgagcactatgacaatctgagtgtcttgctgcccgcagaacagctgttgcctcagaggcattccctgtttccccttccttactgcccccatgtctctgtcctccctcgaattccagggtgggctcagctccctcttccgagcctggccatcccaagcccaggcttctgccacttccgagtattgtgtttgagactcatacagctccattctgcctggaatttgtgaaactctgggctatgagttctgcttactttgtcgacatgttagacgttcttcactaaatggggcatttccgtcgtcgctgtctacgtgctgaaaagtccacacccttaagcccagtctttctttctttatgtgctgaaaggcatcagtgagatgccaggagtgggagaagtcactggagaagccccttggaagtccgcagcatgtcatgttcatttacggtgtctaagctgcttcactgatacaggcacatgttaagatgtgtattaggaataatggctttacaataatgcctattttagtagggattttctgcccacaatttgtaaaaaaatctaataattttaccaagcttaaccttctctcttttttttttttttttttttttttttagacagagtctcactctgtcgcccacccaggctggagtgtagtggcgtgatctcggctcactgcaagctctgcctcccgggttcacaccattctcctgcctcagcctcccaagtagctgggactacaggtgcccgccaccacgcccagataattttttgtatttttagtagagacgggttttcagcatgttagccaggatggtctcgatctcctgaccccgtgatctgcccgcctcggcctcccaaagtgctgggattacaggcatgagccaccgtgcccagccttaaccttctcttatagggcctggtaactcaccacgagtgaatgaataaaataaacaccacattgaaaacacgaactgtgattttatcgtattttcctgtaaagtactgttggcaagaatggcatctaaaatcatttgaatcaaaatcttcactaaactgtaattcactagatgccagttgcagaagaaaatggtgaagtggatgccaatttagcctttattctgtaattctagactgcgcaaagctgcgcccgagtcccgttttctgtgagttccacacactggctagccttggtcttgaggactttccacacaggtctgggtggtgataaactcatgaagggtgtcttggaaagggaggagctcttctgcctggaatcacagggagaacgcagtgctcccaccagacactagctcactgctgctttcctggttgcatggacagaacctcctgtctttagttaggggaatagtagagatctggggagtgagcccgagggtgtggagggtcattgtcccgtgcgggaggagggttgatgatggtgtgtgtgcagttgtgggttgaagggctcgtggagggtgtggaggaccgtcatcgtcccatgagggaggagggttggcggggtctctgccgttctgggttgaatggctcgtggagggtgtggaggaccgtcatcatcccatgcgggaggagggttggtggtgtgcgtgcagttctgggttgaagggcatgtgaagagggcaaactgggcttttggtttctgtcttcccttgagtcctgagtgagtcactccatggtcccccaccctcctgcatagagtgctcaggatcggcccagaaaagaccagttaccccctgttctcccctccactacccccacgtttgcttgtacagactgaaggggtgacctagcagatacctgtgggggtccagaccttgggagagggaagttcttgggggtcagccggtagccctgttcaaggcagaccttagaggagtcttgagcatgcattcttcacttctcaacttttggccatcttagttttttccttgtactttattttttatttttaaattaattattttatacttaagtattatgtggaaacaatccagagggcttgtgggtctctcttcctcccatcgctcctgcaggggtagctcctgtttctgattcaggactctgcttcctaagcatgaggctctgttgctgtcccttgatgcgtaagtttcagatgcatgagccccatcactgttcatcaggtggggtactgtgattactttccctcgaaacggtgttactacgaaagccaatggttgttctgtgccctccagcagctctgtaagatgctctcagtacagtctgcctgccacggaactgttccctgccatgttccctagaggggtccgccttcagtcctcctccacgttgctcattctgtgcctgctctaaactgctctcctgggacggcctttgcactcgcctgggttggatgccaggattcatggatcttcaatttttctctttgctggttttggtggaacatgtcctccagtggctccccaagaaaggcaatatattaactggaataaaggctcagctgccacccagacagcttggcttcaacaagagagaggactttttcttttttttttttgaactaacaatgcagctgtgagcgatccacagccgataggcagccccgtggtgctggggacccaggcttctgctgccctgtggctccgccagcctgggagtgccctcttggtgagccacatgttgcctatctcttcatcagcgtccagccccaaaggggtggagggcatattgaaaattgcagcctccccttttggccacaatgtcctcatgtggccacatctgtgggtgggtgagtgccgctggtcagacgtgtctgttagacattggagtgactgatgaaggaagagatagtctctgtcatggggcctagagggtcatcttcccaagctttgcgcgtctgaaaagacttgtggctgagcagggtgtggggaagtgttccttacagggcttggaagcgtttgttccatgtcttctggcttctgaggtttttgctgggaaattcagggactgtagattttccctccactttctggccgcaacctctgcctgtctgctggcctgatcttccctccccattccagccttcagcccttggcctatccttgatcttccagggactttttattactaacccatttatctggatagcaaatcacgtagtttgcagtttctgggtgtttcttccaagtgaagtgacatccttctccacccctgtcccccagacaccaccagcttagcagccgcaggcgattatgctgtgcactcacattgagagccatggttctggctcactggggtcaccccaggtgtttggtaggtaggaaggggcccaagaacttgcactgcccccttgctccttgcgatgctgaggctactggtctggagtccccactgggccgtgtcatgtctctctcaatctctgcgctctaggccacccttcccaggcagttttggcaggtgggctcacctcatgtaattaaaaagttttaatttcatctgtggacagctttttaaaaaattttttgggtacatagtaggtatatatatttatggggtacatgagatggtttgatacaggcacacaatatgaaattagtacatcggccaggtgcggtggctcacgcctgtagtcccagcactttgggaggccaaggtgggcagatcacttgaggtcaggagtttgagaccagcctggccaacatggtaaaaccctgtctctactaaaaatacaaaaattagttgggtatgatggcgggtgcctgtaatcccagctgcttgggaggcagaggcaggagaatcacttgtgcccaggagggaggggttacagtgagccaagatcatgccactccaatccagccagcctgggtgacagagcgagactctgcctcgaaataaagaaataaagaaagaaagggagagatagagagagggggagggagggagggagggaaagaaagaaagcacatcatggggaatgaggtatccatttcctcaagcatttatcttttgtgttacaaacaatccacttacactcttttagttattttgaaatgtacaattacgttattattgactgtggtcaccctgttgtgctgtcgaatagtagggcttattcattctttcaattttgtaataccccttaaccatctcccctggcccctgctaaccgcccatcctgtggttagctttggagcctttccctctatctcaggctccttccccggccaccagctctaccgagggagacgcagcctccttttgcttagagccagcccttcctctccatcctgccctcttctcacttctccgtcagatccggtctgtatgtctcctccacttgaggtgatgttggcgcctcccctgagaggttggatctgtgacctcgtctctgctgcctattaaggtcacttggggaactcttaaaaccacagacacccagaccccacccgacaggtgacccagaccctgggagtcggggtgaggggtgtccaggagctgtagtgtcccaagctccccagggaattctcggggacaggctggggcagcactgccgcggtaaacgtcctaccctgggaaagagaaacggctgtgagaaaggggcgctcctggactcgtgtgtccatgagtgtgtttcccttcttctcagcaagtttcccagttctgaaatccttcttgtcatcttcctgggtacccttaagtgagcagcctagtacccattttgagctattttgagaagccggaagaagaacctcattcctacagttagttactgtgatcctccctgaattataccacaagagaccccaatagctggggacggagggagttgagataccttgaggggcagattgaaccttgcggacagcggcagctccagccctgccctggaccggttttgttgggggaactgacccggctggcacccccaacaccgcacctttgtggtacatcagcctgtctctctcatttcagcctagatgtggccctcatggggccctcgtccatgggatgatccgggttgttctggttgcttctccggttcctgtatcagggtctttagagcgtgaggggaatggagggagggcatgggttgttctctggcttagaaaagaacctcaacgtttactgatcacatcggctctgagtaaaaactaactctgctctgaaacagaagtcaaggtgggtatcctcatcgggagagcttgctcagctcccatggtactgggaagcacaggatggagcatgtggcagggaagaggggccacaatagagtttcctaaactcatctgagccttagaaaccatctttgtgcttgttaaaagtgcagattccggctgaacgtggtggctcacacctgtaatcccagcactttgggaggccaaggcaggtggataacttgaggtcaggagttcaagaccagcctggccatcatgatgaaatctcgtctctactaaaaatacaaaaattagccaggtgtagtggcaggtacctgtaatcccagctacttgggaggctgaggcaggataatcacttgaacctgggaggtggaggttacagtgagccaagatcataccactgcactccatccagcctgggtgacagaacaagactctgtctcaaaaagcaacaacaacaacaacaaaacaaacaaacagattccccagcccttctcctggaggttttgctgcagcagggctgggctggggcccagaaacctgtatttttagcaacaagtgccctgggtggctctgatgattcaggggcctcagaaacccacagctagagtgtaggtttgtctcaatggatccagcaaccgtgtccctatgtccagcaatctcccacccatgtccctggacctctccagagcattggacaccactgacctggccaccctgaggtcccctcacaggatttcaggccattatgctttccaaggccttcatcctcccacgctggtgggcgccagggtggctggggaatgggcctgggtgtctgaatgttgatcgcaccccgagtggttctgcgcacatcagggggaggaccctggggctctctggaggctctgcctcctcctctttcacctgcccctgagtgtgggtgtgcccctgaggtctgccctcaccctcttcccaccttttctcccgtgagctcacctgaccccacggcctcagctcccgcctccaagtggcaactgacagattttctaatatccagctcagttgttactcccaagctctggcagcctgtggcagcttcaccttggacctgctcttcctctggattccccacttgctgtccttgtcctaacttctgaaggtgacgtgtgaacggtgccctgaggctgtgacctgtggcagccctcacctaacctaaactctctgggcctttctctcctccccaccagtgagataatgcagggattacaaacagacgagataacacagggaaggcagcacatgggaggcatttaagaaagatcagttactttcataacttttattacatttactttattagttttattattacagacatagagaatgttctgctccatggggaactcaagcttttttctcatatccaggggagcgtttacaaaataggatcatgcacttgaccacaaagagcgttttaattataagttccctaaagtgagacccattaagcctaagcctccttaacgagaacatagcccctggaaatggaacactcctgcaaataactgccggccaaagaaaaagtaacgtctggacttatgattatgtagaagataatgaaaactgaatacttcctatcaaaatcggggagatagctaaagatgttttcggagtaaaagtgacaaactttgagcttattacttaaaaggaaaaataaaaaatacctaagtgttggaactggaaaaaaaaaataacaaaatccacccacaggaaggaggcggaaagactcagggcaggagcaggccgactttatgtctctgtctgggtctctgggtccctcctctccccatatcttggagctgtcctcccagccccctactgcaatcccccaaatccaagtctttaccaacacagaacctgtaaagtttgggccatcagagcttgttccgctgtcccgtccaagtccaagcaccctctagttgcagcctactgggcactgccctggcacctggtttgcagaatgtgggtgtgaggtcatgactgagccccttaactgggatgactcggcctctgctgccgaggctggagaccacgtctgttttgcctgctctgccagccccaagtcacagtgtgcacacctgggtcaagggagtaaatgaaagccgacagggcgaacatgactgttgatcggccttggcggtgagtgctgtcatggcagaaaatagtggccaggacgtagtggttttctattctgtgctatcttcagtctacaaataagtttatcagtaaagagccactgactgcgccagctatgacagtctaggagggtctggggagatgtactggctgtgctgggagccctctgtccggtcgctgttccctccgcccagtcgcttttccctccgcccagtcgcttttccttccatccagtcactgttcccttcacgtggttgcagttctctccacctggtcatggttctctctgcctggttgcggttccctctgcctgtggctgttccctctgcctggtcgtggttccctctgcctgttgctgttccttctgcctgttgctgttccttctgcctgttgtggttccctctgcccggttgtagttccctctgcccagttgtagttccctctggttgctgttccctccgcctgtggctgttccttctgcctgttgtggttccctctgcccggttgtagttccctctgcctggttgtggttccctctgcctgttgcagttctctccacctggtcgtggttccctctgcctgttgctgttccttctgcctgttgtggttccctctgcccggttgtagttctctctggtcgctgttccccctgcctgtggctgttccttctgcctgttgtggttccctctgcccggttgtagttccctctggtcactgttccctctgcctgtggctgttccttctgcctgttgcggttccctctgcctggttgtagttccctctgcctggtcgtggttccctctgcctgttgctgttccttctgcctgttgtggttccctctgcccggttgtagttccctctggtcgctgttccccctgcctgtggctgttccttctgcctgttgtggttccctctgcctggttgtagttccctttggtcactgttccctctgcctgtggctgttccttctgcctgttgcggttccctctgcctggttgtagttccctctgcctggttgtggttccctctgcctggttgcagtttcctccacctgttgctgttccttctgcctgttgtggttccctctgcctgtttgtggttccctctgcccagttgtagttccctctgtctggttgtggttccctctgcctgtttgtggttccctctgcccagttgtagttccctctgcccggtcacagttccctccacctgtggctgttccttctgcctgctgcggttccctctgcctggttgcagttccctccgcctgttgcagttcccccgcctggtcgtggttccctccgcctgttgtggttccctctgtctgttgctgtcccctcctcctgttactgttccctctgcctggttgctcttccctccgcctgttgctgttccctctgccagggtcttggttctttctctctacctgggttacccagacaactgtaaggctgcctgtgtttttctccaggtctctgaagaaaaggaaagagacctctcatgagcactctgtataaattagactgcctcagcttactttttattccaaggcaccatcactcctgacacactttcctgtgacctctgtctgtctgttcactcctgcattcccacttagcgcagggcctggcatggagtcagcactcagtagctgaatgactggactgggaaaaatgaaggtcctgcgtgggaaggactgcggactgtgctggtgccgcgcagtcagccccacccagaggattgtgccaggctgcacgtgcgctgcacgtgagaaacacgtaatgaccgctctctaactcgagaaccagtgaccaggcacctcctgtgtgccgagccccgccgtgctccaccagggacactgtgaagaagacacagccctgctggctggttgggagtcaaaccttctgcgacaaacatccatgcaggtgtctagctgctggggagccaaacaacgctgctgggggtcttgaggccaggggacagcacagcttagcctgagactataggaggaggcagaggaaagggaaggcagagaaaacatgggaggggacgcaagtgaggcctccaccaagacgctcttgttcacttggtcttcttggggcagttgtgaaaaaacaatcttttgcacctgcaggaggagttgactttcactgaaaaatgcaaaagagggcacagttactcttttccaattccgtgaccttgtttggccggagcccccactgctacgtgggacacaacacaccagaccctcagtgttggggcaaggaaggaaaaaggtggacgaagagctgttccctactcttgaggaacttctggtctagggggatcaagaggtgaacaaacaaatgctttgggacgccgctttcttcctcgtgaagctgagtggcacaggctgcagttaaattccttctagtactcgccttctaggatcttggtgtttgaaaacatcgttctccaggttcttctgttctgaagaacagcttcacgtccatcctgatgcttcagcgggggagcgggacgtggggactggtgaacttgaaccttgaaccccgagatggtgtcaaccctgaaagcctgggcgtggggttcatatcactccagtccaagcatcctataggcacctgtcccaggaactcactttgtcctgcccacactgggtcctcctctcagccgggtccctggtggccagcacgtcatccctctcaaatcatggggcactgacccctttccagaaatatggagtatttggttgaggtcttgccatgaaccgtaagaacgtcctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgggggggtcagccccccgcccggcccgccgccccgtccgggaaggatgtgggggggacagccccccgcccggccagccgcctcatccgggaggtgaggggcgcctctgcccggccgcccctactgggaagagaggagcccctctgcccggccagccgccccatccgggagggatgtgggggggtcagccccccgcccggccagccgccccatctgggagggaggcgggggggtcagcgccccgcccggccagccgccccgtccgggaggtgaggggcgcctctgcccggccgcccctactgggaagtgaggagcccctctgcccggccaccaccctgtctgggaggtgtacccaacagctcattgagaacgggccatgatgacaatggcagttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaattatcaattaaaaaaaaaaaaaaaaaaagaacgtacttttctacctgtgtacgggtcggatgggggtgtttttcttttcttttctttcttttttttttttttttggtgccacattgtccagcctgtgcttctctctttagctgtggtcgccaggggcatgcgtggcagatacccactgacaacatttccctgttccaagtgatgaacacaaacccttcaaaaggagcgtcccctggactcttggaaggaaactgacaccccaccaaaatttctgggccttccaggaagcgaccttgctttggtagcctccaggctgaggccgcagcctctcactggcctgtccttcttaggggtgggcctgggggctcgtgtgtagctgcagcctcctcttgctggggcctccatggcagttgggatgcaaaatccatctaccctttctctgcttccttattttgaaagtgaagcatggatactcaaacatcaggaagcagtcaagacctccccccttccctgcttcagactctatagaatgtaaggaatcaatgggcgtgggcagctcttggcccttctccctgggtctatgatgctcccagacgtccgggaaccacttagtgaatattcctctgtccatggtcccagccacagaacctgggagggagaggccagggctgtctcgcaggttctcactcaactggatcttttcagaactcttgtaattactaacgggtggggtatttaaaacaagatgaagttactatcattttcttaatataggaggccggcgcccacgctccgtcagttgggattaaatatagaaatgggggcatctcagattgccgcccacagaacagacagcggcacacgggctccgagctgtgaactgccgccttgggtttgcaggcaagcctgacccagtcacgagcaaggccttgggagaagaaaatgaagccttatttttaagccagttgacagatcaatacttaaaaacaaaaaaacacaaaacaaaaacctataagcagttaaatgttacaattaaaaatacctttggtacctaacgtgtatacattagtggccaagaaagtcttttttttttccccgtaattcttgaaataaatgcagctccaaggacggcgggtcctacaattttgttgtcatcttttaaattacagatcttgggagatgaggactgcctgcggtggactgtaatgtgccaaagttattttccaacgttggcagcacccgttgtgcctgcggtgggggaaattgatgaggcttttcagtaggaacctggaaagaagcatcttggaaaaaacttaggcactcgatattttaaatacagcggaagaaagtgaaagggagacagtggcttccagcgtcagaagcggggtggctccctctggcaaggcaggggcccaggtggacagtggtggcaagaaaggcagttgtgaggaaggcactatgtttttctgggttgttttcttaaaatttagttttctcagttaacacattgattgtagtgtcttgtgtgtgctgtcatagacacaggcattgtgtggtagcagtctttacacgcaggacacgatgggcacgtggctttctaatgatctcacttctgcagggaccatctgacctcattgctctctctcggtggcaggtaaccagcaggcttggcacgaggccctacaacaggatgcccagggttgtgtctcgccggtaggagagggcttgtgatcaacagtggttgattaaaatctcagtttttatgagatcactttccttccctctaagtagccagcagagttcagctgacacacagaccatggtttttctatgtttttctcaagcccactggatcgacactaaaaagtgcatttgtgaaaacacagactggggtgggtggaggctgaggcactggtttttcgccaggtccgtcttctcgggtgggtttctgctcccgcctctgatcctgctgcctcaacacctgcagggactgggagccttcgctgtcgcaaggccaaacgcttggtttttggaccgttctaagtgtttccccgagaaaggttatctcctgagtcgtaaagttggccttgagttggcccaggatcctactatgacttctctgggaggtgcagatgacctgaagtggacaaagatccttccagatgagatcctttgggagctcagagccctcctgcctgctgccctggccagtgtccatgaggccagcccaggtcttgaaagacctccttgtctgccagagtcaggatgctacaccgtcctgatttcccaccgctcgtgagtcactgttccgggtccttagaataaaactccaggtgtggggtataatctgataatagacacacatggtgggattacgacagcccccctggcctgggccccagaatagcactgactccatccaccagtcttggccttttccatcgttagtataaagttgttgtttcatagcaggtctgccgctgatctaaactctgcgtggtttcccaggccggtgcgtgtgtgctggctgctggggctggaggaggctgtccctgtaaatgtcaccgtccagctcacacagcaagatcattttgagtgtgggcttggttttttggccggtcatcaagctcacctggctttggggtttctgggaccggatgagcttttcctgccctcatctgtgactaattcttgacgcaaattgttgcctgaaggagccacatactttgtggctggggcagcttgcttgggctggttgtgacctgttagtcaacctgcattcattcattgattaattcattcattcagcaaccatttcctgagcaccagatgccagctctgtgttgggtcagggacacagggacaacgaggcaggtcctcacccagtgcaggcgtccatgtcacatcatgcagtgtggtctgggggtgccgtgtggagcctgcaggagcatgggggtggtgaagagggtattcgcacaccaggcactcaatagccgctcacatcttcccctcggggttgactgtcacgtgctttggatcctgagcggttttcagtaacatgaggtcccttgtggagtctcataccaacaaggtagccttttggataaatggggcaaaccccggtttgaaggagctgattacaactccttccatttattctctcattctgcttttcaggatggaagaacaaggggttaattgtaggcacttcctaagttctgaacattaaatccaacacgaacccttcctttccctcctccttcccccacagctaaaccaccctgagttgatgacaccagctggtggccagcactggacactctgggtctgtgactttgaacgctccttcctgcaatcatcttgggaagaattccactctggactcgatgtcacaggacaggatggggaggcaacatggcattgcctctggtggcccaaggtcaggtccggtcccatcctacccctagtggtgtgactttggaagcgtgactctccatgtgtctggttcctgacttgtagaatggagacagggaggctgctgcctcatcgggtgttgtccagtgagacccggtgttggtcattctgtgtttgtggagagggaccggccgcgcatcaggatagggtgctgtccggtgagattccgtgtttgtggagaggggaggggccggccacacatcaggatagggtgctgtctggtgagattccgtgtttgtggagaggggaggggctggctgcgcatcaggatcgggtggggtccggtgagattctgtgtttgtggagagaggccggccacgcgtcaggatcgggtggggtccggtgagattccgtgtttgtggagagggccggccgcgcatcaggatcgggtggggtccggtgagattctgtgtttgtggagagggccggccttgtgcatcacaggatcgggtggggtccggtgagattccgtgtttgtggagaggggaggggccagctgtgagtcatggactcaggctgcctcagtgaacagacaaagttcacggctcatggcactgactttgcagccgagttcctctatgtgacatgctgggccatgcctggcaccagcttccccggcaatgccagccgctgccctcagcatccagctcacggcccccagcagcatcaggaccctgtgtccatgtgctgtcctggctcctgatgctaggctttggtgtcccttccttaaaactcctgcttgtccctggctcatttgttcctaggaggaccctgactagctgctggatggcgacgtatctccccctgaggaaggccacatatagtgcacatttggtgataaacttctcacatactccagttaacaatgtgtctccccagcacacacggtcctgctggaatcctgctggctcatcgtcattcctgtgctcagctgttgtcacttcatcaccaggttgccattttctgaatataaatggtcagcgtttcatggcaaatgcagctggtcctggcccccattggaggctgacagagcttctgttggctgcccagggcagtatttagagttggtctgtgggaaatgccgtggaattccgtggcacacctgtgctggctgtgtgtgtgagtgggaccactagtccagctgttgtggtcacaagtcagtttctttatgaggcagatcaacctagaagaactcagtctgtgggctgcagctctgccgctactaagccccttaaacacacgcacacacgtgccctacacacacacacacacacacacacacttgcgctctctctctctctctctctgaagccatgacctagtacctagtcaggaggtggccgggtgggcctctctgccctctgtgtgtggcgtccggtaaggggaggccgactgtcctctgtgccctctgtgtgtggtgcctggtaaggggaggccgactgtcctctatgccctctgtgtgtggtgcctggtaaggggaggccaactgtcctctggatccctcctttgcccacctgagccaagtgtgtggggttctcagccagcatgttacctggtgttctgagttatttcatttttctttccttttctgttcagcctccaaacctcagatctgtccccaaagccctaaattaaattagtgttcagctcaacagatgtccaccaaatccccacatcccatgatagcagctgccattgctggcagccacatggtcatcccatttgctcctcagtcaccttgcctgtgggcgccgtcacctcctctgcctgacagacactgagcccacggctcagggagggcaacctgcctgcccaaggtcacccagccggcagtggcggaggtgatggggactcactcccagccaggctatggcagtgactctcacactctagacggggacagagggactcaagcccctccaggcatgggcgatggggcagggggattcgcaccaggcctcattccagactctgctcctgaaccacactgtggtaggggcccactcacaggtgggtgtggttaattcagaagctgaggctgccccctccaaggaagccctcgatattgacacacggatgatcctattctgttttgtgttttcacttccttgccgtcctgggctagggacctggcccaaccgtcctctaccctgtgagggctgggcttgctgggcctttatggaggccccttgccatgggagagagaccaggagagcctggtggtggcttagccaacctgcaccttctatttccaataacaacataaaaccaccttgcagaactgtgagagccaagccacctgaagcccagaggtgccctgccctgcctggcacccggagcggcatcttatttgcctgggggagaaaatccgctgcctaggattctttcccttgccaaacagctattttcccggtatttcacctgcactctttcttcagaatcggacctccatgtgacttagggcctccgttgttcatttgaaaatggggatgctgattgaaaaatggagatgcacctgggcgcagtagctcacacctgtaatcccagcactttgggagaccaaggcaggtggatcacttgaagtcaggagtttgagaccagcctggtcaacatggtgaaaccccgactccactaacaatacaaaaattagctgggcatggtgacgggctcctgtaatcccagctacttaggaggctgacacaggagaatcgcttgaacccgggaggcagaggttgcagtgagccaaggttgcaccactgcactccagcctgggtgacagagagagactctttctcaaaaagaaaaagaaagacggggatgctgatgcccccagcacaggttgagccgaacagatgccccaggtgtttgaaaggacaggcgaaagtgcagcgagcgtgaacctggcccctcctcccctcacctgtcctacctcatttagcagcatcttcttatagcttctgtgggaaaagtcatggtaataaaaacataatgctttaatcaataacacccatgtctctgttttagctttttattctgggaatgctcagatatacacaaaagcagagtgtagagcatcccaagcccctgggtattcgtctcccagcaccagcaatgggcaacacctgcccgttcctgcctcacctctttcccactgcggtatttcgaagcagatcccagatattgtatctaaaagataacttcctaccttgaacacccacaatagcgctatcacatcctcccaaacacacttataagtccttagtatcgtcgaatacccaatcactgttcacatctcgccaggtgctcatctttttctctagttggtagagtccagatgcccacaagatgcgtgcctctcattaggtggatgtgtttcttgaagaatggggtccccatggggggcgctaggtaggagctgagcagcagggggccctggctggcctctgctcggggcccccactaattctgctctttccagcttcacctgctggatgctgtgggcatttgattcccaccctaaacgtgactgtacaagtctggttttcgcttgtgggatggagtctggttttctgcctctctctgggtttattaggaatcattctgtgtccttggctgggtgcagtggctcacacctgtaatcccagcactttgggaggccgaggcaggcagataacctgaggtcaggagtttgggaccagcctggacaacatggcaaaaccctgtctctactaaaaatacaaaaattagttgggtgtggtggtacacatctgtaatcccagctactaggaggcggaggcaggagaatagcttgaacctgggaggcagaggttgcagggagctgagattgtgccactgcactccaatcttggtgacagagcgagactccgcgtcaaaaaaaaaaatcattctgtgtcctagggtgaatgtacataactttctaaaatttctaataggtattaagttggttaatatcactttgctgcttttgtaagtcaaatattgttgactattggcaatttcatgtagttcaacctaagtaaaggtacattttaaatttttaagtgaaataagagtcaggagcggtggcctactttactcctgtaatccccacactttgggaggctgaagcaggaggatcacttgagctcaggagtttgataccagcctgggcaatatagcaagaccccatctctgcaagaaaataaaaaataaattaaaaagttatggccaggtgcggtggctcatgcctgtaatcccagcattttgggaggctgaagtgggcggatcatgaggtcaggagttcaagaccagtctggacaacatagtgaaaccccgtctctactaaaaatacaaaaaattagctgggcatagtggcacgtgcctgtagttccagctactcgggaggctgaggcaggagaattgcttgaacctgggaggcagaggttgcggtgagcggagatcgcgccagtgcactccagcctgggcgacagtgcgagactccgtctcaaaaaaaaaaaaaattaaaaattgaaataattgtaatatatgtgttgtaccagggatgagaactgggggtgggggaccagcatgtgcacagtggtggtccatcaaataagagagactgagtaaaagcggacatctgcagcccgagtattctccagtattctttcagtgagtctttgtttgtttgtttgatataacagctgtactgacgatgatccacataccacacatttcacctatttaaagtgtactggcctggctcagtagcacgactgtaatcccagcactttgggaggtgaggtgggcagatcgtttcagtccaggagttcgaggccagcctgggcaacatagcaagaccccatctacaacaatattagccaggtgtggtaacatgtgcctgtcatcccagctactttggaggctgaagtaggaggatcacctgagcctggggaggttgaggctgcgatgagctgagatcacatcactgtactccagcctgggtgacaaagtgagaccctgtctcaaaaacaaaaataaagtgtacaagttgttgattttttttttttgtatttgcacagagttgtgcaactactattgccgtcaatttgagaccattgtcattactcctacaaagagaccctgtacccattagtggtcattcccatatccccctaatcccttatccctagggaacccctaatctaccctctgtccccatggacttgcctcttctgggtttttcctgtcaatggcagcatacagtgtgtggtctttggtgtctggctccttttgcttgcatagcgttttcaagcttcattcctagtgcagcgtctattgttccgttgtatggacaggccacattttttttctccattcatcatgtatggacctttgagttgtttccactttttggctgctatgcgtacatgctgctgtgaaagctctgtacaagtttctgttgaacatgtatttcttctgggtatctgcctaggagtggaattgctaggttatacggtccctctgtgtttatcctcttgcgaaacttcaaactgtttccaaagtacctgcacctttggctcccactggcagtggaggagggttccagtttcccccacatcctcgccagcacgtgctgttctgtgacttcaggattgcagccatcccagttgatattgtaacaaaacttgcccagcagggtgagatatctgtagaggacaggaaaagggctgttttgttagtggcttggcatatcagccatggtcgtttttttcaaaatctcctgaggaagccccatgtagcgcgtgagccacagcacgtgcggccgagcaccctgcacccctgctggctgcggcccttgctggtggctagtgggaggggagggctcgagttgtaacttgtttccagggtgtgaaataatctcctctgcctccgtgtctcatctgccgcatgtccctttctccgcaggtgtgaccatgaagctcatggatgaggtcgccgggatcgtggctgcacgccactgcaagaccaacatcgtcacagcttccgtggacgccattaattttcatgacaagatcagaaaaggtaaccactcttctggcaaagacgagggaggcagtggccctcggctgcttgggtccctgcaccagtttgttttctgttcacacccagggtcatgtgggccttggtgtgtgcccatctgccacagggaacaggaagctgaggtttctttctttgtccttgctgtttattgacttgatgtttcaatctggtaaaatccttgactcagatatgacggggccattatcctcctaaagacctgcctaaactcaccctctgaaaacgctccacagacagagctctgggaaggtcctgtgcctgcagctgccacgaccctggacaccaaacctcatggcagcacatttcattttgggagcggaattaatgattcatgatttaggcagtggcagggtcagtacagaaaagcccgcaggagcccctcctcggccagccctgcccacgccacccagggcagcactggcattgggtggtttttctccaccacaaaaatccaaccccagccacctggcccctgcctggaaatggtgtcagctgtccctggggtatgtgtgccagcttgacaggccaggcctctgcagtttgtatgagcagaggtcaccatgcttgtcttatgtgactgctctctgcagaagtacagtgaagtgcacctgacacgtggtgatttttgtcagtgtgacgtctgctgagatgaggccgtgcaccccctgcagcagcactgcctcacagaccgagggtggtgtcagcatcgtcagggcctggtgctgattctgaggacaccacctcattaaagcggcttgttggaggagctgttggctgagaccagccccttgtcgtgggaagcgagagtggaagaagtgcaagcttggctctccttgccacagctcctgcccaccagagcctgagcaggggcagactcccaggccccgggtagcccagccttggtgctgtctccggcagctgctactgcagaacacacctggcaatgggagaccctggactagggcagaagcacctaagattggaatggtggagggctgcctccctccctggaattactgagagaaggctaggctcacacatgctggattttggatgctttgtggtaaggagaaggaaggtctctggcgttgctttcttccactttgcagaatccttttcttttttccacaacacgatcttattctgtcacccaggccggagtacagtggtgcaatccctgctcactgtagccttgcacttccgtgctcaagtgatcctctcacctcagcctcccaggtagccaggactacagacatgcaccaccacaaccagctaatttttgtattttgtattttttgtagagacagcggctcactcagaatcttttcttgaccaatagatgtttgccacaaacatagaccacaatgtcattttagaatctgcccaaaacaagtgggtcctctgtgttttagctcgtcccccacaggcctgtgtggtgcgtgactctgcaggagaatctgtggcatcatattccatgctattttttctaggactcctgcctgggtaaatcacgattagggtgaccttgtgaaagacggatgcacagcccatagtgggaaacgtgcattccataggacttgccgtgctcagttgtccctgagtgtccttggagaaccatcaggaaagaaatagactttctggctgagcgctgtggctcacgcctgtaatgccagcactttgggaggccgaggcgggcggatcatgaggtcaggagagcgagatcatcctggttaacatggtgaaaacctgtctctactaaaaatacaaaaaattagccaggcgtggtggcgggtgcctgtagtcccagctactcgggaggctgaggtaggagaatggcgtgaacctgggaggtggagcttgcagtgagccgagatcgcgccactgcactccaggctgggcgacagagtgagactccgtctcaaaaaaaaaaaaaaaaaagaaaaagaaatagactttccagcgaagcacaaaacacaaaaattagccaggctggtggcaggcacctgtaaacccagctacttgggaggatgaggcatgagaatcgcttgaagccaggaggtggaggttgcagcgagccaagattataccaccacactccagcctgggcaacagagcaagaatctgtcgcaaaaaaaaaaaaacacaaaaaaacaaaaaaaaaacaaagtccccacccttaactccttgtacaaccagaattaacttttaagggagagtgctaggaggtgtgttgtggttcttggtcaataggaatcattaattttgagggaaaaccaggaactgcagtctgggtcgaatgctttttccaggaattaacttagcaacctagaagacatctggggcaactcggacgaggagctgctttgccaaaggctttccacaaggctaacggggggacttaattttcagaagccacaatttctggcaggacattcacttggattggcttccttcacgcagtgagggcaggttgggtgggctcgcctgattcccgctgtcccaagccacacccagggcctgacagtgggccgcccaggcccccacctcgtctcggctgtggccggggcctcctgggtaaaacactgggccccttaccagaaacagaaagactgttgttttcttagatgacatcttgttttgtgtatagaggaatttggaccaaactgaaatagcagccatggagtctggcctgtttctatgccagtatcctccagggcccactagactctgtcacatccaggggccgttgaatgctgtcacactcgtgtgttgttttccagaggattgtcacacctgccaggtcctttgcagggaggcgagggctgtgctggccgagtggggccagggttgtcagagcagggtcatcatgcttgctcctaggatactgcaccttagatcagctcgctgcctcccacgcttgccccttggtagggaaacagagcgaggctgtgcggggaggcacggcccctgctggctctgggttctgggtgacactgggtgggtgtgtgagaaaccgcggggggctggcctcacagttccagcgtgactttctcatggactctgctggggccgctgtacaccctcgagccccacacctgcctctcacttcgaccataccatgaaggaggtctcgagggccagaccctgctgccctgccgggtgggggcacacattattgtggactatcccagtcggtgtcaagagcccagggagctactggcaggcacagaaacctcacctcgggttgcacgtggtgcctggcagagctttgtactgtagagaatgggcattgctttctggtgggctcagaacaacagacatctgttcgcccccagttctagaggccagaattctgaaatcaaggcgtcagcagggccaaggtccctctgaagtcaggggaggatccgtccctgccccttccagcttctgggagcagcagctgttccttgacgtttcttggcttgtggctgcgtcactctggtctgtctctgtggtcacaaggcctcttcctctgtgtgtctctcctcttctgtctcttataaggacacttgtcataggatttaggacacacctggagaatccggggtgatctcatctcaagaccttttgcttaattatacctgctaagacctttattccaataaggccccactctgaagttgtgagtagatgtatcatttgggaacccactagaaatgctttgtctccttaaagctcaactcatgtagatactagctcacttccacttttataaaatcatgaacttgataaaatcccctctgggattcaccagccccaagctgcctctgtctctgtggatgtgggacctgcccttgtgagagccagcagtgaaattgacgtcagcctggagaaggggccactctaaggaatgcagggagagtgaccccagcagtcccccaggggccccccacttttgagaagagcagtcatacagctggcaaggggctagctccggaccctgacttcagagagcagcctcactagagccaaatgagagtctctacagttagcaggcctaggggctactgatgaaggaccagggcctttcctctaaatggcagggagtcagggtcagtgtcagaagtgagaacggatgtgacgtctcctccataagccccagaaggcagcggttttgtaataacaagaaatagtcgcatagaccgagggttgcagttctttgtgttggggtgttgtattagtattaaccttaagtcaagtataaatttaatccacataaggattacttttaaaatcatacgtttatggaaaaggtgcctgcaggtagactgggcacatccaggcggttggagcctgagggcacagcagggccatggcagccggtcacagcccgtgcccctcatgtgagcagccctgagaggccactggtccccctgggaggaaaccccctacctcccacaggctgatctgccacagtggggaaaagcccaggagttgagacccgttgccagtcatgtggcctccatgagtttcctggggctgctgtaacatttccatacacagtagcttaaaatagcctgcactcactctcctgtaattttggaggtcagaagtctaaggcaggtctgcaggctgcatcctaccaggagctggagggaagaatccatgtctcgcctttcccagcgtctgaggccacccacattcctcggctcatggtcccggccatcctccagcctctcctaacagcatcccattccccccctcgtgctgacactcctgcctccctctcacaggacccctgtgattctatcaggcccacccgggtaccccagaacaatcttcccatctccagggctgtcacttagtcaatgtctgcagagtcccctttgccacgtgaggtcacaggttcagtggatttgggtgtgggcatcttttgggagcacattattctgtcttagcaggtggaagggggttttctgatgtgcccatttcagcatattttattagaaaaatagctgggcctgggcacgatggctcaagcctgtagttttggctacttaggatgctaaagtaggaggattgcttaagccaggggttcgagaccagcctgggcaacacagtgagacccctgtttctttaaaaacaaaacaaaacaaaacacacacaaaaaaagcaggctggtcacagtggctcacgcttgtaattccaacactttgtgaggctgaggcaggaagatcacttgagccctggagtttgagaccagcctgggcaacatggtgaggccccatctctacaaaaatttaaaaattatctgggctactcaggaagctaagggaggaggatcacatgagcccaggaggcagaggctgcagtgtgagccgtgattgtgccgccgcactcagcctgggtgacagagtgagaccttgtctcaatttaaaaaacaaaaacaggctgggcgtggtggctcactcctgtaatcccagcactttgggaggccgaggcagtctgatcacctgaggtcaggagttcgagaccagcctggccaacatggtgaaaccccgtctctactaaaaatacaaaaattagccgggcgtgggggcaggcgcctgtaatcccagctactcggggggctgaggtaggagaatcgcttgaacctgagaggcagatgttgcagtgagccgagatcgtgtcactgcactccagccggggcgacagagcgagactccgtctcaaaaaaaaataaaataaaataaccagaaaacagtgggaatgcggaatggagacgccagacctgtggggtggcttctccagatttaaggcaggaagtgctttgctttctctccttcagcctcccgtaaaactgcctccttgggagagtgaccttttatgcgatattgaccaagtgccaggccctgtggctgtggcttgccctcgcttgggtggggtgtctgtcaggaagttacacggacagctttgcttcatccagacattggcccaggggttcagaagataactttgagtttcagccacgaagggtgtgtgcctaggaggaacttacgaacttggggcacttgtcgtggctgggagaggcctcacccgcggccatggaggccactgccaccctgccgtgggcccagctctgttggctgcaaatttggcatttatgaaccagactcttccaggatgccccacacttgcctagaccacagagggccacctctgttaccctcacccctcaccagcccaacccagtgccacctccattgtcacagccttttgacgctagggacctgctattcctctgctcacagcctccgtggctccccgtgacatgccacattcagcttgagcccctccagctggcacttcaggtctgctaggacaggctgccacttgtcatagctgtccccttacacctttgcgccaactagcccggccaagcacctacggggtccttagcaggtgtgtggcaagttaaactctcaccaggcagttggggtgaaggaaggaccgcttcatctgtgcgactggatctcatgggaaatgggaagtgcccacccaccaaaggcgcgtggagttcccaggccagcaacggagttggtgctggggacgcgagggccacgacaggctggagcccgcacccaggggaccagcacaggggaaggcacgtggagcccggtagcacccacagagtgggagagcctccgccccccaggcaagcagtggagcccctaatgggagctgtggggtcacttgctgtgtggatttttttttttcagttgagacattaaaatgtccagaggtagctggtgtgaaaaagttatatcgttgccttcagtgtaatagttttggaagcacttggtgagaaaacctaaagttgacgttttcttggggagaaacgatctccactattagggtgaaaaataaggagtcttctagaaaaggccttggggtgtgttatgtaagaaatactaagtcagttcactgtttccaggcttttcttacgaaagttaacagccacagctctttttggagcataaatgctgagcttttcctaaactctgaaacacttggcaacctctcagtcttgctaacagctattttttttttattttgttttcttttccaaatccctggcatactgctgaaatctggctgctgccgcccctggagagacgcccgtctgctgggggagtcaggctggggtacctgccagcgctcacgggctgtgccactccaggcaggctcaacaactacttcaaaacagaaagcggctgtaattcacaattcagcccactacaggcaccgatacgtttaactgtacctaatatgacacacttgatgccaggcattgtgccacctgcttcataccatttacttctcacacagcccagtgagacagggactgtcgctatctctgtttgtttttcccatttggaagctgcaattccgaggggttaaggaagctgttcacagccatggagctggttccaggtgggactgggagggcaggcccagcagctggtctctgggaccagagctctgagcccatgctttggtgtccccagcgacctggcctaaaccccacctggcatccgccccgtcagggcctcgagtgtgagtgatgaagcttgaccctcattgattacatgcggctacagccacctttgaggcctgccctggactgcggagtgactgcacctggtccccgtgcacttgtgccggaactcctggctctcaggcagcttgaaaatgcatcgttaagctgggcgcggtggctcatgcctgttatcccagcactttgggaggccgaggcaggcagatcacgaggtcaggagatcgagaccatcctggctaacatgctgaaaccccatctctactaaaaatacaaaaaattagcttcttgttactttgtggtatgattccttttaccccctgcaagcctctccagcggtgcccctggggcacactcaggccccaccccaaattactgtcctgggcctgtcatgtgacataatgaatgcgggcagttgacatcagtatagcctcagagcaaggatagaaccacatgggttgactgtgtctcctttaaaaatgtggaggaagttacccccaaaatgcccaggtggcctgtggagcccctgatgaaggagagccactgtgagtgggtcgtggctgggtctgctgctcccctgcattctctgaagctgggtgcatggggaaagcatttgcagatgaggaaactgaggcacagtgcagtctcctggcttgtccctgctcagtggccaagcctggatttaaatccaggcccatctgactccaaagccatggaactcagggctcctcccgcatggcttcgtagcctccggagactggccttgacaggtatttgctccagggcctcgaagagccctgcctttcctgatgagacactttgtcatgaatatctggcttcatcagggccctggctgctgtacctgctacagaggctcagagaggaccaggcgctccccttctggccgccttccccagaactaaacaagcatccacacctctcctaggtgggcactgatccgcccgctcagtgggagatgctgttcttggttaatccatttttcacctcaagctggtcccacccatcttttaaataaaccccagccaccttgactgcaggtgcatttggacgggtgatgtggtggagccatcccaaggcagcacctccgctcgtgggctgattgtcaggaccaagaggtctttttgaccccacagagccctccgagtcttggctgccttgttatggcaggtactggcactgcttggggttgtgtttgctttggtttctgagacaggtgcgtggaagtggatttgaggctctctccccttcctcggatgggccccgcaatgtcccaactttgcctagtgccaggttcgccacaggatacagacagacactactggtatacaaggcaggtgcggaccccccttcctgcccttctcatgcctggcgggagggctgaatcaaggcagactttgtgggaaggaggcctgagctcccctcattgctgggagaccctgaagcatcctgacctccgtgtgacacgccaggtctgcaggcagtgcttgtcgggccctgcctctgcctttcctgtcaggttcagggctcccgagagccacctggacacgctgtcttcagctctctgatgcatgaccagcctcacccgcctccacatttggtggagggacctgtgggcatggtcatgatttggccggcagcctggatggtccaggctctgacccagtgggaggaatgacagcacatggctgcgccatggaggaattagcaggaagggcggaatcagtctgtgctgccccgtgggcaggtgacggccagcacgtgactgcccccaggctctccacccttttgcagggaggaagggaggtggacaggtgtggggctccagggcaggctgcttccaggagtggcactgaagttgagactggaaggaagtaccggccagcagggcttggaaggggctgctggccatgctcctgggcactcctgattctgggctgctcagcatccacttcaggaggatgcaaacctggggctctaatggggctctggccagcttgagtctgtggtgacctggtgtccacatgtgacccacaccccagccctcgtgggtccccagaggggtccagcctgtcaactggatacctgctttgggccccctgggcccagccctgccctcgtgggacttccaggctagatggggacagacagacaacagtgaaatagacaagccaacaagtgtgccaatgcaaatggggtcgttggctctgcaggagtggaggacagttctagagggggtgtggtggagggggctgagccgccctgggcagctctctggagaagggatgcttgagccgaggttcagaagatgaaccagatagctgtaagaggagggcttttctagggagagaccacgggggccaggagcttcagggagctcacagaaggccactctggtggggtgtggaaagcagggggcaggctaggggcccttgtagaggctgaggccagtcgctcatcaccccaaccccacctggatggacctccgtccccagggaggcctcgatgctgcaggggggcctctatgtgacctggaggaggcggagaggatttggtgtgcgcctcagccgccatcctggggttgacaaagtgcctgtagctggaatgctggaattctttttttttttttttttttttttgagatggagtttcgctcttgttgcccaggctggagtgcaatggcatgatctcagctcactgcaacctgcgcctcccgggttcaggcgattctgttgcctcagcctcccaagtagctgggattacaggcatgtgccaccatgcccggctaattttgtatttttaatagagacagggtttcaccatgttggtcaggctggtctcaaattcctgacctcaagtgatgagcccgcctcggcctcccagagtgctgggattacaggtatgagccactgcgcccggtctgtagctggaattcttcaggaagggctagagcaggaacagagccctgggggtgggagctggtccccccgaggtcccctgggacagtcccttcccagaggctgcctgtgagaccttggtgtcatgtgtgggatgtgccttctgagcccagggtctaggagatgggataccctaaaccagggcccctggaaactgggctctctcttggtgactgggacttgtgattcgtctgtcaaccctaggtttcaaattaagtcccagccagtgaccacatcagatttccagtttttttctttttttctgagacagggtcttgctctgtcacccaggctagagtgcagtggtgcgatctcagctgactgcaacctcgacctcctgggctcaaacgatgctcccgcctgagcctcccgagtagctgggaccacaggcgtgtgccactatatccagttaggtttccagttttaaagtatttcactttgtcctgctagccaaccttatagcctgtgtcttgtttagaataatgatgttgctctctgaagggtgaaaattctcagattttggttgtaattgaaaattttcctgacatttatgaagtgttaattgtattatggaccacaagaggctctcccagacagcattctcttctttttgttgttacgtctaatgcttttataatcaacctacttagttgtttaaagtcattgttgattgctgttaggagtttcttcagatttctaacacagcaattaagccatgagcagccaggatctggccgtggcagcagtggccaaggtgggccttcatgggcaacaccaagagcatgtttttggagcctgggcggagtggctcacacctaattataatcccagcaatttgggaggccgaggcagttggatcacttgaggccaggagttctagaccagcctggtcaacaagacaaaacctcatctctacaaaagatacaaaaatcagccgtgcatggtggtgcacgcctgtaatcccagctatttaagtgacaggtgtgacagtcgcttaaacctgggagacagaggttgcagtgagccatgatggcaccactgccctccagcctgggcaatagagcgagactccatctcaaaaacaaaaacacgttttctgttgctcctcaaaactaagagccagtgttcaaagacccctggaacctgccctcctccaggcaccacgctcatgggtggcccccgtgtgtgacaccgtggccacagggaagttcttgttggtttctgctcatggaaagggcttgttcctgctttttggcctgtgactcccaagtgttatacacaattgttggtgagggatgtgggctgggcattgtgaggaaggaggcagagatgctgggagaccctcaggtctgacctgttgaaacttctagctccttagctggggcctgacccatggcctgccctcctcccggggtgcgtcttgtgactgcgggcgctttgcatgggactctgtaccttacagctcacgtaatgcctgctggcgctgaccacacagctccttcctcctctcccagcactggcacgaagtgctccctgtaagtatgaagttgaatgtagcatggatcgttctgatactttttaacatggaataaccgctcttgcctctggcctgctaaccgccctccaacagccaccacctggccgctttctcactctgggtctctaaacctgccttgtgaggctggtctcggtgcagctaggacactgggggttccagaggccacattaaaaagtccccgaagccagatatatttcctggggagcaagtcccagcagccagagtcgggcagggatatccttgagcctggcccagaatagaggccacgctgggccgcctgggagggcattctgaccgcagggcagcacttgccccggaagtccccgggggtttctgcagcctggtggccagtgacatcgatggtgacaccttcccggggccccaggtcagctcttggcttgagtccttccatcccgtagctatcccccaggcagggtgtctcatgcctgcctatagggaagagctgagctccctgagattaagggattatgttgaggccaggtaggaggatggagcccaggccggggagggtggtgggggcagaagagcagctctgggtcaggaagcttctgccaggatggactgtcgtgccctggggagcgtggggcgtacagagaggttggttagggttgagggggagagagggacatgggaacaatgtatgggaactggtgactttggactttgtcatgattcacagagaaatggggctggtgctttgagcatggaggactctggccaaggggtgtggcatccagcagcccagaggaggaagctttggtcccgtgggcgagaccagtggggccagaagggaggcttggcatgcagtcacataagattcaatcccaccaaggggcacgggcagctgccctgtgtcactggagcccctgagggtgggaatggctgtggaaggtgatacaaggttctgtcttggtgcttggagcagtgtagtggggcagctgtggctccggtgggcaccagcaaggccaatgaatggacagtgcagtttgcagatttggccctgacctaaggaagggcagagccagccgacacccacagctcctggaaggcagtctgcggcctcccccgtgggggcacagtggctctgaagcctttcagcaggtgctgccactcccggccaggagagagcccgcctgggcgggggcttgaactcatggccaccaaaatccttcagtgctgaattttagcgtagataaacctgctcactagaaagataaacattcatgggcaactaacgacacattctaatattctgttatttgaacatctggtagtcagccaagccactgcttcccctaaccaagtgtctgcctgctgaccacagaaacgccagtgtcccccgcccagccgtggggtggaggccgccctgacccccgccctcccttctccacaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtggtgagtgcgcatccttggaacggcggcccctccctgccaggcagccctagggtccctgtgtttgggcctccagggggaatctgtgcctgcatgagtcctgtcctgtcagtaggggtcagagtagggctgggcctggccactgccgtgaccggtgacctcgggctgcggggctgatccggtgaggccttgagaaggaacgcttcataaccagcgggtaggcctttgggctgtactcccagggcccgtggggtggggctgggcagacaggacaagagagacagacccctttaagagcgccttagcatggctgctgcctgggcgtccaggtcgcctctgagtgtggcgccttggtgttccctggcattgtgtaagaatgctggagggggatgaggaccgtgccctgggtcccccatcctctgctgaagggcctgctgggaagctggaggggtgggctccctccaggtggtcctggcctgcaggtcctgcctgatgagaccaagccaggctggtgggctctgggctgagggtcccagccccttggcctttctcctcctcatgcagggcaggtggggtgggcgtgtgcaggccacacgcactcgttcacaggggctgctgcccccaggtgtccacatcccctgagctctgccacgtttgagagctggtggttctccgcctggcatggactctgtagggtcacagacatcgacagggttcgcgcggcccaaagaggcagcttccctgtctctgtcataagaacagaggttccccatcctggctgaccccaggggctctgcagcctttggggtggtcctgatttctctttgaaccagctcttgtgtctgtcactgaggggagcaagaggaaagcagagctgtaggagcttcctgcccctccggggagcgaggatgcgggaacagagcagctgggagcaggcgggtgcccgcaggcctcttgggagctggcgttctcatggaagtggccaggcaggcaccacggccctgcgaggctgacccctgattccagaggttctcgaggcccctgcccccgcggcgtctgctccccacgcagatccgcaagcatttgctgctcagcctcccggagaggagcgtgcactgaaatctctggggcgaacatgcactgaaaacccattcctctcagagcctggagcacggcctgtcgcttccccacatggctgaggagggccgccgagtcgccccagctgctttgtttcccagtcgaggctgaggcccctccaagcccctctcccagccctgccccttcctggagtggaggagctcatgcctcaccagggcccgtggtggtagcgccaggtgtggtgtgtgagctgtcaggcccagcgagtaccctccgctgccaactccaggccagctcttcgctggagttgggtgccggcctctcccaggtcgggtgggctgagtagaggagctgatggtgaacctggacttgatggatgaggaggactcggccaggctgaaaggaaggaaagtgagtggtgggtgcccccagcacggcactaacacaatgcctgtgacccacccttgcatgactctcgtgaccaggcccctctttgacttggggcttacgaggcatgctccccttctggtgcgaggactgctccatgccttcagccccacagcctcttctgtggcaaagtaccctaggctgccaccctcctgccccatcagggctggctctgctgcctgctccttcctccctcatctgcccccacccctccccatttacttgtaagcctacccgccttgccctggcccaccgtgccacccatcggcccttggcaggatggtgtcctccctccacgtcgcctgggctggtccgcagtcgttcctcagcccctgaccctgctatgaggctccagcctcctctgtccttgaccttcagccctgtgtctggttctcctttcaccttggacacgccttctccaaacttgcctgcttttctcggccatgaagtatgggctccactcccacctgggcccgctctggtctctccccatggacccgacgcccctcccatgacgcttttcagcgtggctgctgtctgtcctgatgctgaatcccccacctgacccaggcacatttccgaagctctctccttccccgccccctacctcttcctgcctcctggacaaactttcccagttctgtcttccctctgcgggcagcatggacagacgcaaggacacgccctgtctgctgtccgctccctgtctgtagcacagctgaccaggccctcagtgaagcctgcgctccctggatgggggaccctgtagtgtctgtagggatactccagcctccccggccaccacacggtccccgaacccttggctttgacatgtcctaacctgtggcccttctctcctggggtggtcagatccatggtctgtgcctcgagcatcgcctgtgtgttgtattgactcccaaattgacttggccagtgctgcccctcaacagggttcccaaaagcatcacaaatacagtttgtcctgaatggaactcattatcacacccgcaaaaaaatccctctccgcctctgtgctgctctggaagtctgggaacccagctggctcctccctactccccccatgcccacgcccacccagtgccgctccactcctctcccgaacagctcttactgccccgtccccatggggcccctgctcagtcctcagctgctccttcctctgttcctggtgctctcaatgtgacccttccctgcagcccaggaaactggtcatcaaaatccgagttgctccctctcccaccgaaatgcacggtggctcctccatgccctgggtgtgggtgcagcaagctcactcctgcccggcgcctgtgcacctgctgctcccatctggaccaccctccccagagcctcctggagctacagcacttctcagacgttttttccttagaagggcacccacaaccgctctagagaagcgtcgcctccgccaccccagaccccctcccaaccaccccccgccactgcagacgctgcgtggactgtcaggctcacatatccaggagcaggcgcctggctgcccgggtcagccagagctctaaacttactagctgtgtggccttaggcacgcactttctatgtgcctcggtttcctcatctgtacggtggtgatggacacggtgcccaccatgtggggtgggtgaagatggggggccttcatcatctgctgctgttcacctgctctccctggggcctcacaccctctcagagggaggagtaaacaaacagtgaagatagaggaagttgaatggtgtccagggtcacgaagaagacagcagggaatgaggggatcggagtgtgccgggggacaggtacaattttaaatatgttccttcccaaggaaagcctcagcggaggcctggagtcagggaggaagggcaggagctgtcttgtggggaccattcaggtgaagggaacggcgagggccaaaggcgcagagccactgtctgtaacgggggagcttggggacagtgacacacccgaggccacccggctaggacggggcagggctggggagagagggctggtgggagtctatggggctcacgcatatgggcgtaaagtagaggaggatctgggtgacctgtgctttgaacaggcttcagtgcaggttgatggggtgccctggggcatctcccaatagcagcccttcaaagctgatagtggggggcatcctcccaggttggcagcggctgcaggcgtggttggtgtttgcccaccaatgacggttccctctcccggctgcccccagctgggctgtgcacactggttgtggggtcaggaccactgcacctaccccagcactcagctggttcagggagaccagtgcagtgaccacgaggggccagcgatccatgggctctcagggaggggacctctgtgcctcacgttccccactccctatagagtccaacctgagggggtccacccttgtgtggatagcagcctgcggtcacggaggcttttggggccgcgcctgtgaccttcccagagccagctggggagcagtcctggggccgccccttccagaactccataccctgggggggggtggtcagagtgcaggaggagggccagccctgggggaaggggctgcagaggggcagggaagggcgccagcttgaatggagggaatggcagcccatcccctgggtgtggccgcgtcatgttgatctacgctgttatttctcactcattaaagatggtctttgattcttcactgaggtgtcctggggcccatggatgtcaatgttgatgttgatagaaatagccactggcggggcaggctgcccggagagggattttcagctctcacttggggactgcccacatgagcacgagttctgggctgggagcacgtgtgtgctccgtgcggtgaacctgcatgtgcgttccgtccctccagatgtgccctggcggcccctcctcctactcccagtcgcctccctcatccccacgtcagctttcttcagcctcctgtctatttttagctcccttccccagggcctggctgacacggatgcagcctctctgcttggagttgcgtctccatgaatattttatgctgggggctgccgcacccgctccgggcagctgccagcacttcccggtctcggtctcgtattagaagaggccaactcagcgcgtagaggcaggcctccccgtggcagtgccctctgaccttgggccgaagggggctggagaagtggcttgtggggagggacagcaggacgcaggcggcagcagacagatgtgggaaggcttttcagcctgcaggagggtcagagccgtgtgtctgctgaagcggaggacgtccctggcacctcaggtgggggctgtacttgcctctgattcttgcaggcgtgggcattgtagcctctacaggcccagggagttggggctgagaacttgtgggtcccagcctgggcctgaggaggaggtgtagacagggcggggtgaggggctcgctgaggcccctgaccagggagaagcctgtagcctgttccatggctgtcagggctgagtgagcgccgtgaccccactgcttcctgggcacactggggaggggatgtgtccccagattagccgaggctccaactgtgcaaccacattatgcagggcagggtctttgcaaagcaggcttccaaactggagggagcccatcccagagggtctctctggtgctcatgaacacacatctcccgaggtggccagcccaggactccgagcttcagtctttagccaccgaaatgttttctggatggaagtgggaggcagtaatgaaggcaggtgcggccatctttttttttttttttttttttttttgagacggagcctcactctgtcgcccaacctggagtgcaatggctggatctcggctcactgcaaccgctgcctcccgggttcaaacgattctcctgcctcagcctcccgagtagctgggattacaggcgcatgccaccattccttattaatttttgtatttttagtagaaatggggtttcaccatgttggccaggctggtctcgtgatccacctgcctcggcctcccaaagtgctaggattacaggcgtgagctaccgcgcctggcctagctgtggccatctttaccttgcctttcagagctgcctcatgcatagccaggggagttccaagaactcagggaaaacgcaccctgttgagctttgtccgctctgacgtgccccgacctagaagaggccctgagacccttgggctccttcaggttgagggagccctaccaggccgggggccattctcagcaggtttgttttctggttaggaagccagggcagctggatgcagaggctgctgcctgtctcctgggtgggcaagggactggaggggcaggggaggcttcctcttgggtggtgcctgggtacaggtcattgaagccggaggcttcagggaacgccaacccctctgcgagctggtgtgtctgctcacagatgcttcccatccccagacaggaggcgggcaccaggcagggagtcactcgccaggggtcgcacggccagcaggcccatctgtgacttcactgactgggaaagggggccgctcactgctgtcatcgatgccactgtgctttctcccagccaggccctactgtggggtcctgggaggagccctgcctgagaacccttctgtgcaagaacctaaaccctgggagtcccaacgcgctgcccacctgcactgcgccgcccacccacaccgcgctcagcccagggcctttgcttcagccccagatgatctcaggaccagtgctgggcaggtgactgaacctccacaggccactgtggagtgtgggggttggggcacattttagtggaaagttttccactccagtttgattcttttgcctctgctggggccttatgtgaggcgtggcctcagcacagacccacacaactttcagaaggctctggaacatggtgcccacctcgcttctgctgctgccctatgacctccttctcctggcctcagctggttcacctgcatgagtgcaggggccgggtaagccccgcgccagccgagaggacagcgtggcatgggctggagcgtccggaaggagggcactgtttgacctgctgttcagctggaggggcgggatgggccccagggcttaagtcagctgaaaggccctctgcagccttctggaagttgtctgccatgcagtgctgagggccacagctttgtgacgcactgatgtgggggctgcagacagagcaggctggagatgcctcttggctgtggctgtcttgagccgtcgccaggctgttaccccaagttccctctccgtgccttctcagtgatgctgtaattggaaggtccctcgcccctttgcacttaggaggaagcatggggcaagctttccatgatggtgcctgctgctccccacccccaggacctgcctgacccccaggcacggtgtgcagaggggcctggggtcctcgcatgggccccgttcctctcgaagaagcctcaggagcagaggtggccattcctgaccgtgtccaggccggaccaggacaagaagagaggtccggtcccaggatgtaggacagagaaagaggtccccacgtggggcctttgtcacggggcagggccctagggtctctgctgcctcgacatcctagacaccccgttgccacaggctcctgctggcagggaggggccgcacctactcccagagaatttcactagcaaaagagtgggcggaagcactgtgtggtggccgcgcgcagcctctgcactcgccctgggatgggcaccgctgcgcccgtgtgcgggctcttacactggcttcctttgtttgtttggccaagattggacttttggaataattttttaattgttgactaatttaggaaattcagctgttactggagtgcagaaggttgacggtgtgttcctggaagggcttggtgaaccgcctgccgcgtttggccattagtgagggaagccctgcccccctcctgcccccaccttgctgccagcccacaggcgtgagtcatggactggaatattcatgaggctcagaatccagtgtcgtgctctctgttccttttgcctgcatttagcgggagtcagtcttgtgatgggaaaatacctgcatcctgaagctgcccctgtcgcctcattggttagcgcttaggaacatccggtggccagtgagtcccatgtgcctagaacccgagcatgggtgctgagaaggaggttggcgcagatgagagcatgtagccctcccctccagcctggctctcgccttccctctgcctgagcccagactctttctccagccacctttcatgtttctgctctgcatatatctctgaaagatccactgtgtccagacagccacacactggcccttctgagcggcactggtaggtagctcttctgatgccactgtggcctaaccggctgcggggggttaaaaacccacctgggcacagtgagctgctcatgttctccccctggaggtttacagaaggctctgctcagagccaggcctggggggcatacaacagagtgtgggatggagccttggggcctctctgtccccactgctgtcagatttgtgacacggacagagtgagcactgccaggaggggggctgtaccaggagaggcccgtgggtgggatttccagaggattcagtgaaccgagggagcatcccggctagacccagggtgctgcggaaggtgagcgagagatctgtcagggaggcctggaaaggttgttgggcccatgtgaggtcctggccatgggacttggagtttttcagcagggcgagttcatgcctggagtatcctggggctggaggccgcccacttggctcggcgctctcagcaaggggtgtggagtgtcctggcaaaggctctttgcggccagacacacatcttgagccctgcaagcaaaggtgcaggaagaaacaggccctgtgccccacacggtggtagaaaggatgcagagccctccccacctgtgtgtgcaggatcagaagcaagtccccagcatggccacagagctggcccatctccagggggatggccaagcctaggtgtgctggacactctcatctcatctttgtcactgttgcaggctcctgttcagaccctccatggtctgagccccctggaattgattggggacagatgatgccagtgttcattgagcagaagtactggttttgaattgttaacataaagaccatccctatttagaattaagcctttttgatcttcatttgtttgatcattcattcattcattcattcatccatccagcaaacacctcctgtgcccctgctatgtccaggcatggtgctggcctccagcaggacaggaagggctccacagggcatagcacagagtgggcacacgcacagcagaggtgtgccatgagcacgcggcttctggcccaggcctagcccacagtgggcactcagcaggtgacagctatgatcattattggtgttgtagggtggggaccgccatgtccacactccggcacaagagctgtgagccgagcgtcccgggaccacggcactccgtgcctgcaggaggggctcctgagaggccaccacccaggcccaagtcccaatgccttttctcccctttgtggtgacgatctccctgcctccgccagcagcctcccgttggcctttacgcctcctttcttggccccacttgggggcagttctttcggagtctgagccggtgctgctgggtgaggggagcccctggtgagggtgtttatgactctccacaatgatctcattatttgagacttccggctgctttctgctggaggctggtgcagtcctgggtgggtgtggaggaggaggtaattaacccaggcctgcagctgctgggagaggccacagcggatggcggagaggccacagcggatggcggacaggctccgctaaggcaaggtcctcaggtggagcaagaccctgggggcacaggtgcttgtgaggctggtggtcctggtgctaagctcatcattgctggcttctccatgcacaaggcccctcgcccggccgtgctgagtgtcctcaataatgagatgttttcattgcttttgtgattatcccaagacccctcttgtctcctgttataacagggagagggcatgctacgtggcttcctaattaagaaggtctgtgtccctcaggcttacaggaagttgttatatcaccactggaaaccctttttacgccattcattaattacaaaaaggacaagctattgattttaccgagggtggaacttagtcactcgtcctccataccatgttccaaatgtgtgttctccaagcacagaaaatgcaaagtggaaaacatttggtttgcagcacttggctctgaaagccacaggcttcccctccagtggaagagagcccagaagacagcagtggcaggaagcactaagtggagggaggaaaaagatgcagaccccaggcccaggcagccactaggctgcaggggagccaggggcttggtgctgagtgccaggcggtgctccctgagcaccagggagggagcgtactgtcaacctgctaccttgggaccctccccacccctgcgtccccatgtgtgggtgtgacatcctaaagggcccgctgcgttaaggtgaccccgggccatctggccctcctttggggcagccacacaccagcaggacagtccttggagcagttcccaggctgcacttggcctcaggtatttctgaggacagcaggaccaccacacagacacacacacatgcaccagggaccgcagacacatgtgcacacacacgtaggagctcacgtgcaccggcaccataggaagcactttgccatgtcactttgttgagttcctgtttccaggtgaacaaacctggccctgggccacacagctgggcccgtgggactcagagtcctgctcctggccatgctgccccatcccttccatcaggcaggtgcccgggatacatgggggtcatgtgccctgagctgccctttgccacctcatcctttctctctggcatattcttggggagccccagaggctcggaggagcctgcctgaggccacaggtgggtgcccggcagctggcaccactggccagtgccccagaggctccagtccttcccccaccagcagcctcggggacttgagagagacatctgtcttcccgcagagcgttctttcgtcctccacccacccccaaccctccattaaaaacagcaacagccaacagcgtatgcatttatttactttgctgggtggagggagatggctgcgaggaggcagcagccgggccgtgggtggggccttgtgctggagacatctgtcttgctctgtcagcttctcacccagcgggacagggtggcccctttgtcacttgggtaggagaactatttagcaaagccatgacctggggaggctggctgcccaccagcagtgagcccgtaacctaccatgggacagacaccgccccgcggccctttgttccacctccccctgggtggtgagcctgggtcctcaggcacctgggacatccctgcccttgactgccatcttcataaaccttcaccctggaagggcgcccctgggcactcagggaggaaggccgcccgcaccttgggagggcagcgcttatgggcgggcactccacgcagtgacgttgaggctcctgggctggtctggactctgtctcagagcctggaacatccagcagatactaccatcccgggagacgggaagagcagtggggccctcacaggctctcaggctcccacacatccatccatcatcagacagcatttgctttgtctgagggcagagcctggctgatgagtttgctgcaaatattaaagagcagggccacatcagagccgccttggggcccgttgctgggcaccagattctccctcagcctggagccgaccctgagaatgacctgcacctgggctcgtgcccgcctcaggctgtgtattaactgacctcgagagaagcagtcacagccctcggcctgtggcattgggaatgctcgatggcctggtggccgctggggtgggagcagctgtagtggtttgggataatatggctgagggcagggcagggcccccgcctgggggaggccaagctcagcaagtgctcctaggctgtgccgagggccggggtgaggtgaggggaggcagggaagcccctgaccctggttcatcgtggacacgctgcaggtccatcgccttcctcacttcccatggacgagtcccacccctaaaagtccctcggcataggacgacctggagggcagcccccatgcccaggtttaaatggaggctctccccttacccgctgtgtcactttgggcaagttactcagcctgtctgtgcttcacttcctcattggtaaaagtggacaatcatttctgtgctgcttggtggggttgttgggaagaccctgatgtgcacagcctgccgcgccctaagcatgggttgcgcagggaatatccccttatcgctgtagtccctgccccacgtgcacagcccatgtgggggcaaaggggtgggagggctctcgtctgcagtgccttctgcagacccagagttgggtggtcctcccacgccctcggcggctggagggctgtggtcacatctctggtaaagatgccgagagctgtaggaagttactcctattccactcccaggtggtcatggaggccagatcgttaggggactcgagggctccgctccactgctgcgtgtggctggcagaggtgaggaccgggctgtatgaagccctggaggttttctcgctcttgggcggagatctccctgccgttcgggccgtgccgcgtgcgtggggcctggggcccatcacacacctatgaactggaccagaaggagcatggtcctgagttagctcttagcgcctcttggcggggagtggggaaaatcgcgcctgtgcacagcccagacggctccctcagctctgcccgcagcccaccgcttgtaaagccaagtccccgtctctttggggcctggagatcattggtgcctagggaagaaaggaggggctggttttcctagatctaggtctagttagttttttgcttttctagctttttaattatagaaaaggtcaaatatacgcaaaagtaaagagaagaaagaattcctgtgtagttattagctcagggccagtcttatgcgttgacagccctgactactcccccaccacagagagctctcaactgtggaggttttctcttttaacagctttactgagatgtaattacatgccgttctgttcacccacttccaggatacgattcagcaggttttcttctattcacagaggtggacatcccccgccacagtctatttcaaaaccttttatctcaccaaaaagaagcaccaccccttagccaccactggtcccccagccccaggcaaccgccaatccactttctgcctctgtgtatatgtctctcctggacatctcgtgtaaatgggtgataggcagaccctgtgaccggcttctttcactgtgttgtttttaatgcctggttgaacatgggctgcagggagaaatttggtccccgcaactctgctgtgaggtggacattggcccattttacaaaagaggagtcgatgtgagtcagtggtgaatcaggattcacacccggctccagggttgaagatgctgggctggtttccaggcggaatgaagagaccatcccaggaagggcacacagcatggttgggtcccaaggtgggcaagcctctgcctgaagcagcccatcccagaggcggggcagagcttggttccttatgaaagggatccctggccagctcagtttgagaaaggcgaaagttaaacagatttgagacgtttcagaaccttcatcccagtgtgcattgtttattgtaagaggccatttagtgcatagatccccaaacctgcctggtacagaccatcagagaggcatcatctcccagtggagttggggagggagcccagaggatctgcagacacagacaggcaggcaggcaggcaggcaggcatctcctgacctggcagcccttcctcagcccctctccagggccctggccttggacgggccattcccaccagccccccaggacacccatggtaacagctcctaagctggtggcgttggctccgcagagccatttgccacctctcttggcccctcctggtcctctggtacctgagagcatgtggctggggactcaggcacttggggaccaagtttctcgccagtctcccacatctgcacattcccaggaagttgcctctcctcaggccggacctggctcctgtgggctgggtgggggcttcagctgtgtcccttctcactccagctgcctttcctgggccaggctcgctctctcctgctttcaaggattctttttctttccaagctccttgccgtctttcctctctgtggagggcagatactccaccagctagagggaggacccgagccgaggggccaggctttcagactgggaggcgcctgagtgcgatccagcctgcccgtccccagctctcctgctcccaacccgatgtctcccagggctgccacagccactccaaagccagcagaacccagtaccaaccccaccaggtcctgttgccttgtcgcccagctctgggaccccatgcccaccctacagctcttgctctgcctgctacagggtcttcaaggtaggcaggaagccaggctgtgggcggccgctcctctgctgagcctcggccttgccgctgcaggcagacaagaagctgcagcttccctccacatcaccaagcaattccacaggggaaggggaggacaaggcccctatatcccatcctggtggctttgaccttgcattcttggccacttcagatgtgccccatttggggcagcggcagatggaaagggggcagggccctgctacacagatgtggtccgcgggccacagcgttgtgtcacctgggatcctgttagaagtgagtctcagctcccagacccactggatcagaatctgcatttacaagactggcagatgactcagatgcacttaaaagttcaagaagccctgatctagcacattctgcctcagtgtgcacagaggtcttcagctgtgcccagcaggatgtagccatgtatgtcttcaggggagcttgtcatctgcaggggctgcgctctgtgccctccaagcccaggaagctcaggggtcttgcccactgagaagtgctgctggaactgagaaagaacatttcattttccctggactgtttcaggtcaaattgcatagcctcaaattttatttttaaaagtcagccagagatcaaaccgtagcagcgggagggacttcttcaataaagtgtcttggaaaagcagttttcctgtgtacaccgaagactcttcaaagggggaccaggaccgctgcaaggagcgccacctatttctttaaatacccgaagattccattggctccaggccggcgaggttttgacagtttacacctggtgacatttagagactgattttggagagagctgaggggaggaggcatttggtataacttgacattacatcctctggctgactgcgctctctcttgccaatataccatttgtctatgaaacacttaggcccaaaaatagctgtacagtttggtgtcattgtggatgaaatgaagggcaactgccccatctctttggctttcagacaccctcaaaatgttgcgatgaaatgtcccagaggaattagcacagctcattaaacctgaattcccagccagggtggggccagtcagaacatggcgttgggacagatgggacatcagaagtgaccacctaatactccaggggtggcacctgcccaggggccacaagacagagtgaaagggggtgccgttcataatcgcagcccgtcgacaggcatgaaccaggaccgtcctgggcagaaccccgtcttgggccaaatcccacctgttcagttggctctgcccccagaccaatgagatggggtccctggggtccaaggtgccgcctcctgagtgtacggtccagagcgtggtgacagggctccctcccaacaaagcaggcctattgctcccagtacggggcggggccttctcaaggccataggcagcacagcatctgcccacttctcgctggggcaatggccgtgtgcagctggctttccccacttctctccggggcggtgaccgtgtgcagctggctttccccacgtctctctggggcagtgaccgtgtgcagctggctttccccacttctctgcggggtggtgactgtgtgcagctttcctgggagtgcagcgaatgcagggtccctcttcctttccacttccgttcagctcccatgtttcattatcaagtgcattttccaccgaagtccagtagcaaacaggccctgggcttggaggtcacctgctgtgaaaggtggtgagaggatgtcacagggctcggcacttcactgactgcttctgacccgccatgcccttagtgtctcctctatggagctctgccacctgtggctcctgcggcccctcaaagcatcttggctgaacatacccagcccagtcaataggcccatcagcgaggtgggacatgagccccatgcctgggctacccggcagtcccaggaggccagcggggccgaggcgtggtactcagcatgcaccaggggtggggcagatcccacgggtggggggcagggccccaggccaggtcacaaggccacggcactggttctgcagtgaccctaacctgcctgtctctgtgtgtggtccacagcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 36962 - DNA, 45124 bp, Homo sapiens; identical to SEQ ID NO: 36745

SEQ ID NO: 36963 - DNA, 5801 bp, Homo sapiens
gggactgtcataaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccaggtacgcgggcggggcgggcggcggcctgccgaggccgcatcgtgtcccgccggggctcaccgcgctcctctaccccgcagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccacccccttccaggcctgatggccctaggcctccgtgcttggttggccggcaggctgactctggtggtagatctgactgcgttgccctccggtaattggagttctgttgacaggtgagcagcgcccttgggtagttggaggtctgttgacagctgtgcgcgcccttcagggtcagttccctctcaggcctgcagggcctcattctagttgcacatcaaattcctaagcactgtctcctgtggcgccctcccaaaccagaagagcttcccacttgagccgcatgcttcctgggcttcggagccctttcctgcaaattatatagggcaggtccccctgcaccatcagatttccacctttgctgttttatttttcccaaacttcttattttaaaagttcaaacatttggaaaaactgaaaagacagtgtagtgcatacgcttgtgctctccaccgaaagttcagtagttaacattttgctctagttcttgacatcccaaaatacatacatgtgacagcatagaattcaccaagagtcttcagcattcctggagaccaggattttcaacccagccatgctgacatttgtggctgggtaagtctttatggtgagatgctgtcttgcgcattgcaggatggcaggggtaccctccctagtcgtgaaaaccaagaatgcctccagacaacctgggtggtggggtcaaccttggccttggattgggagcaagtgctctagaacaagagcggtctcctacacagctgcagagggtagccccctgagaaattaactgttccaggtgtctcctgactttcagtgcatggccacatcatggtacctaacttgtggcaaattgttgctttataagtaaggatccagtccaagttcatgtactacaattggttactttggtctctttgcttctggaacagtccccaacatttattgtggcattgactttttatagagtctaattctataattagaatgccctgctctggatctatcagaggaaatgcttcctcgtgcatttaacctgcttctccactctctgggtttactgtacactggactcctggtaggagcctgattagaggcaggtttaatgtggcaaaaattcctcctagcggggcaaggcccccttccccagaaggcaggcagtgtccatctgctccaggattggtgtgtttctatcaagaatggatgttggattttggcagtttcctttttggcagctcttgagatgatcacgtggtgaatcattttctattactacagtgaattacagtcacttgaattccatcctactgggtcgtgctgtagtatcctttttatgtatgctggatttgatttgctaaaatcttgttaagaatttttttgtctatgttcatgataaactgtggtctatagttttcatgtaatacctggtttgggtatcagggtttttgccagccttataggatgagtttcgaagtgttctctcctcttcagttttccagaagagtttgtgtagaattggcattacttcttcccctaaatgtctgggtgactgtctttttaaaaattttattgagctgtaagatgcatgcagtttactaatcccaagtgcatggctcattattccttaatgctcagactgtgccatgtgtggccagttgggggcgctccaggcacctttagatgccgccccatcattctgtgagcactttcttgctttctggttcaggtatgtgttcaggctcatcttttcttgttttctccgtgtctcagtcctggaatcggccatttttccacagagttgtagttctttctagcaggatggggagtttcagtaactgcctgggcccaatgctgtttgtgcttcagaaggtttgggccaggtcctggttccaccagcagcaggcatgcctgcgttgactttctgcttctcctgctgatttggcaggggtgactggctgctcctgcctcctttgtgttcccggtcgtgtctaaggccaggccccttctgcccaggcagccggcgtggctctcttcttgccttttggttgcatatctagtggaatctcgtagtggacctggcacttgtagcaatgtttgatcagtagagtgaagatgatgacatttccctgcttccctgtgttatggagctgtcttgaggggggcttttggtaaataccatcgtcgaggtgtgtacagaatgccaagaaacaggagattggggaaggctgtaggcacagctggagccaggctacctgcaggggagcctcaggggccgtggagttccctggagacttgccaccagagaagagctgcaacatcagggctcttcccaggaacagagtgttggatttcacgttttgttgtggccagggacccctccttcctggggaactgtagccatttggcacttaatgcactggcgccagctgcggggtgctccatgttccattttgccatgatggtttatgtcccatgatcgcttcctctgtacactcccttcagactagagtttgcacatctgtgtttgtgcacagtttagcagggaccgtggagctttgcttggtggccgagggtgagcccctcaaagccacacagactccctggcccagagcctcacaggcttatgacaccccaggttcatcccaaacttgggcctcccaggtcagctcacccttctccctctggtgctgtgtaggggctgggagctgcaaatgggggagggggctgcccaccctgaagggcagcaccaagggtggaggggccaaccacacacctggtaggcagaggccccacgctcagggtcagcgacccggctcctcctgctcctttcccatgcctttgcctgaggtggtctccaacacttgagtagatgtcctatggcctgtggccacgggggccctgaagccctcagactgcagcctccctcccgcctgccccctccagctgccctgggtctggggctgcagctttggccccacctggccagtcttccccacccccactctctttcagtgccccgcaccttctggaatcccctggagacttgccgtgacagtggggtgggaggatggaggaggctggcgtcctccccagtgcagacacccctttggcctggctgctctgctgggttggtaaggcaggtgcccatgggtgagggctgctgccgagtcccaccgcctgctgacgggctctcatccctcccagtgctcaggcaggcgctgcggcagaagcaccaggaagcccagcaggcctgccggccccataacctgcctgtgcttcaggcggctcagcagcgagaactagaggtactggggacgcaggcagggtggccggcccagctctcctgtgggcaccacctggctctgctgactgggctgagctgaaggggtgtggggggctcaggtgtgggtggctaccctgggcctgagtgggacactggaggcctagtgagtcccaccaggtggctcctcgctgagggtgccaggtgtgctgggactgggtggagggtgagaacccaccagtgctcccctggagtccattagtgcccctcgtgggttggggtctccgcagagcaggtggcctcggggggtacaaaggcaatggtggggtgatggggccagccaggaaggggcccatccttctccccgggagcacagggacaaccagagaccggcatgtaaccaacaagtcatggggcagggtgtgcctgcggagatgtgtgtgtggtcccaaggcagtcccaagtcaaagcattcgtggaagccccttggggcccccttcaggggttcacttggccgaggagaggcctgggtgtggtgaggatgcattggtggtgtcagagctggtgctgttggggacagcagcaggagcatgtgtttgagctgccctcacctcccccgccgcccccggccccacggcaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggtcagtgcctgggcctgctctgtcctagcccgagtgcccctgggccccattccatctgggatttcactgctggtccctggggagccaggctcagggtatagggggtgaagtggaaggattgaggctctggaaaggatttctgtgccattcccagcatggaggccaggcccattccctacaggggggtgagccagccagccatgggcactgcccaccctccccaggcctgctgtgccccacagggccctcttctgctcccctcccgcatgccattccaagtggccctgctgggtgcagaggctcagattccgagtggccctgctgggggcagaggctcagattccgagtggccctgctgggggcagaagctcagattccaccctgtcgtagcaggccatgaccaggcttcacaggatggtcgccccgtgggctcactgcctggcacctttgggccgggatgaaaggggcctgggggtcactctggccttcatggggcccctctgtatcccaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtg

SEQ ID NO: 36964 - DNA, 77542 bp, Homo sapiens
atcctattttctgggaaaagattactaccacagtaattgagctgtgaagcggagacaaattgctctcggtggtggttcaaagtactgcaattgactggaatagcaccgcgcagttttccttcctctcgtgcaagataagagtgataggagctgtatcgattacctgcaagatagaagtagaagcgggccgggtgcggtggctcacgcctgtaatcccagcactttgggaggctgaggcgggtggatcattcgacgtcaggagttccagaccagcctgaccaacatggtgaaaccccgtctctactaaaaatacaacaaattagccgggtgtggtggcaagcgcctgtaatcccagctactcggttggttgggcaggagaatcgcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctggtgagcgcggcgcgcccggcccgggaccctgcgttgcttccgcgcccctagctgggcttctggcccggcctcgcggtggggtgaggcgtgcgctcatccgcctaaagttgtattattagaaacttaattctccgggtgccgcgtccgcacttcccccggctgggccagcgccgactgggggaggccaggagtttggggcgatgggggaggccaggggcgcggggcggagggccgcactcgacccttggcgcccaggtggtgtgggtcgccgatctccagcctccgcgcagccccgcggcctcgcgtagggcgcaccggggcagacaaactgagcttatctgccgagcacgtgtttcctttcttcttaaagcccgtgggctttgtgtttcgacggctgcggacggagcggtcgcggaggtgacggcgcatattttgcagctctgtggttagggttgcggatttgtcaatgctcgttctccctggccgcgtctccgctagggtggcctgcgctttcacgccgtcgcacgttcggatcccgagttgaagtggttgggagttcttggcatcctcttgtgaatgggtcccccccccgatgttttaaagcccttactccaggaagggatgtgagtgtgatttactgcgtttccatctgcccggggaagccattttccacccacatttttcctgcccgtggacagttggtcttcagaccttttcttgacagactcagcgggcaaatctggcattttttttcctggttggaacttttgaagtctttttttgtatgaggagcagtgattttcagagctagtgaggaaacctgatggagtcttgcccgcacctgccctgcgttggttggtggcacccctagactgcaccagcactgagtcggattccgctgcattttgggttttgtgacatcatgatggagagttagaccagagttgctttgcagtgaataccactgcatcgcgagaaaatgccctgaaaatggtagacaaatagcatatataacttttttcagtgaggtttttttttttttttttttttttttttgagacagagtctcactctgtggcccgggctggagtgcaatggcatgatctctgctcactgcagccttcgcctcccaggttcaagcgattctccttcctcagcttcccgagtagctgggattgcaggcgcccgccactatgcctagctaattttttgtatttttagtagagacagggtttcaccatgttggccaggctggtctcgaactgctgacctcgtgattcgcccgccttggactcccaaagtgctgagattacaggcgtgagtgagccaccgcgcccggccgagaaaaattcttatctctttaatgagttggggtgtgtgtgtgtggtttgtttattgggcccatttttgggtagaatatggactttttgtctaactgtgaaccccttccttgtaccattttaagcaaaacatttcaccccaggcatatggtattcactgtgctatttatagtttcaagtttcctttagtcagtgcctatcatggccacacaatataaatttttggcgtgaaagtatttcaaacagatatttagcgtgtgtgggttcttactgtgcagtgtaaatacagatggaacatcagcatattagctaaacttcgactttggtaaaagccaagaaattctttactgaaattgaaaattatagcaaaaggatagtaggtggctcaaaatagttggtgcttttattgatgatcaagacagcctgttttatacaagtgtctgccttccttgaaaatgttcaaatctgccgacttgcaagtacatcagagaacgtaatttgtaaaatctagggcattgcattaggcaaatgtactacgtgatccacaggaaagataaatcctacttgagccctgttggctgtaatccaaccagacagtgtaggtgtgataaaaggagagtactcagcatgctttgtctactgtttgagcacgctctctgtggaaagtagttattggtgtgtttgtcttaacgtttggaaataaatggccttttgaaaggtaattagaaagctttctagcagatgtgaataaaaatgttgctttaggtaaaccctatttctgggaaacctggcttaagtactggtaatctttataaatagtcttttgcatttcacaaggcaatgtaagcctttttcttttctttcttttttttttttaaagtagtgattttcactcagacctttgaatataattttgtgataccctaccttgttttaacctgaattgactctcccttagctaagagccagacaagactccatcttggctccttcacttgcagccccttacccacccgcttcctcaaggacttaacttgtgcaagctgactcccagcacatccaagaatgcaattaactgataagatactgtggcaagctatatccgcagttcccaggaattcgcccggttaatagtacccagagcccccgcgtttgtgtccggttgataacacccaaagccccgcgtctgtcaccttgtgatagatttaaagcccctgcacctggaactgtttactttcctgtaaccatttgtccttttaactttttgcctactttgttttaactagactctccccctcccctttctgaacaaaagtataaaagaaaatctagccccttctttagggccaagagaattttgagcactagccgtctctgggtcgccggctaataaaggactcctgaattcgtctcagagtgtggtttctctataagttgctcggttacaacaatttggttgtccaaaactttgattttcttgaacttttttaagagagtttgtgtggctagggagcaggaccactgtaaaacgaggcaccttccctggtttgtcctaaccctttctctcagccagccatctggatggaatggagtcaattatcagaaagtggagagttaagaattagccaggtgtggtggctcacacctgtagtcccagcttgagtcccaggagttcgaagctgcagtgagctgtgattgcacccctacactccagcctgggcaaccagagtgagcactgtctcttaacagaggccaagtgcggtggctcacgcttgtaatcccagcattttgggaggctgaggcgggcagatcattggaggtcaggagttcgagaccagcctgaccaaccatggccagtgtggtaaaaccccatctctactaaaagtacaaattaggtgcggtggtgtaggcctataatcccagctacttgggagactgaggcaggagaattgcttgaacctgggaggcataggttgcagtgagccaagattgtgccactgcactctagcctgggtgacagtgagactctgtctcaaaaaaagaaaaaaaaagagaaagaggcctggtgcagaggctcacgcctgtaagcactttgggcggccgaggtaggcggatcacttgaggtcaggagttctagaccagcctgggcaacatggcaagatcccgtctctaataaaaatacaaaaattattcggtcgtggtggcatgcgcctgtaatcccagctactcaggaggctgaggcatgagaattgcttgaactctggaggtggaaagtccagcctgggtgacagcaagactcttatctaaaaaaaaaaaaaaaaaagttgggtgtgggtggctcacgcctataatcccagcactttgggaggccgaggtgagtggatcttgaggtcaggagttcaaaaccagtctggccaaggtggtgaaacctcatctctactaaaactacaaaattagtcgggcgcagtggcaggcacctgtaatctcagctgctggggaggcagaggcaggagaatcccttgaacccaggtggcagaggttgccgtgagccgagatcacgccactgcactccagcttgggcaacagagtgagactctgtctcaaaaaaaaaaaaaaaaaagaaaagtaaaataaagaataataataataaagcggagagttttcagacaaggcagatatttaaataagagtccaggccgggtacggtggctcatacctgtaatcccagcactttcggagactgaggcgggtggatcacctgaggtcaggagttttgagaccagcctggctaacatgatgaaaccctgtttctattaaaaatataaaaaattagtggggcgtggtggcacgtgcctgtaaccccagctacttgggaagctgagagaagaatcatttgaacccaggaggcggaggttgcagtgagctgagatcgtgcgattgcactccagcttgggcaacaaaagcgaaactctgtctcaaaataaataaataaataaaacaaaaagtaagagtccacaataagggctcatttaagtaatttcctgttttgcaagataggtaaagtggatcttttttatatgttttcttattgttgattcctaccaataccgtttactaaggctccaagtgtcatgtactttactagatactttgcataaggttaatttttacatattcctggtgaggtagattttcttattcccattttacagatgagaaaactgaggcttagagaactttggtgatttacttgagagcttaaaatcccatggttggtttatgatctgagtgatgttttaatctgttctgtttccactgttttacttttaaaagttgtgcatgtgttttggttttgtcttggaataataaaagttttccttcagtcctgaagtaaagtatattgacttcaggtatttattattattattactatttttaaaattctgggccacgctaactttgggagacttcaggtatttattctagagatcattttttgtttgtctctttttttttcttttattgagttgtgatttatgtactacaattttttttttttgagaccgagtctcgctctgacgcccaggctggagtgcagtggcgtgatctcggctcaccacaacctccgcctcctgggttcaagcgattctcctgctcagcctcctgagtagctgggattacaggtgagctccgggctaatttttgtatttttagtagagatggggtttccccatgttgttcaggctggtcttgaactcctgaccttgtgatccatccgccttggcctcccaaagtgctgagattacaggcgtgagccactgtgcccggcctttttttttttttttttttttgaggagttttgctcttattgctcaggccgaagtgcagtggtgcaatctcagctcactgcaaccttcgcctcctgggttcaagtgattcctgcctcagcctcccaagtagctggtattacaggcacccaccactgcgcttggctaatttttgttttcctagtagagacagggtttcattatgttggccaggctggtcttgaactcctgacctcaggtgatccgcccgcctcggcctcccacagtgctgggattacaggcgtgagccaccgtgcccggcaaaattcacagttaaatgtagtttattgagttgacaaatgcctctgtaatgtaacccacattccttgagaacatttccaaactttcagcaagttcccttgtgctgtttcccagttaatccctgccatatccccaatcactgtaggtaagttttgcttattcatgtaaaatggaattatgctgtgtgtacccttctgtatctagcttctttcacttagcataacttcttttagattcattcatcttcttggagtgttgctttttattgctgagtattgtttttattgtattaatataccacaatttgtttatccatttgccagatattggacatttgggttatttccaatttggggctattataaataaagctgcactgaacattcttgcacaagactttggggacttttttttttttttttgagacagagtttagctcttgttgcccaggctggagtgcaatggtgcgatctcggctcaccgcaacctccgactcccaggttcaagcaattctcctgcctcagcctccctagtagctgggattacaggcatgcgccaccacacctgtttaattttgtatttttagtagataacaggatttctccatgttggtcaggctggtctcgaactcccgacctctggtgatctgctcccctcagcctcccaaagtgctgggattacaggcctgagccaccatgcccagctttttttttttttttttttttttttttgtgacaagatctcactctattgcccaggctggagtggctcaatgcagccttgtcttccctggctcaagcagccttgccatttcagcctcccaagtagctgggactacaggctcacaccaccactccacaccactccaggcttttgtttttgagacagagcctcactctgttgtccaggctggagtgcagtggcgcagtctcagctcactgcaacgtctgcctcccgggttcaagcgattctcctgcctcagtctcctgagtagctggtactacaggcatgcgccaccatccctggctaattttttatttttggtagagacggggtttcaccatgttggtcaggcttgtctcgaactcctgacctcctgatccacctgcttcggcctcccaaagtgctgggattacgggcgtgagccaccgtccccagcctttttttttttctgagacggagtctcgctcttgttgcccaggctggagtgcagtggtgcagtctcggctcactgcagcctccgcctcttgggttcaagtgattctcctgcttcagcctccaaagtagctgggattgcaggcatgcaccaccatacctggctaattttgtattttatttatttatttatttatttatttatttatttatttattttttagtagagacggggtttctccatgttagtcaagctggtctcaaactcccgacctcaggtgatctgcccgccttggcctcccaaagtgttgggattacaagtgtgagccaccgcgcccggcctttttttttttttttttttaaatatccttgttcagttattttttaggaacttagacacagcaaatacataccaaatgcctctgtgccagacactgttcacagggtagttagccatatatcagattataaaggataaaagaggtcagagtagctgcttcattggctttatgacctggtctttctttttaattttctttctttctttttcttttgttttttaattatactttaagttctgggatacaagtgcagacctggtctttcaaagaatccacttgttcacatagaaactcacagtttccttgtttactcaagtaaaggaaaccagaatatctcacccaaaatatacctctttggtatatttcaagatagtattagagaaactgcaaacaagaatagctctgaaaagctgctgtttgtggagatttgcatctttagggaaaatctgcattagtgaaataaacagccaggctttctctgagcacacctccccaccccatcccccatgttcagaccttggaaagattaaccgagagattgagagtctgacacctttgaaggtctaatagagaagtttaccacataccacaggctaccaagtatcttttctcaagccttctacctgtggggtctcatttgcataacaagaccaccttccctagccaggcctttccgtccctccctcccataacctgttttgccgtgatctaaacccctattctttctgtaacttcagaaagacattaaaacttaaaccatctggcccttcctttgagttttcttatttctgtgactcccacgtatgcgtgtgcacgtaatacatttgtatgccgtttcttgctgttgatctattatcagtttgtttattagactcaaatgatcaaaccttcagaagttgtagaagggggagaattttcttcaccccttcacaagcctgatagattttctttgtattctgagaagttcaacaactattgatttgtctgagtacaggatagtaagaccaacatcctgtatttgtagagtgattgatagctttcggtgggcattcacatttgttcttatttagacctcaaagcaaccctgggtcacgcatgataggtggtgatatgttcttttaagattaatagcttctttccaactgtcagattctgtgacttggcccgtaatttcaggatagaataacggactgatttgtggcaattgtgtcatctttattgcctggtgttttccccactatgttagattgtaaaagactaaatagtaggctaaagagtttggattttattctgtaggcagtggggaaccattgaagaattatgaacaggagcgatatgatgaaagcagttttttttggttgttgtttttgttttgttttgttttttgagacggagtctcgctctgtcacccaggctggagtgcagtggtgggatctccactcactgcaagctctgcctcccgggttcaagccattctcctgcctcagcctctcgagtagctgggactacaggcgcccaccaccacaccccgctgatttttttatttttaatagagatgaggtttcaacgtggtagccaggatgatctcaatctcctgacttcgtgatctgcccacctcagcctcccaaagtgttgggattacaggcatgagccaccacgcctggccaatgaaagcagtttttaagttagattaaaatggcaggctgtttcagatggctggaaaaccaggcagtatgttatatatagctctctagatacaaactatagtgggtatcagctcttagtggtatgaataagatggataggaatttttaccagttagtgagtgatacaagtctctctttctacctaggttttctccatctgatttaaggaattgaacagatttagatagggaaggacattggatttttaaagtacaggtttcccctcatctaataaaggatcaagggcagttctatagaacattggttggtggagatttcagtggtattcaatatctttttaagcttttatcacactttttttttttttgaggcagtttcattctgtcacccatgatggagtgcagtggtgccatctcggttccctgcaacctccacctcccgggttcaagcccttctcttgcctcagcctcccgagtacatgggattacaggcgcaggccaccacgcctggcttaatttagtagagatggggtttcaccatgttgaccaggctggtctagaactcttgacctcaggtgatccgcccgcctcccaaagtgctgggattgcaggcctgagcctcttatcacacttttatggtaaatgttcattagaatgttttacagacaaggtggccaataaataaagattgctatcaaaactgtttattaataccaatcactctcggattcactttaaatatatttaacttcgacctaaaaggaagaagctgaggcaaaattaatgtaagtagagagtttatttgggccaggcttgaggattgcaaccccagaatatagactgacgttgccctgactgtacacacagattagcagcagttataagtgcatttttaaagactgaaagggggaacagggagtgtactgatacaaagttgtttgtcaggaattgtccttgatttacagaaacaacattggttcgtgattggctatccattgttgagctatgcattattaggttaatttgcagctgcttgtggcaatagcaatcagtttcaacagttgaagacatagctcaaaagggagggggagtagaaagtgattgctgtatcgttttaatgtctctctgggcctgataataaagacttgcatccctcagataaaagttattttctcagtaacttagcataaagtattaagttaacatgagttttgtcgtacaatgtgtattatgtttgaatgagtaatatatttgttttgtcaatttaactttgaatcttggccctgaaggaagaggccacagttgtcccattctgccccaccaccttttgggctgatttgtcattggtcaaaggaatgctagtggaaataatgtgtgagccctagcaactctccttttcctcctcccagttcttgagactcttagtagagcttttggagactgaatgagagttgttgagttattggttaactcattgtgcttgacggaaagtaaaaagcaaacaaagaccacacttcttcagttgctcctaacgttttaagagtttcgagttgcctctttgcagttgcagcttccaagggaaattgtttctcaggaaaatatgtgggaggttaaaaaaaaatgcttgaggaaatgtaatttcaaattattagtaaacataacattgaacttaaaaaaaaaacaaggccgggtgtggtggctcacgcctgtaatcccagcactttgggaggccgaggcgggcaaatcatgaggttccgagttcgagaccagcctgaccaacatagtgaaactccatctctactaaaaatacaaaaaaataggcatggtggcacgtgcctgtagtcccagctactccagaggctgagcccggagaatcacgtgaacctgggaggcggaggttgtggtgagctgagatcgtgccgctacactccagcccgggcaacagagcgagactcccgtctcagaaaaaaaaaaaaaaaaccattaaccttgagctactaaaattacacagccagttggttccatggtgcagagatggtgaagtagtaacccttagcatgtagtaggtacttagatttgtgttgactaacagtagtgggcctgggggttgcaaaactgaaggtgagccagttatgctatagataaagttgctataacaaagaaacgcaaaactgcaggaaggtagaagtttatttctttcctgttaacagttcagggagtgttggccaacattgttccttgaggccatccagagacccaggctggggggtgggggtgtagctccaccatcccaaatattgtgcatggattccttctctgggttctaaggaggctgcctcctttatgtttgtcttcatggtggagacattaccagcaccatgtttgtgtcctggcctgctgtaagggagaaaggggtatctggaggacaaggagctttatttttttaaggatgtgaaatggaaaatgcacacatcactttcacttacatcccagtaaccaaaaacaagacatgtgacttagctgtgagggaggctaggagatgtttctttcttttttttttttttttgagactgagtctggctctgttgcccaggctggagtgcagtggtgcaatctcggctcactgcaagctccgcctcccaggttcacgccattctcctgcctcagcctcccgagtagctgggactacaggcacccgccaccaggcccagctaatttttgtatttttagtagagacagggtttcaccatgttagccaggatggtctcgatctcctgacctcatgatccatccgcctcggcctcccaaagtgctgggattacaggcatgaaccattgtgcttggccgatttcttttaacagatacacctaacttattaaagtctggggttaataatatctttgtctttcttttaaagaatacaagtcctttaactccagtcgtttctctcttgtattttagtgtccttttctaagttcccaaacacatcaatttacaattaatgtttgtttagaattacccgcatgtttgcatccctctttctccattactccttttttctttttgtaaccactataattcttacttaaaaatgatttatttatttatttttttagacagagtctcactttgtcgcccaggctggagagcgcactggcatgatctcggctcactgcaacctcttctcccaggttcaagtgattctcctgcgccagcctcccaagtagctgagattataggcacctgccaacatgcccagctaatttttgtatttcttttttaaaataaaaggtctcatatttatgaccgaacccagccaaccaacacattcataatgattcagagagaaaaaatatattcccaataaaacgtccaactgtccagatggtggcgccattttcagcttgctgtgggaagatggtgatggccttgacacagtgtaaatatgtgtcatcttgtgtgtaattccttatagatccagctagcttcttctccagtgtctccttttggagttgtacctgatttcattaccagttgttaatctgaatccactggggaatgggacatttttgcttttgtttcttggccaggaaacaatcctgaaagtcttgtgagaagacatggcaagaagcggagtcaggcacacaccacgatggtggagaaaggaagagataactaattttctatttttagtagagatgaggtttcactatgttgaccaggctggtctccaactcctgacctcaagtgatcacctgccttggcctcccagaagtgctgaggttaacaggtatgagccaccacgcctggtcaaaaatgaatattttaacacccaaagtacacagcccatcattttcttttgcacctcagatctgctgtctaggatcattattcctttgtatgaaatatatattctaaaatttcctttgttaagggtctgttggctgcaacttctgacagccattttttttttttgagatgaagtctagctctgttgcccaggttggagtgcagtggctcaagcttggctcactgcaacctccacctcccgggttcaagcgaatcttctgcctcagcctcctgagtagctgagactacgggtgtctgtcaccacgtccggctaattttttgtatttttagtacagacggggtttcaccatgttgaccaggttggtctcgaactcctgacctcgtgatccgcccacctcagcctcccaaagtgctgggtttacaggcgtgagctacagcgcccagccctgacagccatttttttggaaaacatcttcatttggtgctcactctttatttatttatttatttatttatttatttatttatttatttatttattttgagacggagttttgctcttgttgcccaggctggagtgcagtggtgtgatctcgacttactgcaacctccgcctcccaggttcaagcgattgtcctgcctcagcctcccaagtagctgggattacaggcaagtgccaccacgcccggctaattttttgtatttttagtagagatggggtttcaccatgttggccaggctggtcttgaatccctaccttaggtgatccgcccaccttggcctcccaaagtgctgggattacaagtgtgagccaccacgcctggcctgtttttttgaggtagagtctctcttgcccaggctggagcgcagtggtgtgaccatggctcactgcagccttgacatcctaggctcaaatgatcctccctcctcagcctctgaagtaggtggaacctgacataccctaccatacctggctaatttttttttttttttttgagagacggagatttggtcttattgtccaggctggagtgcaatggtgtgatctcggctcatcgcaacccctgcctcccgggttcaagcaattcttctcccgagtagctgggattacaggcatgcaccatcatacctggctaattttttttgtatttttagtagagatgggatttctccatgttggtcaggctggtctcgaactcctgacctcaggtgatctgcctgcctcggcctcccaaagtgctgggattacaggcatgagccaccttgcccggccctctttccacctttttgtacccattaaccttctgcctcgtcactccccactacccttcccagcctctggtaaccatccttctactctctagctacgtgagttcaatggtttaaagttttagctcccacaaatatgtgaaaacatgcaaagtttggtttcctgtgcctggcttatttcactttacataatgacctccagttccatccatgttgttgcaaatgacaagatctcattatggctgaatagtactccattctgtatatgtaacacagtttctttatccattcacctgttgacagacatttaggttgcttacaaatcttggctattgtgaatagtgctgcagtaaaatgggagtgcagctattttttttttgataagcttatttcctttcttttgagtatatacctaggtgtgggattgctgcattgtatgatagctctatttttagttttttgaggaacctccaaactgttctccatagtggttgtataattttttttttttttttagacagagtctcactctgtcgccaggctggagtacagtggcgtgatcctggctcactgcaacctccacctcctgggttcaagcaattctcctgcctcagcttcctgagtagctgggactaaaggcacataccaccatgcctggctaatttttgtatttttagtagagatggagtttcactatgttggccaggctggtctcgaactcccgaccttgtgatctgcccgcctcactctcctaaagtgctgggatccaggcatgagccaccgtgcctggccttaatttttgtatttttagtggaaatggggtttcaccacattggccagggtagtctcaaactcctgatctcaagttatctgcccgcctcagcttctcaaagtgttggactatgggcgtgagccactgcgcccagctggttttgtgttttgagacaaagtctggctctattgcccaggctggagtgcagtggcacagtcttggctcaccgcaactttcgcctcctgggttcaagcagttctcgtgtctcaacttcccgagtagctgggattacaggtgtgtgccactgagcccgtcctagctttttgtttttttgagacaggggtctcactttatttcccaggttggagtgcagtggtgcaatcacgcctcattgcaacctcggacctttcagctcaagtagttttcccacctcagcctcccgagtagctgggaccacaggcacacaccacacccagctatttttacaaattattgtttgtagaaacagggtcttgcttgtttgcccagtctggtctcgagcttctgggttcaagcgagccacttgccttggcctcccaaagtgctgggattacaggcatgagccaccatgcctggttgatacttttttgtgcacagagtttaggtctccattgtccatcctgaactcggctctgggctgggcctctctcttcatattcaaatatttaaaatgttctttaagacatgaaagggagcacagtcattttctgcctccacaccctgtccctccatgtctcccagtaggtctttgcctcttctgggggccatcctttgccttctgtccattgtctagacatccttcttgttaattacgtgcaccctgtgttctttgagtacgtaatggtgtcttagcctgagaatgaacaccagaaccgactgaagttcactcagagaaattgggattgcttctgctggtgtggcagatcgttttgcacgctagccccttgtcagattgggagtgctgtctggagcactcccttgaaaggaattttgagcttgctgccagggattggtttagcagagttggccagggcctgtgaatggggtgtggtggcttcttgggaggaacctgggttactggtaagagcgtatatggcatttgtaatcaaagcaccaacaattgaatgtcagttgaaaactttatgcacctgtattttatgaacatggtatgtgcatatttccctgaagtctgagtcctcatctgtagaatggtgtagtaatgatcagacttgatagggaggcagcactgtttttataatataaaatggtgcatatggggatggtggtttcttagtttagttcatcacctatgaggaagacgtcctaaaaggatggtactgttgactgaactggtgaatcagaaagacctggttgaatttggggggaaaaacttccataatatattaaaaaattatatctgttgaaatgaggctctaataaaagatacaacatccattttactccttaaactttttccctcagagtctataaccaaagagaccatcctttgacttagaagttcagcaacttacaacatggccgccattatagtccaactccaaggattgccaagagtggctcattttcctgcttgtgtgctgtagagtttttcttaacagttggttcttttttatttttatttttttgatacaagatcacagtttgtcacccaggctggagtgcagtggcaccatctccactcactacatccttgacctcctgggctccaggtccctgccaccccagctccccaggcagctgggactacaggtgcgagccaccacaaccagctaattatttgtattttttgtagatatgggtttcaccatgttgttcaggctggtctcaaactcctgagctcaaatgatccacctcccttggcctcccaaagtgctgggattacaggtgtgagccgccgtgcctagcctaacagtcaattttttttttattttttatttttttccttttttgagactaaatctctctctgtagcgcaggctgcattgcagtggcacgatctcggctcactgcaacctctgcctcccaggtccaagtgattcttctgtttcagcctcccaagtagctgggattacaggctcctggcaccacacgtggctgttttgtatttttagtagagagaggatttcaccatgttggccaggctggtttcgaactcctgacctcaagtgatccgccctcctcagtcttccaaagtgctgggattacaggcgtgagccattgcgcccagcataacagtcaattagtcacttaatctgataccctaaaattgtttgtgctataatttttctctctcaggatgtttaggtctgttactttctggtgttaatagtgtcacctcagaaatcatacaaaggatacaacagatttgaaaataataactagaaactctagaatgaaaaaaaaatactgttgttgataaggtaacagaatttgtgttcactctgaatagaacatccaatttattattttccccactagataataggctgccttgagggctttgccataatatatatgtgatgcttagcattgtgcctggcatatatttgtggcacaatagattaatttttgaataactgaatgaatgagttaatgaatgttatagcgtttattctacattttacttggctgttgatgtatgtttcttccactggactaatgttgggcacagggaccgtgtcttttttttaaaccatttttctgttcagaaaaaaaaaggtttagctcgcccccagcactcatttaattttgtataaacaccctatgaggctgaagcaaatctgagtgattttcattgtaaaataaaataaaaattgttcttggaattatttctaaacagaatatcagtattgtctatttcagaaaaatcggattgttcaaatgaatcttcggccaacagctgttcaagagtgatgtcaacatcatccataggaatgctgttttgtaggatttgacacttcagcgatagagaattagtatattttgtacatggaaataccaccattaaaaatgaatgctgtaaacagaatgtctatcgtttcccaaattgatatactagaagaatgtgaaaataataataaaagcaagatttttgtggcaaacttatctcaggataaacactgcagctgctagggctgctggcaagtattcttgggactaatgggacaagggttaagagttggggttcttgctctgtcgcccaggctggggagcagtggcaccatcatagctcactgcagccttgaactcatgggctcaagaattaactctcaccccagcctgccaagtagctaggactgcaggcatacaccaccaaacccagctaattgttttttgttttttgttttttttgacagaatcttgctctgttgcccaggctggaatgcaatggtgcagtcttgcctcactgcagcctctgccttctgggttcaaactgttctcctgcctcagcctcccaagtagctgggattaccagcacctgccatcacacctggctaatttttgtatttttagtagagatgaggtttcaccatgttagccaggctgatcttgaactcctgagctcaggtgaaccgcccgccttggcctcccaaagtggtgggattacaggtgtgagccactgcacccggcccaaacctagctaatttaaaattttttaataaatataaaaattagctcatcttgaacttttggcctctagcagtcctcccacttcagcctccgaaagtgctgggattgcaagcgtgaaccaccatgaccagcttgggaccatgtcttaatcatttttgtacaacccagtttcaatcagaatgttgggcacatagtaggtgaactaattttagtgaatttcttaggcaaataggattttacaataaatctaatttccccccagaatatatttaccatatttatttgaattgaaataacaagcatgggaagaagtttattttgatatcagaacaggaccatagtgagagtctgattgaaacttccctttgatttgcccattgaaattgagtccaaatgagaggcatacctgccattaatagcttttattttattttaattttatttatttattttgagatggagtctcgctctgtcacccacgctggagtgcaatggcgtgatcttggctcactgcaacctccacctcccatgttcaagtgattctcctgcctcagcctcctgagtagctgggattacaggcacccgccaccatgcccggctaatttttgtatttttaagagacaaggtttgaccatgttgtgcaggttggtctcaaactcctgacctcaggtgatccacctgcctcagcctcccaaagtgctgggattacaggcgtgagccgccatgcccagccccattaataacttttagaaaaaatttccaaatactggaatatagaaattagccaagtatcagaaaacagcaaatcagattataatgtttatttattattattttttgagacagaatctcactttgtcactcagagtgcagtgtggtagcatgatcatagctcactggagccgcaacctcctgagcttaggcaatctacctgcgtcagcctccagagtagctgggaccacaggtgcctaccaccacacctggctaaatattattattatttgtctcattatgttgcccaggctagtcttgaactcctggtctcagtggatccttactcttcagcctgtcaaaaattgctgggattacaggagtaagccacccacacctggcctattttttaaattgtgaatcatttttactgattattgtacgtttacataaaaggacgtaaaatataaacagctaagctatcactaagcaaagacccctgtatcttatcactcaagactttctattaatggtttgccgtagagtttatatatctttgacttttaagaaagtctaacactggctgggcgtggtggctcacacctgtaatcccagcatcttggggggctgaggtgggtggatcgcttgaggtcaggagtttgagaccagcctggccaacatggtgaaaccctgtctctactaaaaatagaaaaattagctgagtgtggtggcacttgcctgtagtcccagctactctggaggctgaggtgggagaattgcttgaaccccagaggccgagattgccccactgcactccagcctcagcgacaaagtgagactctgtctttaaaaaaaaaaaaaaaaaaaaaagatctaacactaattggtacttttgatctcttcctagacaatgcaaggaccttagcttagttcatttccaatcacacctcctcttgatttatttgctgttttccccactcacctttgttgcccaggctggagtgcagaggcgcagtcttagcttaccgcagcctcaacctcccgggctcaagcgatcctcttgccttggcccccccagtagctgggactacaggcatgcgccaccctatccgcttagtttttgtgtgttttggtagagatggggattcaccgtgttggccaggctggtctccgattcctgacctcaagtgatctacctgcctcgagctcccaaagtgctgggattataagcaccagccagttatttcttgattatatgctaaacaatgagtggattattcatgagtctaatttttatggagatggagtcttactatgttgtccaggctgatctcctggactcaagcagtcatcctgcctgggcttccttaagtgttgggattacaagtatgagccactgtgcttgtccggatccttgaattaatattatttcactctgatgtttctcccttgttatatctatttccaggtttgatttgaatgcctggacagatttgtttattattgatcattgtcttagcatgttagttgttattttatgcttacattatgcttacattagacaatttgggggaaaaaaggacctagtttataatcattgtatgttgtagtgctttttacctatgatttatacatgtgagcacattacagatagaaatgtccgggcacgtccgggcgcagtgactcattcctgtaatcccagcactttgggaggctgtggtgggcagatcacctgaggtcaggagttcgagaccagtctggccaacatggtaaaaccccttctctactaaaaatacaaaaattagctggatgtggtagccggcacttgtaatcccagctactcaggaggctgaggcaggagattcgcttgaacccaggaggcagaggttgcagtgagctgagattgtgccattgcactccagcttgcgtgacagagtgagactctatctcaataaataaataaatctcaataaataataaaataaagaaatggccgggtacaatggctcatgcttgtgatcccagcactttgggaggcttctgtgggagcatcgcttaaacccaggagtttgagaccaggtcgagtaatatagtgagatcctgtctcaaataaaaaactagatattaataataaaattggaattacaactttttttttttttgagatgaagttttgttcttattgcgcaggctggagtgcaacggtgcgacctcggctcactgaaacctctgcttcccaggttgaagcgattctcctgcctcagccttccgagtagctgggattacagacatgcgccaccacgcacggctaattttctattttagtagagaagaggtttctccatgttggttagcctggtctcgaactcccgacctcaggtgctcctcctgcctcatcctcccaaagtgctgggattacaggagtgagccaccgcgcccggctggaattacaactttttaatactgtgcttttcatttagtgtgattctgtgaacattttcttgtcattaacattttaaaaaataagattttaatgcttgtataggattctgttacttggctttaatattcagtcattctacttttgtttcaagttttcactattatacataagtctgcagtgatcatttttggatacaacctgtgtaaatttctgatcgttgtttaattactgtatcagtgggtttgaatgttcataaggattttttttattgaggcttttaaaaaggagagctgacaattacattttcagttgtttagattcaagctgcaagtctcttatttgggatctgatagatgacttatgggtgaaaaggactttgaattcctggaacatattcaggggcctaacaccactttagaaattggacagaagttggatttatttacatgtggaagtaatcattgttaagaacaaggaaaaatatgtgacatcacaggatcagtttgtaaatagaacaggaacagtttgctcataacataaaaaaacagacaatgaaaacccaaatataagtgagcattagctgaattagagcataagtgtgtcccctcttttgcatttagatcaactgtgggcattatgtattctgctcctggcaagcctgagcgtcgtcttggttctcatttgtggtgttttattcttggttagaatggatgattgagtgattgccattttcgctctttcaggaagttcttacccagtgttgttggggctttgactcatgtttgaccttttctatctgtctgggtttagtagctaccatggctaatcctacccccaacccctttgcacagacataggtcctcatggctccccattttctattcacatcattcatggtgtgccagattcccatccaacaattgaggttttatataataataatacagtagatatgtggtggttcacagaccttcttatattaggaaaattccacactgattaaaagtcacagtggtgagtcatttgtgatgtgtaatgagcttacctgtcatatctttgttttatctgtgtcccctctatctggacggcctcgcgaagaaccagggcacctggacagggacttggtcccccgagagaaagaacacagggctagaggtagagtgggtgataatagttactgcagcatttatgacactggcaggtttaggacccaggacccactctggagtaagaaggacacactgagccagcagccaggactctgttgtcagataccatgtgatgtgttacagagatggagcaggagagggcagaaaggcatgtaagtatctgacagcatcaggctgtcagaactccagtagcaaacagaaaaacagggcacacatgaataccacagggcaagtacaaagagaagggttagaggccagatggataagctaaaaataggattatctggacatcctgcagtactttcagcacagtgtatctaaaatcgacgtcgtcatagtccttccactgaccttttccatttctgataatgacaagatacatcctgtcaccaggcttgaagtcttaggtcttctttgcttctttttctgtgttctttgcttgtagtcagttactgtatctctagtaattctgcctccatgtggaaaggtcttggggttccaaccttggctctcccacacataggccctaagataaagtcactaaacctcaccacctaacatggaagaagaccatctcacagggttgtcatgagaattggagatgaaatgccctattacttcttagccagactattgtaggtgtttccagggtcaaaggagaaaaattacaacaatttagttttaagatcttaattggctttctagaattgggcaacacttcatctcataaaatagagtatcctgtgagctaagcagaggagcttggctttttagagagaaatgggctgaagaaaccagaaacaaagaactaaaagcagatgagtcgtttcaaagggacttttcttttaaggcaggggcaggaagacagaacaatacaaaaataacatggttagcatcaggtgacttcaggttatctgaacctgagcacggtgactgcattttggtttgtagtctagtatgttgaggccctattgtgcaggagctcaatctgcaacaatggccgcctataatttttatttgacaccagattggattcctgcctctaatttagccttcccacttctgccagtttgttctttctaacaacatagctctgatcatgtcatatccttcctcaaaacctttatggcattttcattaactattagaattcctgtcctagtttcgaggcctcttcaccacctggccccatcctacatttttggttctatcctctaacatttccttttataccccctgaccctggcgttccagccacattgaacttgctgtcttgaggagatgtccttgtctcagtggcattgctcatacttggaattgttcttttccacacctctcaggctccaaatcttcatcttttgagttcctgttcaaatgctcccatctctgttgcaggtccctgcaacccctgactgtaactctccttaacttccatgattctttctcggagctcttgtcacattcattgctttatgctttttgttttttgggtacatgatgtatttaacttcatgttctgagtcctagggagttcttcctaagcacttagcaaatatgtgttgtaggcaattagtagctatatatgatcagtagactccacgggggaataataagcggattaagagttgacaggtccctagggactgagagtgcggggaaagcacaggcgtaaagcaggtgtcttaacactggctttagaagatctagaaaactagtaaccaagagcttttaacatggttcttgttaagatgtgaagaggtaagataactaatttgagtggctattgtatgccagtcaccggtctaggtattttatgtatattcactcatttgaactctggccagatgacattcttcccttctgtaatattaccccttgacctctttttttttttttttttttttttttttggagatggagttttcgcttttgttgcccaggctagagtgcaacgatgcaatctcggctcacggtaacctccgcctcccgggttcaagcaattctcctgcctcagcttccggagtagctgggattacaggcatgcaccaccatgcccggctaattttgtatttttagtggagacggggtttcttcatgttggtcaggctcatcttaaactcctgacttatggtgatctgcccgccttggcctcccaaagtgctaggattacaggcatgagccactgtgcccagccccgttgacttcttgttacacttagaataaaatacaaagtcaggtggtggctcgcgcatttaatcccaggacttcgggaggccggggcaggaggatcacttgagcctgagagttcaagaccagtctgggcaacatagtgacacaccccatctctaattaaaaaaaacaaaacaagactccataagtagccctacgggaccccagactcacactgtacgacttcctcacctttccatcttctctgaccagctccttacctctgctccctcctctaaagctttttgcccatgaatcccaaatttatgttttttcatttcagctttaaaaccctaccctgttatgataacaataatggagtacattgcccttgtgtggttcttcatacttttttttttttttttgagatggagtttcgctcttgttgcccaggctggagtgcaatggtgccatctcagctcactgccatctccgccccccactgggttcaagcgattctcctgccttggcctccggagcagctgggattacaggcacacactaacatgtccagctaatttttctatttttagcagagatggggtttcaccacgttggccaaactggtctcaaactcctgacctcaggtgatccatctgcctcggcctcctaaagtgctaggattacaggccaccatgcccagctcttcataatttttcaaagcacattcttcttatttcgtttgatcctatttcagtccacaattttccacataccttttctcaaaaataagagtatagaagagttgggtgcagtggctcacacctgtaatcccagcactttgggagtctgaggcaggcggatcacttgagaccagcctggctaatatggtgaaacgctgtctctaataaaaatacaaaaaattagccaggtgtggtggcaggtgtctgtaatcgcagctacaggctcctactgaggcgggagaatcacttgaacctgggtggtggaggttgcggtgagccgagcttgcgccactgcactccagcctgggcgacagtgcgaaactccatctcaaaaaaaaaaaaaaaaaagtatagagggattgaaatgccaagaaaacttgacagtttatcaaataacatctttgccataaatcttaatgccagttgtgggactggcctgtggctcctttaagccttggagttgtaacagaaagttttcttcagatagttttgttaatcacactgtttaaaatgtgctatgaaatttcttggatctttggagagaaacaagatactgttataataattactgtggagatgtcactggaaaggggatccagaccccaagagagggttcttggacctcgtgcaagaaataattcagattgagtccatagagtaaagtgagtgtaagtttattaagtaaagaaacaaaagaatggttactccataggcagagcagtagcttggactgctcgactgataatactataattatttattcattatatgctaaacaaggggtggattattcatgagttttccaggaaaggggtgggcaattcccggaaatgagagttcctccccatttcaggccatatagggtaactacctgacgttgccatggcatttgtaaattgtcatggcgctggtgggagtgtcttttagcatgcatgctaatgtattataactagtgcataatgagaaataaggacagccagagctcacttttgtcaccatcttggttttgatgggttttggccggcgtctttaccatcacctgttttatcggcatggtctttgcgacctgtaccttgcaccgacctcctatctcatcctgtgacttagaaggcctaacctcctggaagtgcagcccagtgggtcttagccacattttaccaagcccctgttcataatggagtcgctttggttcagatgcctttgacggagaaggtaacttttcactatatattctttgtacagttcaggtgtttggttaaacacatgcttgtagtatctgtttaaattagttatatgtatatgtatactctgggaagtggctcttctcattattacaatttttttcgaaaagcaatcagcttttatttgacaatttggaaaatacaggaagaaaaaaagttattccggccaggcacggtgcctcacgcctataatcctagcactttgggaggccgaggcgggtggatcacgagatcaggagttcaagaccagcctgaccaagacggtgaaaccccatctctactaaaaatacaaaaattagccgggtgtggtggcaggcacttgtaaccccagctactcgagaggctgaggcaggagaatcgcttgaacctggcaggtggaggttgtagtgagccgagatcgtgccactacactccagcctgggtgacagagtgagactccgtctcaaaaaaaaaagaaaaaaagttacttcgaatcctacaataatcctgaaataaccaattgggattgtcatttaaaaatgaacttttttttttcttcccctgagacagggtctcactctttcacccaggctggagggcagtggcacgatctcagctcactggaacctctgcctccctggttgaagtgattctcctgcctcagcctcctgaatagctgggattacaggcatccaccaccatgcccaactaatttgcattttaagaaatagggtttcaccatgttggccaggctggtctcgaactcctaatctcaagtaatccacccaccttggcttcccaaagtggtgggattacaggtgtgagccaccgtgccgggccaaaaataaactcttgaatggatgttctgtaaaacatttacacttcctttaaacaggtatttccaagtatgtggatttttgtttatttggttttgagggaaggtcttactatgttgctcaggttggagtgcagtggcgcatcagctcactgtagcctcaaactcctgggctcaggcgatcctcccacctcagcctcctgagtagctgggactacaggcatgcaccactgtgcctggctcattttcttgtttgttgagatggggtctcactgtgttgcccaggcttgtcttgaactcctgggctcaactgatcttcccacctcagcctcccaaagtgctgggattacagacatgagccactgtgttcaacccaaatatgatttttgtggtaggatatgccattagttagtgttgttagtaagaggcttttctctgtgtatcttcactccatttgagaagagtaaaacatagaactgtgccataagtttctgaacttagaatagtaaagaagtaacaagccagtcttggcctggcccagtgatgcgcacctgtaggcccagctacttggaaggcagaggtgggaggattgcttgagcccaggagtttgaggccagcctgggcaatatagacaccttgtctctcagcagacaacaacccagtcttagctggtgcctcacttaaactctgcaatccttgctaccccagccccatcaaagttaatatgtgtgtgtattgtccagcagtgacaggaagaataaaggaaatagaaatgaagaggtagaatgatcaggattttgcagttggttgagtgtgcaggataaagatggtaaactcagatgatcaagtttcgtatatggacaggagacttgtagaggttaggttttggaacctaaattcctggattcaaatcccatctctacagcttggtagttgtttgttcctgggcagtgttttttaacctctgagcctcagtttgctatgtataacatgggaataatttagtacccacttcgttaggttattgcagggcttaagagagattccacataaagcacttagcatagtgcctgaatgtttttcattaattattaatagcgaggccattttttaaattagagaacaaataaggagggcagaagtgggagatgttaaagaaggtgattgtcatttagaggagctgagtttaaagtagccaagggcagtactcagaagacaggactactggcctggcctggcctggcctggcctggaaagggttattgcagaaggatgatcctggatccactatgtagctttgcattcattctctgaaactgcttcctagatggcttcaaagctctcaaagctccactagtttgaacctgtaaaatgtttgattaactgagacaacttgggttgcttacctttagctctagagtgtagctgactcactggaaagtttttgtgctttttcaaccactggcgccagggctgatgcctgtgtttgtgtgtgttgttcactgctctatggtgcctgggccagggggaatgaggtaaaatcctgctgttgtcttcactccaagccttgtgcacttggctgcaactgaatgggctggcagcatttctgccttgggaatgtttatctgctccctccatgggtggggcttagtgttgagagtcaagccactgaagaagttgcctgtggccagcctgactccatgtggtcagtgtaattttctattataaggattgcatcctggggttacttaaattcttttttttttttttttttcttgttgcagatcatcaatgctgtggtactgttgattttattgagtgccctggctgatccggatcagtataacttttcaagttctgaactgggaggtgactttgagttcatggatgatgccagtaagtagtagatatttgggtattttcaagggcagggaatctgactgccagcacttcctattaaattacaaatatagactcgtgagttcatttgagctgatatataacttgtcattgcaaatcaacgaatatttgtgtgcgtctaacattctgtcttctaggtgcaagagtctaaataagatctattttcatcttatgttaacttacccacttaaaaatgattgcattatcatagactttctaccctgggccttttggccttttttgagaggaaggggtataaatgccaggaaggaaggtgaaaaggcttgtgcttatctccttgtgtcttctattatgtttcagtatttatttttattctaggagtgatccttttccattctagaaatgatgttgcagattatttgggggaatttagggccttttcccagtgaatggaaatatgtacagggatgtggatgtggggtaagcagggaggaagctaggctcccagcttgaagatcactgcagcctcatcattttataatcattatgccgagtccatgccaaaggagaggagtagtgctgtgcataatctccagcagaagatagtacagatttatttctcattggcttcggagaacttcaagtgagtttttcttaaaaagtgttggagcaaagtaagagaggagagagtggctcaacatgcagttttagagatcggaagcattcgaaagacatggtgagggctctttgtttctccaagtaagaaaaagctgttcagtggttttaactaaatgcatgaactgatatatgcatttaagatcccttttgctgctgagtagggtactgggtgtgtgagcacagagcctgggagagtggtattggggataccacctaggctgcactggggatagagaacagggaaggatttggcaacttgctgttttgggcagcgaaggagacggaggaatcaaagatgacttctgctttccagttttaggagatgacctgcatcttaactgagctgagaaagtccggagtcaggaggtgggaacagacctgggggagaaaaatagactttaatttcagtaactagctgagcacagttgtttggaattgatatggtttggctgtgtccccacccaaatctcgaattgtatctcctagaattcccctgtattgtgggagggacccagggggaggtaattgaattgtgggagctgctctttcccttgctattcttgtgatagtgagtaagtctcatgagattgaggccgaggctggcagatcagctgaggccaggagttcgagaccagcctggccaaggtgacaatacctcatctctactaaaaatagaaaaattagcccagtgtggtggtgagtgcctgtaatcccagctacttgggaggctgaggcaggagaattgcttgaaccccaggtggcggaggttgcagtgagccgagatcgcgccagtgcacttcagcctgggcaacaggtcacttttgctttttcttcattctgtcttgtcaccgccatgtaagaagtccctttcaccctttgccatgattctgaggcctccccagccatgtggaactgtaagtccagttaaacctctttttcttcccagtctcgggtatgtctttatcagcagcatgaaaacagactaatacaggtgtaggctccgaagccagaagaggtcagtttgagttctgacaccgccgtgtgttgaagatgctaaacttgagctagtgacttatcattgtgtgcctcaatttccccctctgcaagataggagtgactttataaccacatgatttaaacgatagaaagtaattacagactggccacggtggctcacacctgtaatcccagcattttgggagcctgggagggtggtggggatcacttgagatcaggagttcaagaccagcctggtcaacgtggcaaaacaccatctctactaaaatctacttgcctcagagttgttgtgaggattaaatgagttagtgcgtaaaacatgcttagaatggggcctggcccataggaagtgctcagtaccttttgctgtttcagctactattatctagattgttatggctggaacatgtgaaccatcttaaagtggagaggttacaaaggtcaggcatgggagtctgtggcccagaggaaatatttggactgagattacagatttgaggatatcagcctaaaaactgaatttctgttagggaaagagtaaaaagaaaaggcaacggggcccagaactgagccctgaaggagctccaactgtaagaggccaggaggaagaatgagagagtaactaactggtagtgaagtaaacagagaaccaagagatgctttctagccatcatcttccaccactgttgtttcataacatggattaagaagttggggcattaaagttactgcagagataacttaaaaaaaaaaaaaaaaaaaaggaaaagttggcattatattatcctgggatttgagatcctgattagctgggattataggtatgtgccatcacatggctaatttttgtgttttttgtagagatggggtttcgccatgttgcgtaggctggtctggaactcttgagctcaagtggtccacctaccttggcctcccaaagtgctgggattataggcatgagccaccacaactggccaattttcataattttcaagcacaatttgaagtaattaattattcaggctgggctcagtggctcatgcctgtaattccagcactttgggaggccaaggcaggcagatcacctgaggtcaggagttgcgagatcagcctgtccaacatggcaaaaccccatctctactaaaaacacaaaaattagctgggcatgatagacacctggtaatcccagctactcaggaggctgaggcaggagaattgcttgaacctgggaggggggagtttgcagtgagccgagatcgcgccattgcactctagcctgggtgacagagtgagactacatttcaaaattaaaataaaattaaataatccatctcaaggattactaatcctgtccacacatgagttaaatatggaaagctgtgtccaataacctttggcctatgagcttatttattaaaggagaccaaaacacatataaaagaagtttaaaaaaacagattcaggtgaatatccacttttctgtacctttataaccacgtgatttaaatgatggaaagtaattacagactgggtgcggtggctcacacctgtaatcccagcactttgggaggctgggggcggtggtgggtggatcacttgagaccaggagttcaagaccagcctggccaacatggcaaaaccctgtctctactaaaaatacaaaaaaagtagccaggtgtggtggcgtgtgtctgtggtcccagctacttgggaggctgaggcaggagaatcgctttaacccgggaggcagaggctgcagtgagccgagatcatgccactacactccagcctgggcgacagagcaagactgcatctcagaaagaaaaagaaaaaagaaagtaattacaaactattcattcagtcctttcaaatatataaaataggagagaaaccacaaaggcactggaattaacatccaggacattataaaacaattactattttaaagtcttaagtaccagcaagcctttcagggtagctaaattaagcctatcatgtcagatagttattacccagcttaatctctggtgattagaataaggcatgcagtgttgctaccagatccagatagaaccatagcattatcatttacaacttcttttcctaacctcgattgccttagaaaaggaatcccgctactggaattgtgtagctttaatctgaggggaaagaaagcagagtgacatgaatttaacattaattaaatattttttctggaagagttcatatgagtataatggggttattcagaatagacagagtaagaaatgttagaccaggtgcggtagctcacatatgtaatcccagcactttgggaggccaaagtgggtggattgcttgagctcaggagttcgagatcagcctgggcaacacagcaaaaccctgtctcaaccaaaaatataaaaattagtcgggtgtgatggtgcgtacctgtaatcccagctacttggaaggctgaggtgggaggatcacttgagcctgggtggcagaggttgcagtgagccaagattgtgtcactgcactccagcctgggtgacagagccagaccctgtctcaaattaaaaaattacgaaaattaatatagcaattttatcttgatatctttttacattggtgacagctatctgaagatttcatccagccagacagagcagaactctttctcacttttgcaggtgatcctttccatgatctggtagaagaaagctaaattcctatttatattgaaatgaggcatataggagaatctactggaataaagaaagaaaatataagaaaatgagtttaaaaatttatttttgaggctgggtcccactctgtcaccaggctggagtgcagtgtcgcacacaatctgggcttactgcaatccctacctcttgggctcaagcgattctcccaccttagcctcccaagtagctgtaactagaggcatgagccaccatgcctggctaattttttgtagagatggggttttgtcatgttgcccaggctggtctcaaactcctgagctcaagcaattcgtcattctcgacgtcccaaagtgctaggattacaggcatgagccaccctacccgccctcaattttttcagtgttataaaaattgactatactgggaaagaatgtggaactggcatagattggaggagacacaattaaatgcactgtgggatcctggattagattctggaaaagaaaaaggacattgaaggggaacaggtaaaattcaaattagttgtacagtttaattaacagtgttgtaccaatgttaatttcctggttttggtagttatgctacagctaggtaaattgttaataggggaagcagggtgaagggtatacgtgaattctgctgtgtttgtaactttcctatatgtctaaaatgacatcagaataaaaaggtaaagcacaggtagttcagtccactgacctagaagctcaaagagtaatgtttgaaaagcatgtatgtgtggcatattgtgttacacactcatagccctgagtagaagtagacttcatggaattttatttgtgaaattttgtttggcaaagaattataacatcaagtgtctgtactatgcataatatgaaacaggagttcatccatatttctaattaattttgtggtagatttgtctttctggtcaaacttactttcttcactgggcagacaaatttagcctgaagaaagaaatggccagataagttgtcaagaaatgatggctacttatatatacagtcacctgatttaggctaaagacaccactacatttattggagaaaggatggtcttttcaataaatggttctgggtgaaattgataagagaaagacagacacctcacaaaagaagatatccataagagaatattctccacattgcaagttatagggaattgcaaattacagctacagtagtaaattaccgtgccccttcaaaatgaccaacattaacgcagttaacagtaccacctattggtatcgatgccaaacagctggaactctcaaatcacggctgggaatgtaaatcacgccaaccactttggaaaactaaagctaaatatacatctaccctatggccctgcattccactccttgatatacgtacactccaggagtgaaggctacacaactcagtcctagatatataccctagggaaacaggtgcttcataaatctgtcgtcagccatgtataaaaatggtcatagtagctttatttatgatagccaaaagttggaaacaatccagatttccaatggcagaatgggcaaaaatgaagcaatcagagatgaaatgatataagcaaaatgggtgatgagaattaactgtactgtgtgtatgcttatatatgtatgtgcatgttttgaagttttgataatgaaaactgagaaataggaaacagcaacaaaaaagaatgatgaacctgaggagggccgcctttcctgatggctctcaacatcacaaactaaggctcatcttgctctggcatttggaaagggcccttggctgcctacctgccctcttcacataccgcagactaacttggcagtctgcacagcttgccggcttgtgcataaagatcctgacagccttgaggaaatagaactacagcagcaggggaagctgagccaggggaaccatcctggccctttattttctttacttttgtattttattttttgagacagggtcttgctctgtcgcccaggctggagtacagtagcacaatcttggctcactgcaacctctgcctcatgggctcaagcagttctcccacctcagtctcctgagtagctgggaccataggtgcgtaccaccatgcctggctaatttttgtatttttagtagagacggggttttgccatgtttcccaagttggtcttgaactcctgggctcaagcgatccatccaccttggcctccaaaagtcctgggattgcaggagtgagccaccgcgcccggcctggctctttattttcatcaatctgccctcccatcctttcaaaaaaagtagcatactctacatcttgacttttttttaaaggataagtaaattaattatttgttttttttttgttgttttttgttttttttttgagtcggagtctgactctgtcacccaggctggagtacagtgctgctatcttggctcactgcaacctccacctcccaggttcaagtgattctcctgccttggcctcccgagtagctgggattacaggcatgcaccaccttttgtgtttttagtagagacagggtttcaccatgttggacagtctgttcttgaactcctgacctcaagtgatccacctgcgtcggcctcccagagtgctgggattacaggcatgaacgactgcgcccgtcctaaatgtttattttcaaggagactttttgcaaaagtacgcctttgtatgtatgagaagaccactagagttggtgaagtcacttggatcatctaggctagccattttactattcttctctagaattgaagaatggatggaaagccatggttattggagttgggaatgagtcacctagatttaacctatgtgaggagcagtgacatttggactaggactaccaccaacccaagacaacctcagagtgggaggcaccctcactctacttccctctttgtgatctcattccctcaccagagggcggagggcaaaagagctgtatgttgatagcccaaacaaatcactgcctgtggcagagaacagggcgttgaagaatggatttggaacagcaccagaagccagctggtagagccactcccctacttaccttgatgttccacctaaccaaactgtgtacatttccctactttgcctacaagaatactataaaaagctctgctagtgtcttactgaaatcgtaggatgttatattagtcagggttccctagagggacagaactaatgggatatatttaaggaagtttattaaggaggattgacttatatgaccacaaggtaaagtcccatgataggccatctgcaagttgaggagcaaggaagccagtgatggatcagtccaagtcccaaaacctcaaaagtagggaagctgacagtgcagccttcagtttgtggccaaaggccggagagcccctggaaaaccactggtgtaagtccaggagtccaaaagcggaagaatctggtgtctgatgttcgagggcaagaagcatccagcacgggagaaagatggaagccggaagactcagcaagtctgctcttcatcttctcctacctgctttattctagccaggctggcagctggttagatggtacccatacagattgagggtgggtcttcgtctcccagtccactgactgaaatgttaatctcctttggcaacgccctcacaggcacacccaggaacaatactttgcatccttcagtccagtcaagttgacactccagatgcattaagcctacagaatcccctggatctgttgaggtcctgtttgccactggctaagaaggagttagatcagctctggtgtccagtattcctcctttcatgctcttaacgtgctcaccggctgcttctccaatgcattttattgttgttgtttacattttaatgtttttgaaatcaggatgtgatttgcaatttagtagagatttagtatgcagattatgttttcccctctagatctctgtcgaaaaaatgcaaagcttttagagaagttgcatgtacaatgaaaaccaatattatttttctcattgacaataatttgttctgccagatctaggaaaagcagtttaaaaaaaccaatagtttggggttcatttttataaaattatttcttattaaatattgagtaggtataaaagaatatttataaaatatttattacccgtagcaaataatggtgctacaagcagttgtgtacctgccaagttggtttaagatatttttgtccgggtgcggtgacttatgcctataatcccatagtgacaatgcccaggcaattgaagctgcaatgagccatgatcacaccactgcaactccagattgggagaccaaacaagactccttatttaccagagattgactaaaggaaaaaagaagttgaaggccaggcatggtggctcacgcctgtaatcccagaactttgggaggccgaggctggcagatcatttgaagtcaggagttcgagaccagcctggccaacatggtgaaacccccgtctctactaaaaatataaaaattggcatggtggagcacacctgtagtctcaggtacctagggggtgaggtgggagacttgcttgagcctgggagacttgcttgagcctgggatgcggaatttgcattgagccaatgttgtcccactgcattccagcctgggcgacagagtgagactctgtctcaaaaaaataaaaagaaaaaagaaaaaataaataaaatagaatgaaccagatgatatggctgtcttagagcaagcaagagagtgggacaaggtgaggcgagattagagaggtagactgctctggaataaagaggaacatcaaggccttgataagaaatgaaggttttatttttatttatttatttttttgagatggagtctcgctctatcgcccagaccggagtgcagtggcgcgatctcggctcactgcaagctctgtctcccaggttcatgccattcttctgcctcagcctcccaagtagctgggtcagcaggtgcccaccaccacgcccggctaattttttgtatttttagtacacatggggtttcactgtgttaaccaggatggtctcaatctcctgacctcgtgatcgccctcctcggcctcccaaagtgttgggattataggtgtgagccaccgcacctggccggagtttttattttaaataagatcggaagctatgaaggctttcattagagctttgaggcacacatgagtttacaaaatagaagttagacacctatatatctataaagtaatacctaattcattatttatataatccagtggaccagaagaacaaacattaaaaaaatctgtaaaccaatatccctttttctattttgaaataatctcttagtataaagtatttactaactttatgctagtttatttacaaaatgcctttgagaagagactgaaagtattcagtggatccactactgattgtcttttttaaagaaattctttttaatctttcggcagacatgtgcattgccattgcgatttctcttctcatgatcctgatatgtgctatggctacttacggagcgtacaaggtaagccgcttgcagtaagatgctggccttttccttggtctcttacatgtgtaatctgtgctgctgtctatagtgagaagtgactttccagttttctgttaagaatctctgtttaaatctctcgtttgtattatgtggtactaggaaaaccaatattatactggaaatttttttttttttgggaagacggggtctcactctgtcacacaggctggagtagagtggtgtgatcttagctcactgcaatctccgcctcccaagttcaagtgattctcccacctcagcctccagagtagctgggactacaggtgtgtgccaccacaccttgctgatttttgtattttttagtagagacgtgatttcaccatgttgggcaggctagtctcgaactcctgaccttaagtgatccacccacctcagcctcccaaaatgctgggattacaggtgtgagacaccacacacagccagtcctggaaatgttcactgaagcttatttgttgactgcttatatttggcatactggtttccaccatgacctgggttaatgaattccaatttttccatttcctttcagattaataaaatactttgaatttaagaaaaatattgttttataatattgaacacattaactttctattttctgttctgtttagcaacgcgcagcctggatcatcccattcttctgttaccagatctttgactttgccctgaacatgttggttgcaatcactgtgcttatttatccaaactccattcaggaatacatacggcaactggtacgtggacctcttactgctccttttcattaattcttttcattagggaagctggttaagtaagggatgtgtagagatacacagacattaatttcaggatttttagcttgcagctgagttactcataggaaatttcttttttcttttttttgaggtggagtcttgctctcgtcacccaggctggagtgcagtgatgcgatctcggctcactgcaacctctgcctccagggtctcagcctcccagctagctgggattataggcatgtaccaacatacctggctaattttgtatttttagtagagatggggtttcactgtgttggtcaggctggtcttgaactcctgacctcaggtgatccacccatcttggcctcccaaagtgctgggattatgggtgtgagccactgtgcctggcctgataaagttttgagggccggggttatgattggtggcagtgatggtggtggttgatgtgcctacctaaattatagtccagttactaatagtcgtatttggtaaaatgtagttttctcagttatcaacaaaggatagctttttgcctttgctagtgtgttgaaagtgggactctgctcaaaaacaaacaaaataattagctgggagaggtggcacacgcctgtgaccctagccactcgggaggctgaggcaggagaattgcttgaacctgggaggtggaggctgcagtgagccaagatcacgccactgcactccagcctgggcaatagagtgagatctcatctaaaaaaaaagaaaaatcaaaagaaagtggaaagaaagtggaacactgctgtatactagctcccaaatttgtttgaccatagaatccctttctcaagcatcattttgggactagtttacggttaaatgtcctttgtgaccatatgagtgaatattggtggcagggtattaagaagcttataatggctatgaggttggaataactttatttatttttgggacagggtctctgtcacccaggctggagtgcagtggtgtgattatggcttgctgcagcgttgacctcccaggctcccgtgatcctcccatctcaacctcttgagtagctggcactataggcatgcaccaccatgcccacctaatttttctttttgtatcttatgtagagatggggtttcaccatgttgcccaggcttgtctcaaactcctagactcaagtgatcctccagccttggcctcccaaagtgctggcattatagatgtgactcactgtaccaggccaactttacttttttttttttttttttttgagacagagtctcactctatcacctaggctggagtgcagtgttgtgatctcggctcactgcaacctccgcctccctgggttcaagccattctcctgcctcagtctcctgagtagctgggattacaggcacccgctaccaagcctggctaattttttgtatttttagtagagatggggtttcaccatcttttccaggctggtctcaaacatttagcctcagaggatccaccctcatcggcctcccagagtgctaggaatacaggcgcccactaccatgcctggctaatttttgtattttttttttagtagaggtggggttttgccatgttgaccaggctggtctcgaactcctgacctcaggtgatccgcccaccttggcctcccaaagtgctgagattacaggcgtgagccaccatgcccagcctgcaacctcaatcttctgggctcaagtgatccttccaccttagcctcccaagtagtttggactacagacatgcaccaccatgcccggctaaatttgtatttttagtagagatggggtttgactatgttgtccaggctggtctcaaacacctgcactcaagcaatctgcctgcctcagcctcccaaagtgctgaaattacaggcatgagccactgtgcttggccaagttattttattaataaaagagtaaagttgcatgatctgatcacaaagaatgacgattttatttcttagatattttgtcccaagtgaaaggagactgaaaaccattaggtggtgttcaccctggtgagcaggagccaagcccatgagtcatgggccttctccatgttcttcctcaacattggaaacaactttgttttggaatattgctcgtgaggaatccaaacacatagtgttgaatggtgaagggagataaaagatgagatagcacagtaggctgccttcccattcacttgcctaggccagtgatgtaggcgttgatcaatgctgtgtgagtgttctgtggggaaagtccggcaactccctctaaccatagtagcagactttgatcctcctgaaaaggttccctttgacctggttgttaagcattgtggatggtagtgcttgattatttccccccaccctggaagtacttgctagtataagagaatatgctgtcttgggagaagtaccatcaacaaaaatgctctttgcaaagaagacctcattttagtaggtttctgtcccttgccctgcatatgccctttagaatggttcagaacttttgagacatggtctggctctgtcgcccgggcggctggagtgcagtggcatgatctcgctcactgcaacctccaccaccagggctcaagtgatttgctcaccccagcctcccaagtagctgagctgggcgacagagagaaactccatctcaaaaaagaaaaaaaaaaaaaaaaggaatggttcagaacttgcagagaatacaaatttcagagatccctggatatacaaaatgtccctggataccgatcactgacgtcttttatatggtaagagggcagagtcaggctagaaattttgtattggttctaaataatagctgtctgctttaatcagttgctttctgataagcatgtctgaattggtgcccaaggaatactgtctggaatgattaatgagatttgctaatgaggcccttttcttttgcagcctcctaattttccctacagagatgatgtcatgtcagtgaatcctacctgtttggtccttattattcttctgtttattagcattatcttgacttttaaggtaagcatgaagattttacttatagtctaaaaatattaagtgtattcctgaataccaaataagtaaacaaactttggtcagtttattgtctttctttggacatccaaattgctttttgatttcctaagattacaattctttatgctgtctatgttggaggtaaacactaatcaaaattccacagtttgatcaaggagtccaaaatatatttggacagagataagttaacataatgttatacattacatagtatatgatattgcaacgtctgttacaaggtctgtgtaatggatattcttttgtaattttttgctaaaagtgtaatattttctgaatattgttctatctcaatccattatatgaatatcattatttaataaattacttgatgagcattgagacattttttactttttcacttaatagggctgtagtgaatatatttaagtacatccttatatttatgcatttatctcaagataaatttcctttttttttttttttttttttttttgagatggagtctcgctctgtcgcccaggttggagtgcagtggcgcaacctcggcttactgcgagcttcgcctcccggcttcacgccattatcttgcctcagcctccccagtaggtgggaccacagatacccgccaccatgcccagcaaatttttttgtatttttagtagagatggggtttcactgtgttagccaggatggtctcgatctcctgacctcatgatccgcccacctcggcctcccaaagctgggattacaggcatgagccactgtgcccggcttcaagataaatttcttaaaatcagggtgttcatggttggaaagcctttgataggttgtcaaattgatgtcccccaaagttaaatgacttctacttcctgcagcagtgcctcacccttatcaatcaattgctgcaaattctttttcatcttggtcaatctgtttataaaaccatcattataacttgtgcttatgagctactaatgggtagaaaactctcatggctctttatgctttcaacttttttctttttttatttatttttctttctttcttttttttttttttttgaggtagggtctctccctgtagtctaggctgcctcctgccttggtttcccaaagttttgggattacaggtgtgaaccactgcacccagcatactttgaatttttgaatctcaatgcctttcattgtcttaattttggcataaaattatgtcattcttcaaaaatcatgcctcagtaaacttgggaaagctgcattgaggcagaaaattcatataggtactgtgatgaaaaggagtagaaagaaagtggttcattggaaaccagttggccaggtgaaatggctcacacctgtgatcccaacactttgggaggctgaagtgagaagattgtttgagctgggagtgtgaggctgtagtgtgctatgatagcagcactgtacttcagcctgggtgacagagtgagaccccgtcttgttgttgttgttgttgagacagagtctcactctgtcacctaggctggagtgcagaggtgcgatctcggctcactgcaacctctgcctcctaggttcaagcaattctcctgcctcagtctcacgagtagctgggactacaggcgcctgttaccacacccagctaatttttgtattttagtagagacgggtttcaccatgttggccatgctggtgtcaaactcctgacctcaggtgatttgcctgcctcggcctcccaaagtgctggaattacaggcataagtcaccacacctggctggggacaccgtctcttaaaaaataaataaggccgggtgtggtggctcatgcctgtaatcccagcactttgggaggccaagacgggtggatcacgagatcaggagatcgagaccatcctggctaacatggtgaaaccctgtctctataaaaatacaaaaaattagttgggcatggtggcgggcgcctgtagtcccagctacttgggaggctgaggcaggagaatggcatgaacccaggaggcagagcttgcagtgagatgagatcgagctactgcactccagcctgggcgactccatctcaaaaaaaaatagtgaaatgttggggtgatcagacccaacaccaggtcgtgggggttgtgaagtccggcggagtcagaggaatgagacaagacaagagtacatagagtgggtccaggggtccagtgccagtttggaggctgcgaaggccctgagctctgggagtccacactatttattggtaatcaaacaaagaagcaggtagtgaggacgtgtggatgtaggggtggacaggtgaggacgtgaggatagaaaggtagtggtgcatcaagcgtagctgtgacggttttgcatatgctctgctacttgagataagggagaacaggttcttctaattcgagatgcaatcaatttgtgatcttgggagagcaaggagcaaggggccagcgagtctggatatattccacaggctacaaggggttttatgctctgggcttagattgtagtgcggcagggcagccttccaccctttggcacagagcttggtgttccataggccacaaggggttatagaccctggacccaggacatgttccaagacacttttaccttatgtcagaagccctgcctcagcttttctgccaacataaataaaaaaataaaaacaaaaataaataaataaataatgaaagaaaatgaattgagtctaaatttccatcataaaacaccatgatttcatgtgtcattcagcagttaaggatgggagtgaattttacacacggatgttgggccttactgccttgcagctccagctcctccgctccagtttcttggctggtatttggccccacatgttgtcctctgacctccaagcctgtgaggctagggctgcctaccatccaggctgcaggcagggctggcagtgccccctggtgaaaggccacagactcacatctcactcattgtagttcgtctttgaagggtagactccccttttgacttctgcttgtttttggtcagtctcccatgacttaaaatttgtgtgtgtgagtaatttttctagattttataaatcttacctgcaggaaggttagtctgaccaagctaactctgccattaccagaaactcgaagctaggacctcacaattatctttaaaaagactttttaaatcttttaaacattttcacttgtacttatttgaaatgcccacatcacattttgagtcagaggacctagggttagcttctgtcagtatgacttctattttatttatttatttatttatttatttatttatttatttattaaggcacaaccatgttcatcattactagtcatatggtctaaattagcaaaaccatagcagaataaaatatactactcattgatgtatttatacagacattaaaagatatttttgaatgcacttaattttttaaaaaaattttgtgggtacataccaagtgtatatatttatggggtatatgagatattttgatacagtgcagaataatcacatcatggaaaatcgggtgtccatccccttaagcatttagtcatactcttttagttattttttttatttattttttttgagacaagagtgtcactctgtcacccaggctggagtgcagtggtgtgatcccggctcactgcaacctctgcttcccgggttcaagcaattgtcctgcctcagcctcccgagtagttgggactacaggcgcctgccaccatgcccggctagttttttgtatttttactagagacagggtttcatcgcgttagccagggtggtctctatctcctgactttgtgatccgcccacctcggcctcctaaagtactgggattacaggtgtgagccacaatgcccggcccactaaatagttctaattcaatattgcagaagtgtgaaataagaaataaggtcaatgaaagaagtacctgggcttttcaagacagcaggtcgaggtttttccccttttggagtgtgtagtaggtgaatgcatgtggccttgcaaaggcccttgagaatgcctattctgggcattccatgcgaatacaatcatcatacaatatggtttttttttttgttttttttttgttgttgttgttgttgttgtttttttgagacggagtctcactctgtcacccaggctggagtgcagtggcgcaatctcggctcactgcaacctccacctcccaggttcacttgattctcctgcctcagcctcccacatagctgggattacaggcatgcatcccaatgcccggctaatttttgtatttttagtggagacggggtttcactgtgttggccaggctggtctcaaactcttgggttcaagtgatccacccacctcggcctcccaaagtgctgggattacaggtgtgagccatcgtgcccagtcccattattattattatttatttagtttttttttttttttcggagatggagtctcgctctgtcacccagggtggaatgcagtggcacgatcttggctcactgcaactgccacctcccgggttcaagcaattctcccgcctcagcctcctgagtagctgggactacaggcgcacgctgccacacccagctaatgtttttgtattttagtagagatggagtttcactgtgttgcccaggctgttctctaaactcctgaactcaggtaatccaccagcctcggcctcccaaagtgttagaattacagacgtgagccaccttgcctggccccgccccattatttttattgttgttaataccacattgtatggatggtgccacattttgtctatccattcatcagttgagggacatttgggttgcttctactttttggctattatgaataatgctgctgtgaacattcaagtttttgtgtggatgtatattttcattttattcggtatatattatatatatactatatgtagaatacctaggagtggaattgctgggtcctgttgtaactctgtttaacctttcgaactgccggacttttccagagtggctgcaaccattttacattctcataagcaacgtatttcctggattttagcaatctagtttctctatgtgtttaaacttcttttaatcaaagaattttaatgttaagggattttgaaatcctttagttctaatccaattacacatgatggaatgaaagtacagagttcatagcttaaacatctcccgtgaactcatgtttcatttctaagcagtatttatgttggacattaattttaagtatcgtcgtcggatatttcgttaataaaggggaaatgttttagtgaattttattgactgtgagataaatttatatgctatgaaatttttaaaaaaatcgacttgtgtaataaaatcacagataatcatatagaagaaaaatttccaaagaagcagttaaactgtggcaataaatgagttaatacattcgattgttctgtgaattcaggagcgataatgttaattgtgtgcttgttctttccagacacttattcttagaaatttctcattcaactctcatccctcccctctcccaacttcccccagtaccacccccatacccccattggtgtaatagaatacggctccagtagcacattgtgccaagaagttactatacccaacatttgtactttcagggacttttggtttagtagagctgttataatatgtgcatttattgcttatgtcaataaaagttttataatatggctttatctgtgtggtattctaaattacctgcagtttgaaaattaaaaatctgataatcactcctcattttcagggttacttgattagctgtgtttggaactgctaccgatacatcaatggtaggaactcctctgatgtcctggtttatgttaccagcaatgacactacggtaggtatgatgtcacttatggtagagatctcgcccacacctttactgtatgctgatctttaagtgtttctagtgtttgctacatttttattgttactgaaacatactcatgagctgcttagttatcaaaagattcatcttagttatcaaaatactcatttaactatgaagttaaatgtattttgtttttcttacaggatattaaaatgtagatggctcaactctggtttattttaaaatgtattacagatagataatatatgtaccttactgtaattatttatcttaaacctgcattgttaaaccatggtgtataattctagatatcgcttctgcattgtatgacattatattaactcactttatatgtgaagttaaaccaagatgcgatgtttacaggtaggtaaaaaagaactgcaaagttactatgtctttgtaatttatcttatgtatgtattcttagtaaaataatttagatgatctctgttctgctactagttgctcatactttaaaattgcaaacctgtcataaaagatttttgaaaacatgtcttcactggaagagtccatgaaaacatatgcactttatgtaaattatcttgaaatttcctggctcatggtaagatgaaggtataagtcctcatggtgtctctgtcgtcactgcctgatgtaatgcacagtaccaggaagtgctccatgcatggttagtgaaaacgatggggatggatgacatgtaactgtgtggcatgggacaggatgggtgggtcaaaacggataggattggactggacgggtgaaaggaacacataaatggtaggacgtcaaatttatactagagtagagttttgtgtttttggttttttagtttgcttgtttttttctggtgacttgctcactctgaccttaccgaaataatccagcctgttccttactttactttcttgtgtataaaatgagactaaaacagttacagactttgtattaaatatatgggtgtaggctactgtattactgagaactctgtgtgatagctaaagcatgttatacactgacagttttcctaaatgctcaccacacatttcttgagttcaatcaaatatgcatgagcagtggtttaatagacagccatgaccagatgcacaaaacctggcatacccaggtgctgaggaggctcgttttgggagtctgcagaattctgtgtattgattacagtaatcacgtgttctgctcaacccctttaaaatatcactcctgggtctgtaactctctttgaaagaaatatctattcaaaattttcgtgattttgataaaattactggcttaagaatttttttccttttctctgagttgttgggtattttttcatttgttttacccattaactttttttgttcgcccaggctggaatgaagtggtgtgatctcgtctcactgcagcctccaccccctgggttcaagtgattctcctgcctcagcctgccgagtagctgggattataggtgcccaccaccacgcccggctaatttttgtattttcagtagagatagggtgttgccatgttggccagattggtctcgaactcctgacttcaggtgatccacctgccttggcctcccaaagtgccaggattacagatgtgagccactgtgcccggcctgttttacccattaacttttgcagaaggcaagttgttgtttagccatctataaattttttctttttcttaaaacaaataaaaagtccataattagtgttctactgaactaatgaaaaatgtaagcaaggtttgagatttttaagtttgaagaaccagtaaagttgttacacaagatacatcagaacctctttgtaaatttcatggcacatagggcttataaagccaccatcttttagaagtatctcagagcagagaataatacccatattgcatgtgcttgttttgatatggtggtgttatgaaagaggaggcgatacataggttttcatccacagttcctggctcttaactcttcatagccattgttagtctttggttattaccctaggtgtgtcaggtcttagggaatctctgacttacttctgcactaaggcaggattctaatcttcccccttcctttctaactgtgggtcttaagaccttccctaaagagggtccagcctcgtaccctgagggaaggaatgctgactgtccttaggaatgctgaagcttccttagggatagctgaactcctggaggttccttgagggtggtacacccaggaagggcttggaagctccatgttccttcccccatatctatgaatctcttcatctgtatcccttgtatccttataataagccagtaaacctcagtaagtgtttctgagtccaaaatgttatgggaacctcaacttgaaggctggttggtcagaagctcctgaggcccagacttgcagagtgttggagtggggaggggacacttttggggattgagcccttaacctgtgggatctgacactgtttccaggtagatagtattatgtgcgcatctaagcgaagagacaacctgaaaaggctaagtgtgagcaacaaggctgtttattcactcaggtgcgagcgggctgagtccgaaaaagagagtcagcgaagggtggtgggattggagctagttttataggttaggggtaagcagtggaaagttacagttaggggccgtttattgcgggcaggggaaggggtcacaggcgggaagggtcacagggcacaatgtcacaaggttgatcgatcagttagggtagagtctgttacaatggtagaatgttgcaaggttggctaataagctaagacggcagctagctgtttttcttcttttgtggttttcctgttgtcctagactttctggctccaggaggccttctggatgtatacgtgtgggtcacagaggttacaatggcttgaccatggtgcagctttctcagaagacctcacattcctggctttttatattaataatggaaaaacaaaaatgagaaagagtagtgaagtatggagaaaatttatggtgtaaattttgggggtggtatggagggatgatgggagatttttctcagcgctgcttcaagcgggattaggggtggcgtgggtacctaaagtgagagagaaaggttaaattgaagggagaccctggggcagggggtgacattgtcgagttgttaaaaggagcatatgtcgaatttagtgattagtaatagcttggatgctgttttgtatgaacagagagattagcctgaaaagacaaggtccgaataagagaaggagaaggatgagtgctaaagggcctgttagtgggaggagccatgaagctaagctagagaatggccaagtaggtccagtataactatctgcctgattagtgagtttttgagctctgtctttaagttttttgatattgtcgtatacaaggcctgattgatttacgtaaaagcagcattcttcatttaagaataggcagagtcctcctttttcagcagtaagcagattgaggcctcagcgattttggaggacaactgcggctaaggaatcgacttgggattggaggacagaaagtgagttatatcggtaaggctagcggagaagtcattggagagactgcgaaatgtggtgatagaagttgcaaggcctgctactcctgttccgattgcggcagtggaaactcctaatcctataagcaagggaattcatcgaatgactcttttttgtcttgttggagttataaggggaatggggagttgctcgcttccgtttgcaaactgggttttgggagtaaggaagatttaaagtgcaggtgcctgtccggttagcagggaggcacatgtaggtggaagagctgcagaggaaaaagagtccttgaggcaggcagaactggaaatgcagagtaaaaaggtaagagtgtgttctggaagtggggtcctgcacccagacccctagggatccagcaagggtagcagctgttagaggttgtagcggggtttggtaggggagctgcgtggagggagaggttctattttcatggtgtataagaaagcgcttggtatctacaagtagccattcactgttatttataagactaggtataagcaggcaagaagaaggacttggaggggaatctgttgaacgggggagggtagccaaagatcgagcaagtgagcggtaagcgtctttctagacaaaagttgctaccaatgttttaaagactgtttgtgatgagagtgggactggaatgctccaattttctggttgatgtgagtgttggggctttggaggtgaagagtaaaggaacataaggaagacgggaggttacctaagggaattccagtaggtaattgttgggagatgcataagggagcagcaatggggatagttgtctgtgtagcgaggtgtccaagaacagggggtgtggaattgatgtagggagatagacctcgtaggtaggtagggagaagagcagcagcctgttagtatgagatattgggggagtttttgctgaatttttcttttctttcttcttttttttttttgagacaagagtcttgctctgtagcccaagctggaatgcagtggcacaacctcgctcactgctgcctctacctcccaggtcctggttcaagcaattctcctgcctcagcctcctgagtagctgggattataggcacgcaccaccattcccagctaatttttgtatttttggtagagatggggtttcaccatgttggccaggctggtcttgaactcctgacctcgtgatccacctgcctcggcctcctaatgtgctgggattacaggcatgagccaccgcgcccagcccctgctgaattttccagaaagtgaagaagatgttcgggagggtaaaggtgtgggggtcactgaaagaggtttggaggtgtaaggagatgggggaggttgcctagtcagctagtagggcagggacagctgtgtagtaggaggaagagagggaaatgcatagccaacaattttttgctaagaaaggattagagacggtgaggagagagtgggtgggtgaggttgatggtatgttggagataattagggaggggtagagggtagcaggagaacgggagtgagacccaaagtgagtagaaaagaacttcatcgaggtggaagaattggagagtgccttgccacacaaggtcacctatccactctaggagagagttaagggtggcaccttgagggtgagaccaggagatgtcagttacaatggtccagaggaaaagcgtgagccggcaatgtagacaaaagcagggcatttagaagtaggcaagaatggtgattagggacctaggtagacattaagtagtggggtggctatgtaaaggcctattgtaaatgaaagatacaaagggctgttgttctttttcaggaatgcgagtaagttgaagagaagtgggggagagtacttgcgacttccagaaggaggtagaggagttaggctggtggtcagatgggcacagttttatcctggagcgatgaacccagtggggaaggttctgtagacggaccgtggttggagtgctgtaaacaacctggtagggttcctgtccaccgaggttgtagagtttgaggggttagttcttaacaagaactgaccgtcgggctaggatgtctttatatggctgggtatctggagtgggtaaaaggaaattggcagctcagcggatttcatgtctagcttgttgaaggactggaagatagttaccaagagggctggtgtctggaatgaggttgggcccatgtaaaaatgtgcggccatataggagatcaaaggggctataccctgtgggttcttgaagggtggctcaaatttggaggagagcaaagggtagaagaattgtccagtcttttttgcgttggagggtgagtttggtaagatgtgtttttaaacgactgttggccttttctacttttcctgaggattgaggatgataagggtcatggagattccactgaatactgagggcttgggaaactgcttgggtgatctgactaatgaaggctggactgttaccagattgtacggaggtaggaagaccaaattgaggaattatgtcagttaggcaagaaatgcctgcagtggctttttctgtccctgtaggaaaggcttcaacccatctggtaaaggtatcaacccagactaggagggtttgaatttgcagactcggaacataggtgtgaaatctatttgccaatcttttgtgggggtaaatcctcgggcttggtgtgtgggaaagggaggggattttaggaagccttggggagtagtagagtggcagatagaacagtgagatgtgcttgttttgagaatgtatttccataatgggaaataaatgaggggttctaaaagacaggtgagaggtttgtgtcctacatggaagtggtcatgaaaggaagaaaggatagagtgggcttgtgaggcagggagaaggaattttccatggtctaagaaccacttgccttgagttggaaaggactggtagaacaggttttcagaagaagaataggtgggagtgatagatgagaaagacaagtattggctgtctggagcggagactggaacgtgtgcaggcgctgaggctgcctctttcgctgttttgtgggcgcagacgtttccttgggcagtggggtcagatgttttttggtgccctttgcagtggattactctggctttggctgtaaggagggcagttttaaggagagcctttattagacccagctggtgcctgctgcttgttggtgggagaaacccccacgcctttggtcacaggagccttctgctttgattgttgtggtatgagagcagaggaaaaacacagcttgagagctttccccaaaacaaatatacttctagttgtttttttccagtagaaattttatagaaattagggtgcttagagaatttaagaaccatgagtaagtcccccaaatgcatcctactagctttttggagaaaacttctatttttcccctttgaaagacacaaaggtatggaataacaggtttgtttatttaggcttagttataaaatttatcaaaatagctacacttttcaactgcacgttcccacctcttctaacagtgtgcctcttttcttcagaagggctaccaggtgggcagtagtttgtggtagctacatttgggggccatggtcgaatgccagctgcgtttgtttcctggtgtgttgacatacatgccgggaaattgcttggtagcggttggtcagtctctgtcattttgtaacaacttgccatttttaagatgaggaaactgaggtactgataatgttactattttcccacagttcccaatgagccattttttaaaattttcttctgaaagaattatattcctggaaaaggtagatttatcttttctcttaacatagttgtattgatataatccactccgaaatatcagggtagaccaccagttgaagtctcagctttctgacgatattttttatttatttatttttattttattttattttattttatttttattttattttatttttttgagacagagtcttgctctgtcatcaaggctggagtgcactggcgcgatcttggctcactgcaacctctgcctcccaggttcaagcgattctcctgccgcagccttctgagtagctgggattacaggtgcgcaccgccacgcctggctgattttttgtttttagtagcaaaggggtttcaccatgttggccaggctggtctcgaactcctgacctcaagtgatccacccacctctgcctcccaaagtgctggggttacaggtgtgagccaccgctcctgaccttctctgacaatattttgttaaaagatatttacaaaaacaaaatggggccaggcacagtggctcacacctgtaatcccagcacttcgggaggccgaggtgggtggatcacttgaggtcgggagtttgagaccagcctggccaacacggtgaaaacccgttactcctaaaaatagaaaagttagccgggcgtggtggcacatgcctgtaatcccagctacttgggaggctggggcaggagaatcgcttgaacctgggaggttcacttgaacctgggaggcagaggttgcagtgagctgagattgcgccattgcattccagcccaggaaatagcagcgaaactccatctcaatcaattaatcactcaataacaaaatggtattgttattttttaattgttattttttaaagagttattattttacctaaaataataagtttctaatcccataaaatatccagtaagtgctcaggtttccagttgtgtcataaagggataattttctagcactttatttgaaacaggatatatgggtcaatatgtagtttgtctttataattttttgttgaagaaattaggttgtcccacagtctagatgattctgattgcatgcctctcatgtagtcttctgcattaccagcgaattatttggatctagaggctttttgtgttcagatttgcctgtttgttttgcaagactacttcataggtgacgattttttcttccattaggaagcaaataatgtctggttaaccatctttttggaagtcaagaaccattgatacttaatacctagatttattgatcattagggttgcaatatgatctataattcctatttcatttattagttagaatatttgtataaagagaagctttccctcatgtactatttggctacccattgtatttgtgacatggataaatatacgtggttttgttctctttgtcagttttcaaaataatgaactcattcctcattctctagtggtgaccagtaaggttgttttaaagtaataaatgaaccgatgaaaactcgcagtggctcacgcctgtaattctagtgctttgggaggatcactggaggccaggagtttgagaccagtctggtcaacatagtgagacccctgtctctacagaaaaaaaaaaaaaatccaggtggcatgtgcctgtagttctagctacttgggaggctgaggtgggaggattgcttgagcctgggacttagctggaagctgcagtgagctgtgatcgtgccactgcactccagcctaggtgacacagcaagactctttaaaaaataaaaaagggagcgctattaatgttatgttgaaaagtacaaccattttgataaagtttataagtacgcctaaataaaatttgttactccgtacctgttttcagtctttcaaagaagaaaaataaactttctctgaacagctgatatataatagttaatataattaatgctcaagttgtgctatctttggccacttggagtctcttcaagttggtttctgagtcttttgacatgtccctggttgtgtgtgtgtgtgtgtgtgtttatgtgtgtgtgtttgaagagacagggtctcactcttttaccctggctggagtgcagtggtgtgatcatgcacctgggcctcaaacttaagcaatcctcctgcctcagcctcctgagtagctgggactacaggtgtgagctactgagaccaccctagtagtctttgattgctttcttattgtctggtatgacaagatgctctaggctcatcttgtacatttcttgccccaaatgtggaatgagccatttctccaggcagccctgcctatgttttgtaggaaatgacatctggagaccataatctggatttctggggttagaggacaggctttttgttttggtttcggctttttaaagcagggctctgcatgtttaaagattgtttagaactaaaggagttaatgttaccattatcaattaagaaaaccaaagttactgaagcctccctctgagactctaatgggggttggaatgatctagatctgtcattttccctggtctccatagctgtgttaagaacttcaccatgtgtaataatgtatgtttctcttttgttcacatctttgttgggaatccacatttacataataacatgtcatgtcttgctttcacttattccagatactaggccagatagcttttctcccaggctgaatagtttcaggttgacctctgtggaaagatactgggggctcttgctggtagaaaatgaatgtggtttttcctcctcttctctaaaacagtatacatattattatccagatgtgctctttcccaaaattcttctcagagggaggatagagaagagttgctagatattggagatcattccctgggttaatctctcctccagtttcccagctaaaccaaaccacatactttgaaaggaatgcgtaacgcagaaggtcacaaactctgttcataatgctttagagtcatcccgcccccagcacccttaggccattgagataagtaacataactgtggattttattgagtagtcatgtccaaatgacttaatagtggtcattggggcagtatctaacaagtgctggcacattttccttgaaaatttaaaatataacaaggtgtccttttttgagtctgcagctcccttgggcgggcctgctggtggtgccttggagccccctttcttttagggcagtgttatgaaaatcacatggtgggtgtatattgtgtaataccacactctccactgctgccaaaatttggttataagaggaaaagatttaaatacaaatcctgtagatcaggggtccccaagccccgggctgcacagcaggaggtgagcagcgggcgcgggcaagcaagcattacaacctgagcaccacttacaagattagcaacagcattacattttcataggagcacagaccctattgtgaactgcacatgcaacggatctaggctgcatgctccttttgagaatctaatgcttgatctggggtggaagagtttcatcccgaaaccatcatcacacagccccctcaccccctcatcaaccccttagcaaagttgtcttccatgaaaccagggactgccgatgtagattatggtaataggtttctttcacattaagctttattcaaattaagttttgttttgttttgttttttgagtctcgctctgtcaggctggaatacataggagtgatacatcagctcactgcaacctccaccccctgggttcaagggattctcctccctcagcctcctgagtagctgggactacaggcacatgccaccatgcctggctaatttttgtattttcagtagagacagggtttcaccatattgatcaggctggtctcgaactcctgacctcaggtgatccacctgccttggcctcccaaagtgctgggattacaggcgcgagctactgtgcccggccataaattaaggttttaaaaagtatttcttaaacctatgtgaccttgtttactaatactaataaaggcccggatggtgataagagccagtattatgttaaatctaaatgtagggaacctgattcctctggagttgtggcactcaaaaagcagtgaggttgatatttagccaaaatggtatataagaattctgattgcagataaaagaatcatagtcttggctaatgtaggaaaattcctatttagggaaaaacaggaaaattgttaactccatagtatttattatgccatgtcatattgtaggctcttatccagattaacattatatgcaaacttattgttttaacttcaaaaagtattttgctatgtgggggccttcttttgcatctaactgcttgaaaaacgcaattgaagaaaggtgagtgtggcttctttggtttcagaaaataagtataaagagaaaaaaaaatatatatatataacatataaggtgagtgatgactggggcaaaggccagattatcttctcagtgtccttttctcaataaattctctttgaagcacctgagattaattaaggctgaccttgggttgtcaaaaagccacaaaacaggtattgcctgactaagggggaatgggagtggagtcagatttagtagtggttgcaatgactttcaaaaattgtgcatgaaaaatttgatgtttttcctcctgccacttttttttttttttttggagacagagtctctgtcgcccaggctgtggagtgcgtgggtgtgatcttggctcactgcagcctctgcttcccaggttcacgttattctcctgtctcagcctcctgagtagctgggactacaggcacatgccactatgcctggctaatttttgtatgtttattagagacagggtttcaccacgttggccaggctggtctgaaactcctgacctcaggtgatccacctgccttggccacccgaagtgctcctgccacttttaaaagcaggttattacttccgagtatagtttggatatggttagaaacaagttcttgactgcataatgagttctgttttttttttcccttcataaaagtcataattaactttccaaaatggtttgaagaaggctttgcctaagcgtagttactaggttggctattaatttagcatccttttcagtcctgtacgcaccaaattcaggtacattaaaagcagctcacaacgaaacagtttttaccactgtcatctgcgtaaatgaaccagagggcccaggggacggtgagggtagaaggggagagaaagaagattcttcaggaattggactggaagagtttgaaactctagcctgtcattattggctttcaagcttcttgcctactaagtttagaagagagatcttattactaatatctcaattttaggtatcacttttcccttataatttagtaatttatataatctctccaagcattttcttttcttttgattttaaaagcccaaaacaaaagtgacaggttgatatggaatagatttggtaaaattgcaaataagctgagagagcactaagagactgtttccagaggcagggttagaggcagtgaaggtctggcccagggcaggagtgctgggagtgagccaggcagatgggagagctgtcagaggtagttaatagtagatcattgagggaactggaatgacaggagctttcttgtgtgtgactgtcacttaacatatacaatcacacacttgcagggtagggtaacaccttgaacgtcatctggcccagccatcatttgatgccctcatttcctcaacagtgtgcccaccagttccatccagtgagggttgagtgactgcattgatgctgtactcctctctgcatctcttagacctccctactcttgtgtttgtatcataggtttctccgcagacatgtggcagttgccgcccatcaggccttgtgccgagtgctttacatagattaactcaatcacacaagagtccttcacgtactaggtcctattaattcctgtgttgcaaaagaggaaactgaggcaccaagagggtaacttcccgaggtcaccctgctagtcgagtggcaggagggggactacaacctgatcagcctggctgcaggctgttctgacccactcacctcctcctaactgttgtccagttgggactgcagctggggccaagtgttctcaccgccgtgtctggctgtattgcccaggatgaggagtgaaacatgtggacactttttcattcagacagttcttctcgagtacagtcagaaactttaaaagcagtgggattttctggtttgttgttcgtttgctagtttttaccttttcacacagtggaagggaggggtgggtaactcagaaaaggggcggaagaaaaagaaagggtaaaagtaaattttgcataccagggcagctgcttatctatatagttgtgctacacagtcctgcttcccataccccagtccctgcattctcccgatgttgtcatatgcgcatacagcttcagatagacttacctgttggttccaatatcaaagcatcatgggtgagattggactacatgctcctgagatttttctcccaaaaccttttccttggctgtaattctgaggttcaggctgacagtatgtgacattaactcggctcctatttctttccttctgcataatattcttccaacaattttttttgttttgttttgtttttggtgagatggagttttactcttgttgcccaggctggagtgcaatggcgcgatctcggctcactgcatcctccacctcccagttcaagcgattctcctgcctcagcctcccgagtagctgggattacaggcatgtgttaccatgcctggctaattttgtatttttagtagagacggggtttcaccatgttgcccaggccgatctcgaactcctgacctcaggtgatccgcctgcctcggcctcccaaagtgctgggattacaggcgtgaaccactgcgcccggccaccaacaataaaattttaaatgtcccggtctgctggaaattatctccgagccatataactttccagttgtttcatcccagagcaacattcgagaagactacacgagcacttgtaaacgttaggaggctttgcatctgggggatctcagagtgtgtttgagaggacatctagagcagtcagatcaacacatggatgtttgaaacctaaagttcttaaagctccaaacaaacctagttttcgttgtgaaccattttactataaaacacacacacaacttatttaataacgtgcctcagagtccatattgattttactctagggacaaataaggcaaggaattttatatttttacattgtaggaaaggtttctgggaatgtatttccctttccattattgcaagggaggtggcagggaaggatgtggagtaggggaggcaggtgaaatgggagtctgagatccaaggtcatgagcagtccctgcatccctcctttttcagcccatgttctgtggcagcagctgggcatggtgggattgtatccccctggaacggttgttgtcgtgaaggagatgtgtacagtaggtggcgtagcacattcaggcttcaggaacatgcagaggcagctgctgagatgcctttgataggattaccgaggtgatagcacactgcttatttcatttcctcaatatttaaatatccagtatttacttaactattatacttcagtgtgtagaaccattttaactttcagtttgggccactgtattggtattttataatttttggacccaactgaaaatatttgcggtgtgaattctgtattttgagtacaatctgtatcaaataattcagatagctcctttgctgagaattaaggataataatggctccctcctattatgaagtgaagaaaacagagtagttttgcagtaaattgaggataaaaatctacctctatcttgtttgcctttggaaacaattccttgctctaggtgagaggagagtttctcattagaactcccaaaaatgtgtttatattctcatctcccgatgtcttaggttcactgaagacaagatgttatcacttgtcaatagcactattattttaggtacctcttactgtgaggtactgttacaaggcacagccaaaattattattattttttaaaattaaaaggtaaactttaatgttgaaaatgcaaacttggggaagacagaaaagatcacacacaaggctgtcacttcacacttagaaggttgcacagcggccgggcagaggtgctcctcacttcccagacggtggggcggccgggcagaggcgctcctcacttcccagatggtggggcggccgggcagaggcgctcctcacttcccagacggtgggtagctgggcagaggcgcttctcacatcccagatggggtggcagccgggcggaggccctcatcacttctagacagttggtggccaagcagaggtgctcctcacttcccagacggtggggagctgggtagaggcgctccttacatcccagatggggcggcggctgggcagaggcactcctcacttcccagacagtggggagctgggtagaggtgctcctcacatcccagatggggcagcagccgggcagaggggctcctcacttcccagtcagggtggctgggcagaggcgctcctcacttcccagacggggcggcacagccaaaattctgagatgttaagatgtacgaaaatgtatactttagaataaaaggtacagagttgtgtgtctgtgtttacttatagtatatatcataggtggggcatttaaaaagtttggaaaaattattctagatatctttctcttttttttgagatggagtttcactcttgtcacccgggctggagtgcaatggcacgatcttggcttactgcaacctccacctcctgggttcaagtgattctcctgcctcagcctcccgagtagctgggattacaggcgcctgccatcacgcccagctaatttttgtagttttagtagaggtggggtttcaccatgttggctaggctggtcttgaacttctgacctcaggtgatccacctgcctcagcctcccaaagtgctgggattacaggcgtgagccactgcgaccagatatcttaaagataagcccagactttgtatttctgattattcgatcccaaatgcccaaataactctgtgagttattccagttactcacagaggttcataattcacttatctccccttccctgtttggcttaagtaaaggaatctcacatcaaaacaggcaaatgtggcgtgaccaatttaagataaatatttgatgtaaacactgcacattttaaacaagatgcattataggtgattgggggttttacatggtggaaaagaaaacatattttggctacttgggattaattgaaatggacctttggaagacttaagtgcccttaaataatgagactgcttggagactgtactttctcatctgacatcacatcttccaaggttacaattaagggcagcgcttttccttagtgcaggcaaaggcaaacttatatttcaggttttgggggccatatagtctctatcgcaagtatttgactttctgatgaagctggaaagcagctgtagacagtatatgtgaatgaatgtggctaagtcccgataaagctttacttacaaacactgaattttgaatttcatatgattttcacatgtcgcaaaacatttttcttttgaatttttttttccttcaaccatgaaatgacatttaaaaacttcttagctcccaggccatacaataaaatggtgacaggccctatttggcccacatagtttaccaaccccagccttactagaaatttaggctgagttttctaggcaactgtaggacagctatctgaaacattccagattgttcagtagcccctgcttttggcttggatagatctgaattgaactattccctcctgcaggagggccggcaaacaggagtacctaatctttgtttttttgttgttgtttttgtttttgtttttgagacagagtcttgctctgttgcccaggctggagtgcactggcgcgatctcagctcactacaagctccgcctcttgggttcaagcatttctcctgcctcagcctccagagtagttgggactacaggcgcccgccaccacgcctagctaatttttgtatttttagtagagacggagtttcaccatattggccaggctggtttctaactcctgaccttgtgatctgcccgcctcagcctcccaaagtgctgggactacaggcgtgagccaccgcgcctggcctaatctttggggtttttgtaaggatatctttttcctgcagaagttttagtgctcccttatataatatctttttttttttaaagacagagtctcacgctctcacccaggctggagtgtggtggtgcaaacttggcttactgcaacctccacctcctgggttcaagcaattcccatgcctcagcctcctcagtagctgggactacaggcatatgccatcacacttggctaaattttatattttgtatttagagacaaggtttcattatcttggccaggctggtctctaccttttgacctcaagcaattctcccggctctgcctcccaaagtgttaggattacaggcgtgagccaccgcgcccgcccttacgtaatatctgaattaaaatttacatttggccgggccatccgagaccatcctggccaacatggtgaaaccccgtctctactaaaatacaaaaaattagctggctatggtggtgtgtgcctgtagtcccagctactcaggaggctgaggcaggggaatcacttgatcctggggggcagagattgcagtgagccaagattgcgccattggactgagactccgtctcaaacccacaaaaaacaaaacaacacaacaacaaaaacccaaaacttatatttaacaaactatagtggaaaataaataaatcatttgctggccaggcacagtggctcacacctgtaatcccagcgtttggggaggctgaagcgagcaggtcacctgaggttaggagtttgagagaccagcctggccaacacggtgaaactctgtctctactagaaatacaaaaattagccaggtgtggtggcaggtgcatgtaatcccagctacttgggaggccgaggcaggagaatgccttgaacccaggagacagaggttgcatgagccaagattgcagcattgcactccagcctggggcaacaagagcgaaactccatctcaaataaataaataaataaataaataaataaataaatcatttgcttacaaaacagttgctaaagtcttgaagaatagtagctgaagctgttatttatatagaatgttacctgctgtcatttatacaaagatccattctataaattcctattttagtttactaccagaaaagaaactgacatctcctctttccctttttgtctatctgtgtatatgtagaaataaaaaccttataacccaataaatttccattttgccttatttctgggtgattttaacactcagttgtcttattttgcgtgatgatttttgggggtggggggagcaggatggggagaggggggtctctgtcatactggctggagtgcagtggcatgatcatgactcattgcagcctcaaccctccagggctcaagtgatcctcctaccccagtctcccaagtagctgggattacatgcacgtaccaccacacccagctaatttttcttttttgttgttgttgagatggggtcttgctatgttgcctaggctggtcctgaactcctgggcttaaacgatctgcctgccttggcctcccaaagtgctgggattacaaatgtgagcttctgcatcccgccaatgctgttctaatgctagaactcatttcacaagcaaagaagttcagcagtgagctcatgcttgtggaattcattggtgttaacatgttcccaccatcctgaaacagcttgcatcctaggtctgtagtttccattggggttttgggtacttctagattacgtctcattgtggaggtggggtttcacaagactggaagacttctgtatgaaaacatgtcagctccaaggcaatgacttcaaacagcatggtactcccccttgctttacttagtgtctatactgcacgtgttcaggccctacttccttgtgttgaaagtcgcctctttgacaagttgggttgtttcccaggcctttgcagaagctcataggtaaaagcttgcaactcatctgccagctgggaaggccgaaggaatgggtagtctttgcctgcccacatcctcaggctgaaagcttccccatgatgactgacttcctctttccattttgactgccatgattatctttttatttttaaaatgttgcttttaacaccatattgcacacacatccctaaaaatcatagaatcaaaaggttttttaatcgtcccgtcactccctcccccatcctccactttttcaccccagcagaaagcaccctcaactctttcactcatttcttctgtacttaccttcatatttaaaagtaatagtctgctttgctagttgctgatgatcaatgtgagatgccttttgaataggatgtaactctcactcttccattttctccgctgctttatcctcctcgtgtagtttcatcacattttgcctgcatcatcagctagtgtttactttgcctttgcgaatttatgatattgttcagtgcagagttctgtagtgtacattccctttctcatacaactcttgattttcccaaactaacacttgctttgtttttttttgatcctaagttgtttttttttttaaacttttacctagtcccaggcttttctaagtggctatcaaacctgtcagtttattaatattaactattaataatgctattttccaaaggtttgattctataagacacttcatcagttctctttcctgagacttctcctcaccccgttccaggccagacaaggggccacacagttgtcatctgggcattgatttccttatagctttacctcacccttcttaggaccttgaacagacttatggtgcaattaccttgtgctttatactgcccccacacccagtgttagacctcaaaatctccaaggatggttctttgagggtctcatggaagctctagacaccctccccaggaaaataaacacatagatggaaaatttggcctgcaatttcaggggactggtagatccttgcagtccctttgtggatccccaagaacccatgatcacaatcagcatatctttttttttctttcttttctcttttccttccttttccttttccccccccttccactcccctcccctcccctcccctcccctcccctccccttcccttcgacagggtcttgctctgtcacccaggttggagtgcagtggtacgatcgtgtttcactgcagcctcaactccttgggctcagtcttcccaccttagcctcctaaggctaatttttgtattttttgtagagacagggtcttgctatgttgtccacactgttctggaactcctgaggtcaagcaatcctcctgctttggcttccaaaagtgttggagttacaggtgtgagccaccgcaccaacacaatcatatcttttaacgttttgtgatatatttttatgaatgtctgaagacccttgtgtaatttatacttcatattttgggaaatgtaatgctagcaacagtagaattctaaataagcctatagtgacttaactaatattacagtaaaagttcagttctaaccagagtatccaattttttttttttttttttgagatggagtttcgctcttgttgcccaggctggagtgcaatgcgcgatctcagctcaccacagccaccgcctcccgggttcaagcaatcctactgcgtcagcctcccgagtagctgggattacaggcatgcgccaccacgcccagctaactttgtatttttagtagaaacggggtttctccatgttagtcaggctggtcttgaactctcgacctcaggtgatctgcccacctcagtctcccagagtactggaattacaggcgtgagccactgtgtcaggcctaaatattttctatttttaccaataaatagttcttccctcctgagcattttgttatttattattatttgatggagtgcattcatttttcccaaaaatattttaaaatttaaatagagatggagtcttgctattttgcccagggtagtctggaactcatgggttcaaacatagacccacctcactcaacttcccagactgttgggattataggcatgagctactgtacccagccagtttccccaaattattaatgtcttgtggatttttgcctagttggaatcacttttattctaggatgtcagattttgcaacctttgatttatttctccccccaactgttctatatgttgatgtagctgagaagaatgaagttacctctggtaacactctgaatctttgttaagttgaattgaaatgaatgatgagtttctttcccacatgttatgtaggctgtcacctagcatgacaacttcaatagaagagacattatatatagatagagagcagtcttcctaatgaacttctgaggtcattagcaagagggatttttccttttgtgtggaagagagttccactgtcattcagccattccgtagctgaactcatgttaaaaccaactggaagaaactgaacttagattagaatttggttgtattaagcattgcttgacctaaagcagtctgtggttgcggttttaaactcttgagtatgtttatctaggtgctccttgagtagctgctgcttgtcaggaagtgacttcagaaataggacatgacctatattcttagttctcagagattatttttggtcattcattgtgaatggttaagtttttaaaacaaaaagagtggttttaactaacaccagcttccacaaatgtcaaaataatagagttgtcaccagttttgttctatggcatcttgatgggcacatcccatgttcattgatctcctatagttattttctcagattttagtatacttgactgatccttgtagaaaagaaaaatagcaagtgtttgtagtgaatatactgcagtagaaactgtggcaatgcttccttcaccaacccttctaataatatcagcatcacttagatacaaagatgatgctgcccctacaaggatttaaaactagtcccacgtggagaacctttgaaagtagtccaaaggcgtcatctggagaatattttgcaatcagtatttagtatgtgttgaaggaaaagtgaaaacaagggagggtgtcagaaactttaatgaaaggagaaattcttctccaggcatcttaagctttggattaagggtccaaggcaatagaatatttgaaagaaaagactatcaagatattaaagtactggctgggcatggtggctcatgcctataatccctgtactttgggaggctgaggcagtcggatcacctgagggcagaagttctggaccagcctggccaacgtggcaaaaccccatcactactaaaactaaaaattagccgggtgtagtggcgcatgtctgtaatcccagctacttgggaggctgaggcaggagaatcgcttgaacccaggaggtggaggttgcactcagccgagatcgcgccactgcactccagcctgggtgacagagcaagactctctcgaaacaaaacaaaaccaaagatttaaaatgttgatttaaaatgaaactttaaaacgagtttgaagatgaataataagaaatagtgacagaccgccaaatgtaatgtgaaagttttattttgacaaaaggcagatttgcagcaccattttttttttcaagaatatcttatgttaatcttctgtgaacattttggagattttgatttgaatattgtgttttgcctagaaaaaaaaatggtgggtgtgatagctgatttttaccttttaagtagctctacaggtcggccacagtggctcatgcctgtaatcccaacactttgggaggctgaagtgggaggatcacttgaggccaagagttctacaccagcctgggcaacgtggcaagaccccatctctatgttttaaacatttaagtaactctactgtgttttaggataatttatctaaagataagtatatgaatcagttaattgtttaatgcagtggtggggcattgtggtgaagctcagtcttgctaaaattaatatttctggtgcggtcacagctgtttccacttgttataagttgctgtatctaatgcacacacacgtatgtgcgctgggggctcagtcctaaagtcaaatatgcacacgcagagaagacagctgttgctttgttttagagaatacttttttcttcccgcagctcaagctgacacttttggaattgctagtggagatgctgttgttagatactggctagaacttgtcaaggtcgaccatgaggctctcttcatgtgctgacctgtgcctatctttccaacttcatctctgcaacattctcccttcagtgttcactgtagcaaacaccttgcagttcccagaaagtgccctgtgtcctgctttcctcttaactccctactggaatgtcatcctctttactgcacacctggtcatcctactgagaggccttccttgactccctagcctaaattggttgtccttgtctgttctttcctaacttgtctgcatccacacattgctcatgttgagttttacctgtgtctgccttctgctagattgcaggcccctgaacagacagtgacatgttttcaggttcaagtcgctgtgactgagttccctggacacctaggtgctcagtgggtgctggtttgttggacttagtttcctgctgtgcttccttacctcaggcatgtgttctgtactgagtgtatcttgcctactccattccttttccacgtgggcaacgctgaacatttgccccagactctgtatcttggttaatacctgacatataaagtatttagcacataggcaaagatcactacctctttcaggaacaaaggccggctggcgggtgcgactctggcgcattgcctttgcctgtgtgttgctggccagttatcggcttcttgcatcacagctccagagtcccatttagcttgacatgggctgggccttgcagatactcctccttcacctcctgaccctgttcagccaggccagtagggggcactggaggaggaaagccgccaccccccctcctccacccccctgcccgcctgcccgcccccggttcctgtgtgtttctgcagtgttcagatcttgctggcagtgctccccagggcccagtgcgagcggagacagcggtggcagcgcctctcaggcggtttccagagcgggccgtggctcccgggaacggcttcccgcaggtgattctgtgcacactggcctctacctggttcagcgggaagcctctccactgtccaatgggcttcagccacaccctccctagccgtgtctcagcccagccttggggacctctgttctagcttgttccgtccctgagtgccgtacttcaatcttcttatccattagtgctctttccccgccatgagtcagttcccggttcctcagtctcctgttaataattcttcatgaaactatattcacatcactgtgtggcttctgtgttctgactggaccctagccagtacaggtgccctctgcctaggcagctgaaggaaccatacaggcttttcgggggccggcctaagtggcacctccgtcactccgcaaacatctgagttcctgctgtcggataggcactggcccaccctcgaggaagtgagacctggcttcagccccacaggagctccaagactgggaggagagaagtaatgaagtgtgtagagctggagaggaggggtgtgtgtgtgtgtgtgtgtgtgtttgggagagtgcaatgtgacaaaaacttaacaaaattttagtgtggttctagtaggagctaaagggacagataaatgaaaattaacaaaattgatgaataccactttaagcataagtgatatccctgatagaaaatctaaccaagtgtggttttgtttgtgaatagtctttccctttccacaaatcacttgaggtgggtgaggttttgttttgtcttctcatctctgaactcctaaagggcagggactgtcttttgtctcaattatcttatactcacaatgactattacatactagatgcataataaatgttagtttactgaatgaagggtgatataactattctgtattccattttctactccaagaaagccgaaatcagccagtgtatagaccgccaactctgaggtatccttatttcatagacatggaaactgatgttaaggaacttacccaaggctacgctgataaaatgtgactgacccaggctttgaatccaggctgataccaaaagcttggcgttttcactgcactttgcagttctcaccatgagtggttactgtagtcaatcaagtgcctgccctatttgtgtgtgcacatggacacactcacctaggggtcttttttcctcttcagagccatcaccatttcttttagagtcaccgacctctggccatccagctacacatggacagggttagaaaaactcaaggcttgagagtcgctctccatttgctcctttaaggattcaaaaagtcttttaatgaagtgtatccacttgctagaaaattgaacttggtacaagttgtggaacatgtttagttgcataaaagttcagtaaaagctaaacctcggggaacgtgtgtgctcttcaaacattaactcttgccgtccctctttcttctcaggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatcc

SEQ ID NO: 36965 - DNA, 86205 bp, Homo sapiens
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggtgaggctagctagcgggggcggcgggggcccggttcgggctgaggcggcggcgggggcgcggggaactgggccgcggttgcggcgggcgggggccgcggggcctgcggcggcccgggcagcctcgggggcggggaggccgctgcggcgccgagggcgtcttggaggggtccccgcggggccttcggcctgggccgagccggggagcgagggcgccgcagatctttcatcgggataggaccccggggactaggcttttcccgggccgctcgttcctggccggcttgtgggctgcaggggtgggggcggaggaggacgaccctggctggacgctggtcagcatcctgcttgtgagaccggttccgcggtccgcagcgctggtggctgcaaggtttgtgtacggacgcatctgtcggctctcgtatttaaaaacgacggcttctgccaaaagagaaaagccatatctgccgacggacgctcgagagataatcgtggaactttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttggttcgcctgaaactgttgttggtttgagcataatttatgtttagaaagacaaaaagcaattgtcatatctccaaagaccaaagacatagctgatagctgtatgcattactggtaagttaaagaaagattttttgtgtgaaaaattgactgagatcttaatggggataggaaatagaatgctgataggtcgactgtgtctatgagtagaggcgcctagtgaaaacaagcttggagtggatgagtaggagttcaacaggcaccagagagaggagggcatttcaggcagagggtgtgaattgtatgaaagtgagtttgtaaactttggagccttgaatggacaaaggcccgcgatgataccttttttttttgagacggagtctcgctctgtcgccaggctggagtacagtggcgcgatctccagtcactgcaatctccgcctcccaggttcaagcaattctcctacctcagcctcccgagtagctgggactacaggcgcgcgccaccacgcccagctaatttttgtatttttagtagagacggggtttcaccatgttggccaggatggtctcagtctcttgacctcgtgatccgtccgcctaggcctccaaaagtgctgggattacaggcgtgagccaccgcgcctggcctacgttaaaattttaatatactcctttgattttgacagtggagaaaactagaatagtaaagttgtcttttcaggaagtggatgatttgggcagtcaaaactgcttttcagagtttcgatgtggtttacaatggtatggacagctggtatgatttgttagttttctacttgtggtgtctttaggttttaaagtttcggagagtcgctgagtgatgtgagtctaaactctagccagtccccgaattgtgagatagttttccttctaaaatatacttcgtacaagctggtcatttttccccttaattcttttgatgttatctgatatactgagaaggttttgtttggtgttcagttttgtgttactgattttgccataaaaactgtttatttacatgatttttagtttttagttcttatagtctttgaattgaataagaaaagtaaatactgaaatgctttgaaagataacaaaatatttacttattgcttgaaacttagagttagattgactgcccttcctttctttccttccatgtttacctcttaacatatacacatatgtagagagaatagtataaaccccttttctcaaccagtttcaacagtcaatcttgcttcatcatatccccgcagtcctagatatcctttaaccgttaaatagttcaatatgtatatcttaaagacttaaacaaaaggtaaacatgagtaccactatcacagaaaatgaataattccttaatactttcaaatatccagccagtgttaaaattgtcagaattctcattttttttcttaacaatttcaatcgatccacatgctatctatacagtgtgactcattttaattgatagtttcccctccatatttagttttctcttgtaatttatttatggatgaaacctggtagtttgtcatgtggagttatgcacagtctcaattttactctgtggcatagtttcacagaatttactgaaaactggtggttagatctaaaggtatgatcagattcagctttacttttgtcaagcaaacttcttaggtaagtaggcagaaatgattagtagtctttgttcgcagcccttgattgtcagtgcctacagtcatttcagcaagcattgaatatattgatatttgaattctataacttcttttattaaatagaatatttttataaagataatttttcatgcctccactatttggttatcttgaggtatctcttacagaaaagggaggataaatgcttaattcttctccattatttactaggtttcacataatgaattgtttcgctaatatccttcaaaagtagccaatgaagctgggcatgctaggatgggcctgtaatcgtagctgctcctgaggctaagatggtacgaacctgtgagcctgggaggtcgaggctacagtgagccatgatcacttcactgcactactctgtctctttaaaaaaaaaaaaaaaaaaaagccgagcgtggtggctcacacctgtaatcccagcactttgggaggccgaggcgggcggatcatgaggtcaggagatcgagaccatcctggctaacatggtgaaatcccgtctctactaaaaacgcaaaaaattagctgggcgtggtggcggatgcctgtagtcccagctactcgggaggctgaggcaggagaatggcgtgaacccgggaggcggagcttgcagtgagtggagatcgctccgttgcactgtagcctgggcgacacggagcgagactccgtctcaaaaaaacaaaaacaaaaacaaaaaacaagctaggtgcggtcgctcacaatcccggcactttgggaggctgaggcaggtggatcgcctgaggtcaggagtttgagaccagcctggacaacagtgaaacctcatctctactaaaaatacaaaaattagctgggcatggtggtgcatgcctgtaatccccactactagggaggctgaggcaggagaatcgcttgaacccaggaggcggaggtcgcagtgccattgcactccattctgggcaacaaaagcgaaactccgtctcaaaaaaaaaaaggaagtaagactaggattctactcaaccttctcatttttatatacctgtatctacttttcttctaagccaaacattttggttctacttgctcactgtttcaacccacaccgtacacatttcagtctcagaacaagatgaacacgtgaacctcgaaaatttgagacaggtctcggttaacttagaaagtttattttgctagtgttgagaatgtgtgcctgtgacacagcctccagaagtcctgattgacatgtgcccaaggtggttgggcacagcttggttttatacattttaaggagacatgagacatcaatcaatatatgctagaagtacattggttcagtccagaacggcggggacagcttgaagcagggagggagcttccaggtcacaagtaggtgagagacaaatggttgccttcttttgagtttctgataagcctttcctaaggaggcaaccagatatgcatctatctcagtgagcaaagggatgactttgaatagagtgggaggcaaggctgggcatggtggctcacgtctgtaatcccagcactttgggaggccgaggcaggtggatcacctgagatcaggagttcgaggccagcctggccagcatgatgaaaccctgtctctactaaaaatacaaaaattagtcaggcttggtggtggatgcctgtaatcccaggtactcaagaggctgaggcgggagaatcacttgaacccaggaggcggaggttacagtgagttgagatcgtgccattgcattccagcctgggacagagtgagactccgtctcaaaaaaaaaaaaaaataggaatcttaacatagcataatattaaactttaatagagttgtttaattgttaatgcttattctggcctttctacattgaggaaccttgagtttaaaggaatgaggggaagcacatttaatacagtttgccttttgagcttaatttttctagaagtacctttttaaacagttgttataactaatgtgtaacactgtttttgataactgtcagcttaaacatgttgagcatatatttatttaattaatttattttttttgagacagactcttgctctgtcacctaggcgggaatatagtgatgtgatcatagtttgccgcagccttgaactcctgggcttaagccattctcccacctctgactctgaagtagctaagactgcaggttcatgccaacaggcttggctaatttttttttttttttgagataaggtttcaaaagcctgagctgtgttgctcaggctggtcttgaattcctggtctcaagtgatcctcctgtctcagcctctgaatatgctaggataacaggcatgagtcactgcacctgacctgtttccaggtttttactgttataagcagtgctccaattaatattacatctccatattgggcacttatgaggtacatctataaatacattctcagaaatgaaattgctatgtcaaagaataattgcacttttcatttgcatagacatttccaaattaccctcctggccccaattaatattcttacatttccatctttgggcacctatgaagtatatctatagatacattctcagaagtgagattgccatgtcaaagagtaattacacttttactttccgtagatgtttccagattatcctcctaagaagttacgttggtttatactcctaccaactgtgtattttctccacataattaagtatggacactaaagtaacaatagtccctatcttacatggttattgtgaggattaaatgaagtaaatgccaaaaggtacctactaagctgtcagcaaatgacttatattattaatataattattgtttttttctgaactttattaccagaaatattataaacctagacagtgcttcatgaggttgggaaagagggttcatacaattgatctgagcaatatatgcctccaaaatactgttatctgtattagaacagacgagctctgcatctaggccttgggcccagggagtctggcatctggggctgacgttaggggacagagtccacaggtatatctcaaatttgctggaaagggcatgcctcaggaatggggcgcagtagatgtaactacatgtgtgcctctgcagcctggaatggcagctgtggctgtttgcatggggaggagaaagtcatcatttgggagggacctttagaatatcccatcccaaacacttctctccttctcttactctgaagggcttaatttaaatttgctttgtggattaacgtattgagaatgatttagggagttccttacctaaaaaatgttttccctcatctgcacactgtcgcttgaaatttatttcacaggagagggagccgtaaccataggcagtgtggtattatgaaaggagtactggctcttcactatgggtttactgtggtttgctgagggtagttgagtgggtgagaaagtcacttagctgccccaagcctcacttttctccatcggaaaattaagtagccatgtaatacatgaaagagagaatgttgtgaaaacactttgagaatgcaaaggccaagtgaaaacatatgtccgtacaaaagcttgtgtgtgaatgttcagagcagcattatgtttaacagacaaaaagtgaaacaccccagatgtccatcagctaatgagtggatcaacaaaatgtggtctgttcatacgatggaatagtagttggcaatagaaaggattgaagcactcatacctggtacaacatggatgaactctgaaaacatgctaagtggaagaagccagacacaagagaccatgtgcttcatgattttacttatgtgaaatgtcttcaataggcaaatctttttgttttttgttttttgtgagactgaatctcactctcttgcccaggctggagtgcagtggtgcgatcttggctcactgcaacctccacctcccaagttcaagcgattctcctgcctcagcctcctgagtagctgggaacaggtgtgtgccaccatgcccggctgatttttttttctgagacggtgtcttgctctgtcgcccaggctggagtgcagtggcacgatcttggctcactgcaagctctgcctcccgggttcacgccattctcctgcctcagcctcctgagtagctgggactacaggcgcctgccaccatgcccggctaattttttgtatttttagtagagatggggtttcaccgtgttagccaggatggtctcaatctcctgacctcatgatccgcccgcctcggcctcccaaagtgctgggattacaggcgtgagccaccgcgcctggccacgcccggctaatttttatatttgtagtagagatggggtttcaccacgttgcccaggctggtcttgaactcctgacctcaagtgacccacccgcctcggcctcccaaagtgctgggattacaggtgtgagccactgtacctgacccccagtaggcaaatctatacaggcagaaggtagatttggggttgactggggctccagctggggagaatggagtgggaatgaggaatgactgctaatgtgtatggggtttctttttgggtgttgaaaatgttataacgttagattgtgatgattagttacacaactctgaatacactaaaactctgtatacttcatttagagacagtcttgctctattgttcaggttggggaacagtggtataatcatagctgactgtaacctggaactcctgggctcaagtaatcctccccacctcagcctccggaatagctaggactactggtgcataccaccacagctggctaatttttaaaaatgttgccactcaagatgtgtggccctggatcaaaatggtgaaattctctgaactaatttttctcatctgcagaaataggagtaataataataacagtcatatctaactggaggtgtgaggctgtggtaagcaaacttacaatgcttacagtatgtgaggattctgtcagtgtgctttctttccttcttttccagaacatagaggatggaggagcaggccttaagagggaaagacacagaagatgcaatagagagccttgtagctcttttttgtctgtctctccctctctctcaaaataaagcctatgtagaggtatttttttgtctgatacagctgcatgtgtttgcagtttagtaggaactttgtggttaaaccatgctttctaagattttcttaaaaggccaaccttgttgccagatgataccattaatcaagttattcaagttattgtcacatagggcttcaggcaggaaggaaggttaggaatggtctttagtctcatagaatgaactcccttttggtctgagtgtctccttcagtaggaagggatgtgatgttaattgaccagtctttaggggggaaatagatgacccccaccatccggatactcagtttttattcttttttttttttgagatggagtttcgctcttgttgcccaggctggagcgcaatggctcgatctcggctcaccgcaacctccgcctcccaggttcaagcaattctacttcagcctcccgagtagctgagattacaggcatgcatcactacgcccggctaatttttgtatttttagtagagacggggtttccccatgttgaggctggtctcgaactcctgacctcaggtgatctgcccgcctcagcctcccaaagtgctgggattacaggcatgagccacagcacccggcctcttttctttctttctttctttctttctttctttctttctttctttctttctttctttctttcctttctttcctttcctttctttcctttctttcctttctttctttctttctctttctttctttccttccttccttccttccttcttttcttttcttttcttttcttttcttttttttcttttcttttctttctttttttttttttttgaaagagagtctcgctctttcgcccaggctggagtacagtggtgcgatcttggctcactgcaacctccgcctcccgggttcaagcgattcttgtgccccagcgtactgagtagctgggattacaggtgcacagcaccacacccggctgatttttgtgtgtttttgtagagatggggtttcgcagatactccatttcagtttttttctgagcaacgtctccagggactgaagcacacatactttgacaacagaatcaccagcaatgtcactgacctagggtgtctgcagcattcagtgtcttctattttctgtactaggtgttttctgtactgtttgtaaagcaggaaatatctttttttttttttttttttggagacagagtcttgctctgtcacccaggctgaagtgcagcggtgcgatcttggctctcactgcagccttgacctcgtgggcccgagcagtcctcccacccagcttcctgagcagctgggcctgcagacccaccccaccacacccagctaactaaaaaaattttttttttagtagagccaaggccttgctatgttgcccaggcaggcctgaaggtgcttttaaactcagataagcaggacatttgtagctgtggaaatagctgtaatctaaccatcagagttgttttaaggatacaaattacatatagtgtttaaagcataatgaatgtacaggttgctagattgggttttactctgttctttctgtaactttttagaagttggtcacttactttttttttttttttttttgagacaggttctcactgtgttgcccaggctggagtgcagtggcacgatcttggctccctgcaacctctgtctcccaggttcaagcaattctcccacctcagcctccccagtacctgggattataggcgcccaccacacccagctaatttttataattttagtagagataagggtttcaccatgttggccaggctggtctcaaacatctgacctcaggtgatctgcccacctcagcctcccaaagtgctgggattacaggtgtgagccaccggcgtctttttctagtataagtgtttaaggctatatagctctctagaagcatctctttagtgaagccaatagtttccaactgtaatatttttgttagtaatgtatatttaaattttcattatgatttcttttttggcccataaattattttaaaatgtacctttaaatttctaaatatatggtttgaagaaactcttctgttattatgttgtttttttttctttcagactgagttttgctctcgtcacccaggctggagtgcaatggtgcaatcacggctcaccgcaaccttcgcctcccaggttcaagcgattctcctccctcagtctcccaagtagctgggattacaggtgcccgccaccacgcctggctggtttttgtatttttaatagagacagggtttcaccacattggccagggtggtcttgaactcctgacctcaggtgatccacctgcctcggcctccaaaagtgctgggattaaaggcgtgagcgaccgcgtctggccgttattatgttttaattgcattgcacccggagaaatggcttgtgtgctgctgattccctggaatttgttgtgattttctttattgccagatatgacatgaatgtttataaacattccttgtattctaaagaatatgggctgggtgcagtggctcatgcctgtaatcccagcactttaggaggctgaggtgggcggatcacctgagatcaggagtttgagaccagcttggccgacatggtgaaaccccatctgtactaaaaatacaacaaaattagcccagtgtggtggcacacgcctgtaataccagctactcaggaggctgaggcaggagcattgcttgaacctaggaggcgtaggctgcagtgagccaagatcatgccactgcattccagtctgggcgacagaatgagactccatcttaagaaagcaagcaagcaagcaagaaagaaagaatatgtatttaatttgtgtgagaaagggaggtgcaaggttctgtatatctctaatgatctaactttttgcttgcattgctcatatttcctatttactgttactgacttgagcaatgtggtagattattatggtaatctcattatggtagatttgtcagtttctctgtgagttctagcaatttttggttcatatatgttgacagtattttattaggtgtgaataaccttatacttttcatcttcctgttgagctgtacttaggtttatggccttttccattccgaataaatgcttttattttcttggtcttcattgtctgatattaatataattactccagctttgttttgtttggtgtttgcctggtatttgtatttttgtccatttattttcagactgtctgtgttctgtttcatgggtatattagttttttgtggctcctgtaacaagttaccacatacgtggtgctttaaaacagcagaaattattctctcatagttctggaggccagaagtttgaaaacaatatcactggaccaaaatcaaggtgtcactagggctgtgcattcttcctctggaggtcgtatgggagaatctgttcctcgcctcttccagcttctcatggctgccacattccttggctgtggctgcatcactccaatctttgtgacccaggtcagattggtttcttgtcttctgtgtggttaaatctcccccacctcgattttataaggatactggtgattacattcagggcccacccaggtaatccaggataatttcacaatcccaaaatacttaattatatctgtagtctttgccatataaagtaatatttacaggttccaggcattattcagacctgttaacttggggaccgttactcagcttactaaaagagtgtctcttataagttacctgtaatttctgtcttttaactggcataatttagtacatttatgttatgattcagataaatttgtactttctttatcatcttaggttttgtattctgtttgtcttttctccccatgcttgcctttttaaacaactgggagttgtttgtttttctttatattcttccatcttttggtttggaaatgacatactcttaatattcttttagtgattacccttgaaattttgctatgcatatttaacgaagtctaaaactaatattctgtcgccctcctagatacagcaaaggcatgaaagttctttaattccaattattcaactctcaagttacatgctgctgttgttcagtgttttagtccagactttttttttttctttttaaagagacacagtcttgctctgacactcagactggagtgcacaagtttttttcttttcttttttttgagacaggttctcactctgttgcccaggctggagtgcagtggcgcgatcacagctcactgcagccttgacctcctgagctttagtgatcctcccacttcagcccccaagtagctgggactacaggcacatgccgccatgaccagctattttttgtatttttttgttgaaacagggttttgccatgttgtgtaggctagtctcaaactctgggactcgagatctgcctgcctcagtctcccagagtgctaggattacaggcgtgcaccaccattgggcatggtggtgcatgcctgtagtcccagctactcggaaattatttcacacaagttcttttttaaaaaaaaaaaaaaaaatagagacgagtcttactattatgttgcccaggctggtcttgaattcctgggctcaagtatcctcccacctcagccttccaaagtgctaggattacaggcatgagccaccactcccaaccttcacctaagttcttgaaagataattttgcttgatatagaaatccagattgacagttatttcttttcagcattttggagttatcctactgctctctacttttgttgtttctgttggcaagtttggcagtagtcggtttgttattcccttgtaggtgatctgtctttttttcttctggcttctgttagaattttcttttctttattttggccttggctattctgcatattcattacaatgtgtgtaaggtatggatttatctttatttattttgcttggtttttgtagattcatgtctttcagctctgggaagttgtcagccattttcttttggaatatttactgttccctatttattatttctgcatgttactcaagtaaatggttactagagttttttttttttttttttttttcctgagacggggtcttgctccgttgctcaggctggagtgctgtggcatgaactctgctcactgcaacctccacctcctgggttcaagtgattctctcgtctcagcctccaagtagctgggactacaggcgtgcaccaccatatctggctaatttttgtatttttaatagagatggggtttcaccacgttggccaggctggtctcaaactcctgacctcaggtgatctgcccaccttggcctcccgaagtgctggaattacaggtgtgagccaccacacccagccaacgttcttattctgttattttttattttttattttttttgagatggagtcttgctttgtcgcccaggctggagtgcagtggcggcatctcagctcactgcaacctccacctcctgggttcaagcaattcttctgcctcagcctcctgagtagctgggactacaggctcatgccaccacgcctggctaattttttgtatttttagtagagacagggtttcaccatgttagccaggctggtcttgaactcctgacctcatgatctgcctgtctcagcctcccaaagtgctaagattacagacgtgagccaccacacccggccagggcaattttttcaaagctgtgttttaattcgcaaattcctctttgtatctaagctgttactcattttttgacctaaaaattcaatttaaatttcttttattctaaaagttagcaggtgtggtggtgctcctgcagtctcagagtcccagctactcaagaggctgaagttagaggatcgcttgagcccaggagtttgagaccagtgtgggtaaatcgaaaccctgtctctacataaaatacaaaaattagccggacatgatggggtgcacttgtggtctgagctactcaggaggctgaggtgggaggatcacttgagctcaggaggtggaggttgcagtgagctgagattgtgccactgcactccagcctgggtgacagaatgagaccctgtctcaaaaagaaaatctgagtggtagggattttcaagtatttgccttagttgaggtctccaaatggaaatagtgattgggcactagtttaaaatgtacaaaaggtgtattcagtgtgaggttggttccaaagtgcacggtttgacagcccagggagtgagtgaggtgtgttggtgtgttttccatgatacaggggaactgactccagtatggccagtatacgagactttggtaaaatcattactttgttctggaactctattttagcatctgtaaaatgacttctaaagttccttctggggcagaaaatacatgcttctaaggttctgtctcattgctttttttttattttagtaatttaataagcatttatttaagatctgctgcattcagagcattgtgttaggaatattggaagtaaagcattgtaatagctcttgccttcagtaagcttgcagtctggcagttggattaaaaaaatgaccatacgaagccgtgataacagcctctaggagggaactctactatgtggtggagatatgtgtccccctgcaaataccaagaaagacagttaattagtgtccattacagaatgttcttctggtgtcctttttaaagagattcagtcagtctttaaagatgatgctattgctgctactgctaataataatagtgatagctaccacttactgtttactatgtaccttgtgctaaacacttgacataagttaactcgtttaatcttaaaccaaggaagtagataatgattctcattttacagatgaagaaactgaaatagacagagatgaagaaatgtgcctaaggttacgcggtttagtgaactgggatcagaacctgggttctctggccttagactataaaccatagataggaattgagcacatttattaatcagcattgcaaggctggtggaattttgataaacacccaaaccagattcttttctgcactagtgataccagacagattttggaaatataaacaggatagggtgcattaaagttcactcacatttgttcagttaaacagatggttggcttatctttagttgcttcactcagtcatttccaaaaccacacccaaggccaggcagtggctcatgcctgtatttctagcagtttgggaagctgaggtcagaggatcacttgaaaccaggagtttgagaccagccttggccacgtagtgagaccatggctcaacaaacaaagaataataaacatatttactattatgggacgtctatgtgccagacattgtgctagacattttacatttattatttctaattgccccaacaacctgggaacatatcaccgagtgtattttattacaaatgtggaaactgaagtacagaagacaataagcctatgaagtgatcgtagggcgttgctggtacaaagtcaaaacctgcatcattgggccctgcgcctctatgtctgtggggagaagggattgttgatgatgtgatagctggaaaacataccattcatcaaaataaatcccaggtggattaaaaagaaatgtttaaaattatagaggcactgtggagaaaaagcaaaataaaatgtttatcagagataacgccttaacattttcttggaacattttattagatgtgtgcctgggaaggaatgataactttctttttaaaaccagaagaaatcacaaaggaaaaggtttgtcaacctaaatatgcaaaatgttaaaatattttcttattgaaaaataaaattatagaagatagtagtctgagaatgacaaatatgataaaagggtcaatacctgtactatttttttcagatgtgtagaaataaatacatcaagatctcaacagatatgtgtacaaaggaaatcataggccatgggaaattttaaatgtaaataagcatataaaaaaattcatgctcacatactgagagagatgccaaataaagtagacatttctacactccagccttggcaaccgtgagaccctgtctcaaaaaagcaaaaccaaagcagacatttcccatctaccaaaacagagaaattttagtgatagcctctgcttccttttcggagtatgtaagccaaaaggaaatgaaactttttatttaatcctcacccattttggaggttttctttactgtaaggtttcctttccagtgtcaggcttaaccttcaagcagttaccactttagacacattgtttgctgccatttcattcagcagctgcgttattcataagatcactttataatgacatacttttccatcttactgttttataattattaaatggttcccctgatattgctccattttttttttttttcaggagaaacattctcaggttagtactgttaatccctccttacgtgtttaattagattatagagtgttggttttttccttccttataaaatcttacgtagagttttctatactgatgtgtctggtcaacctgtgcttcctgacttagctgagtcttcctgcagtctttatggggtttcataaagtgagcaggtaccatgctcacttagttataacttccctgaggtctagaaatctccttttcttcttttcttattgtcctacctctgggagttgtttgtgtgagctttagtctccaaatcgagtcatctagaggcagacatactagctacgtttgctttatcaactttgggaattgacgtgattttggaaacataagaccttcttaattcagagatacaaaacccaatttgatatgcagattgtccatttgcagtctggaatttccttgtgagtggcgaacttgtgagtgaaatttggagtgttttagtttgttgctgtactccaagggtctcttcagtcggacgtcagttgtgattgaatgaagcaaagcaaaggtttttcttagtcatatgcctctagaaacaaaacttagattagcgttgttagtccaaaatgttagatctggaaatgtatttgttcttccatatgtattaattgagagactattacgtgacagctctgtgaatacagtagtgaatgagacagaccagtttcttgtcctcttgggagttttattatactaggggagatagtttatttctgacagtaatactaagagttaacacttaagtacttcctatttgtcaggcacttattctaagcattttacatgcattaacctgttgttaaactcatatttcaaatgtggaaacttccaccagggaagttaagaaatcttgccaaaattacagagtcagtaagtggctgagctggagtttgaactcaagcagtctagctccagagtctgtgccctgatagtgatggtaagtactttgaagggtaagaaaacacaaaaagtccagggtgatttgagagagctgggagtggggactattctaaatagggtgggcagggaagcaaacttcaaaatttccagttgaaatttgacctgcagcctaactgataaggactaaggcattcaaagtagctggaataaattctttgttctaggcagagaggacagcaagtacaaagactctgaggcaggaaggggctgggagtgtttgaggacagaagggagactagtgtgtctgggaaatggtgagcaagggagcgtgggggctgggggccaaaatgggaaggcccctgcatattggggtcaagagtgcagattttattctagggactgtgggaagccattgaactcttggccccaagtggtccttggcctcccaaagtgctgggattacaggcatgagctaccactcccaaattaagtagggtgcgacatttaaatatattaatacctttatggagaatgaattattaagagtttatgagtttagatacagagagacaagactagagattaagagtcttattttgaataagttaggtttgagtagactttaaatattcaaacagatgttttgttggcatttggacatacaagtttggcctcagggaagagtttagggctagagataaaaatttggggcccattagtgtatataaatcagtggttctcaactgtgagtgcacatttgactcacctttaaaaatgctcatgcccaagctccattcctagagattcagattctgtgggtctgggtttgggtctagccatggtttgttttaaatctatctaggtggctctaatgtatgacgagggctgagaaccactggtggaggtggtatttagagccaaggatgggcctggatcagtgtgatcctttaaggcaaacttgtccaacctgttgcccacatgtggcccaggacagctttgaatgcagcctaacacaaattcgtaaactttcttaaaacattatgagatttaagttcatcaactatcattagtgttagtgtattttatgtgtggcccgagacaattcttcttccagtgtggcccagggaagccaaaagattggacacccctggcttaaggcaatggtatagctagggaagacaagcagctcagggtactggggcagcccagcaggtagaagttggatagaagaggtagaacagcaagggagactcacagcagtagctggagaggttggaggaaaaccagaaactgatgtctgaaaactggaagaggacagtgactcctgaaagtgggagcagctgtgccagatgctgctgagagctggtaaagtgaatgcgctcagaaggaattgaaactagcttcactgaatgggtctcagaggttcaaaccagggttttaggagctgtagattcaaatcctacccctgacattagttttctatttaaaattaaacaggatgctcttttcttagcctctttttatctttgcttattaaccaaaatgtaactgaactgtctcaatgcttaaagaaaggagatgataaacagacagccttattcccctctcccattcccaaacaaaagccagttcttacctggagttttggctctagctttctctctgcctggagtgcctttctggatatatggccacctggcctagtgctctcaccacctgtttgtctgtgagtccttccttagctgtccccttctctgggagctttcctttgctcttcctacttaatgatgtgactcacctccccaccccctggactcccagttccctacccatagcacttgtcgccttctaacagactgtgtgatttacttatttatcatgtttattgcctggcttccctgcaggaatgtaagaaatctttgttttgttcattgatgtcccctgagaatgtggattgctgagcaatgcctggtctatagcagcctcacagttagtgcttggtagatatttggtgactgagtgctgactccatgaaaatgattgtcatcctttgactctgctccagttgcatttgaaaagttgcatgggatctgccacttctctccatgacccaactatagagacttctggagtgtggcttctcccctctacctcagtactgtcatgcctattgaatttttttgagacagagcttcactctgtcacccaggctagagtgcagtgggatggtcatggcccactacagcctctactaggctcaagtgatcctctcacctcagactcctaagtagctgggactacaggtgcatgccaccacgcccagctaatttttaattttttttttttttttttttggtagagctagggttctgccatattgcccaggctagtctcaaactctgggctgaagcaatctgcccacctctgcctcccaaggtgctgggattacagttgtgagccactgtacaaggctttacttggaatttttagacttcagaaattatttgaatgttaatataggaaagtggtagtaataattagaagcaaattatatatatgagaaacagtatttaatgtattttggagaccaagtgttatgacagggatcagaaattttcagttgtcactgacagtaaaaatcattgcaagaagcaatttggtgctgtggaaagttcataggcttggaagccaggatacttggttcttaggtttgtccagtaatcttagccaccctacagtgagtgtctgctgtctgccaaacactctaaatgctttccagacagcatttttgattttactgtatcactcatggttgccattactacaccttgtttttttttgttttgttttgttgttttgttttctaagagatagggtctcactgtgttgcccaggctggtctcaaactcctgggctgaagagatcctcctgcctcagcctcccaagtagctgtgagtacagtcatgagccactgtgcctggctactataccctgtttatagatggaaaaactgagtcccagagaaaagataagaaagaaaagattctattctgatatgaacagaatcattttggagtggagaccatgtggggcacatttaacccctatacactgtcaactagagagtttggttaacttactgtctctaccttagggtaagacacaatctccgaggacctacattttatgacctgtgagatcaggataaggctatcctgctaaaacacttaaataacagaatttatggccgggcgtggtggctcacgcctttaatcctagcactttgggaggccgaggtgggcagatttcctgagttcaggagttcgagaacagcctgggcgatacggtgaaaccccatctctactaaaatacaaaaaattagctgggcgtggtggcgtgtgcccgtagtcccagctgttcgggaggctgaggcaggagaattgcttgaacccgggaggcggaggttgcagtgagccaagatcgtgcgtgccattgctccaccctgggtgacagagcgagactccgcctcaaaaaacaaaacaaaacaaaacaaaaaacaggatttatattgtaaaatataaaactttaaacaaatgttttgtatcattatgctgctgaaaatacaatgttccaacagtgtcctctgttcattttatactcacagtgatgcttattattttatttattagaatgtatctgagatgccaagttcaggagatttttggagtcctgctctgtgtgcccttctgccaggtggccctatgcttataatcactcttaggtgtttacacttccttcctttttcttgtcagggtccctggctccctctggagtctactctccaggaggtggggggcgctgatgtcagcagggaaggggggcttattgctctcagtgatgcttattattttattcacgttcttaatggtttgagtttttggttttttaagagatggggtcttgctttgttgcctggctggatttgaactcctggaccccattgtgcctcacttgttttatttttcaaattttattattttgtaaatttcccttttataaattaatctttaaaaatgtgtgtgtgtatatctatgaacaaataaaggatctcctggtcatctctgtccccatccacccagctccctgttcctccttacaagtaaatcaccattgtaagttgtatattcttcctgcatttctttatgcaaatagaaggaaatgtgaatgtttttcttattctcttccttctccccacaaaagatgccatacatacactattttctcttgttttttttttcctgcctgacagtatttccttgtttttgtgaagactagaccatctaaaattttgtgtactcataattacttgatagcataaagactttcaagtctccatcagctgacacaattaattttcaatgaacatacctttggcaagtcttcttaggcttatttttgtgatttttaaatgcttcctgcctagctctaaaaaggaaaacctggcaccatcctcagaagtttcagagttaatgaagtatctcatgtctcagcctttgcgtgtacagaataaatacgtttttctcagttcacttacccattgtggtgttctcagtttatgagcccttgctataattttcaaagctttcttttatcatttgtctttcagataaaacaactgcttcacaactaggaacttttagttgttgattattaaattctgtcaaaactgcctgtttgttttttgtggtcagtattttaatctcccttatctacaatcctgccaaacttccctaccttccccctgctccagaaaaataaaatccaactcaaaccttacttagcaaaccaccctcacagagtgaaattcagaaaaaaaattttgtttcaataaaaagattttgaaagatttcatcacttcaacaaaactatagttaaaaaattaaaatattatattaattgaaggacagtaacagtataatgagggagcaaaaatagagaaagtagctgacattgccagaagataagtcaaattctgctttttcccacatgtaattgttcaggacatgtggctcagaatatgtgaattagtatagtaactacagcagagtctctctgggttgtgttatttgctcaattgcgagatagcatacttataaaattatttctagattcactcctgaaatcttaactgcagtctgctttgtggaatttcttcttggaagaacttgtttaagagtatgctgattgatatttgttcatgggccatctgaagattctggatgttattttattttattttttgaggcagtctccctctgttccccaggctggagtgcagtagcacaatctcggcttactgcacccttcgccttccgggttcaagcaattctcctgcctcagcctctggaatagctgggactacaggcacgcaccatcacacccagctaattttttgtgtgtgtgtatttttagtacagacggggtttcaccatgttggccaggctggtctcaaagtcctgacctcaggtgatctgtccgccttggcctcccagagtgctgggattacaggcgtcagcctctgtgcctggcctggaggttattttaaatcgttttttttttttgggatgaaaacaaattttgttaaaattagtaatacagaatgattttgtgttcttttatcattcattcatttaccaaatatttattgaggcctgttctgtgctaaatggtggggagatggtgctgaactacacagaagagccccagtatgcctgctagctcttcccgtgtttacattttgattttctgtgctgcaatacagtagatgagcttggcattgagagtgagtagtcttggatttaggttttgagccggccatttatttattgtgagacctctgaagcttaaaactctgagccagcacacctgtaatcccaatactttgggaagccaaggtgggtggattgcttgagcccaggagttcaagaccagcctgggaaacttggtgaaaccccatctctacaaaaaatataataattatctgggcatggtggcacgctcctgtagtcccaagctacttgggaggctgagatgggaggatcacttgagcccgggggcagaggttgcagtgagccaacatcacgccactgcacttcagcctggatgacagagcaagacccagtctgaaaaagaaagaaagaaggaaaacccacaaaaacactgagtcagtcttgatctgcacatggaggaatcttgcagggtggttggaattaacgagtgtgtgtgagaacattgttctctgcagtggtctttatagggtctttagacaattcgtggtcacttttctggatcccttgcattttctagctgcattttcctcaactgggtttgggaaaaattaggtctggagtttgggatggggagctgtttttactttacaggtgaggtaactccatacgtgttgaagttttataggagtatgagtggaaccaacctctgatttttggctcagtactgacccttggactggagagtcctgttgtcagcaacaagaacacagtttaatgagaagcaattaagagtgcggtctccaaaccatagtcttaatttcagattcttgcttctccacttactgcctactaaaccttaagcaagtaactggaatatctctcataacataccataggattaattaatgctgtagttaaaagaaaaacaacaccagctatgtaattgtataaaagacttaataaaatgtggatgatttaggctgggaagccgttaactaaccattcatcataaaagggaggaagcaagaggacccacttgagtaggctgggacaaattgctgtggttcagttttactttttgcttttgtttctaattggagctgttttgagacatcctgattgtcagagagaatgtggattagagggaggaggaggagctctggagtcaggcagcccgagttcagactccagcaaccccattactggctgcttaactgtgttgtgccttatctgcagaaaaaatgagttaaaacacacatagtgagcagtgataactgtagctgtgattatttgaaaggggccttttgagcagctgcttctgcaagaggacatccggagacacaggaatagaaatgatccgatcagagtaattaaaggcttttaactgagctctgaggtcccaaacagggcacactccgtcagcctaaagctgtgaagaagaaccttcaacataaggtgggtgttctcttttagggtggtggagaactgtgtcattaggctagtactgtaagcagtggggggttagagcttaactacggttgtgtttgggagatagcgccagatgttgggctccctcctgccagtagattacagggatttcctttgcattggctggtgctgcagccttccagtattgcaggtttccaagtgtttgtaatgaatttctggccagggcgtccatgtctcttggtgctggccagggtgtgtgctgacggctgcactgttcccagccctctgcctggatttagtcttcagtgtcggagcccccaagtctgtttacaatcttgttactctttccagcgaactctccaccttctgtttcactgcgtatttcctgacgatgcagtttcattttggatgcagacctcttggagccctttgtcccagggaagttagatgtcccttgtggcaaataccctccttcgggaataaacagtctcatttgagcccctgctatgtatgacacactcccccagggcccttgtacaaacatgagttagaaatgtattgtccctgtatttcacaggcccacagaccagtgatggagcaagtatgtacccagataatttatccgcatatgatttggtcctgtttgaaagtggccatgggagaggtgggaatggtgtatgttgacacacaggagtccaggtgccaggcttggggcgtggggaaccttcatagagcgggaagcattcgagttggatattgagaatgagtgggggctgaaaggtttagaatagagagaatagttaaattaggtcattaaaaatatgtggaacacctgctgggtgccaggtactgcatgtgaaatcagacgacggttgactgcgctcactctgctgtgttttctgtgctactccctaaagctcagtagatgtttattcaccaggtgactgctgccttccccaagccacctggcagtcacgttttacctctgaaatcatctcagtgaagctttcctgacagcccctctctatgagtttcctagagctgctgtaacaaagtgccacagaccaggggcttaaacaacagtaatgtgtcatctcacagttctggaggctagaagtctaagatcagggtgtgggcagggctggttcctcccgaggctgtgagggagaatgggccccatcctagctcggtagtcggcagtccttggcgtttcttggcttgaggaagcactgcgtccacctctgccttcatctacacttagttctccctgtgcgtgtctctttgtccgcattttccgttttataaggacataagtcattttggattaggtctgccttgtggaccccatcttaactaattacatctgtagcgaccctatttccaaataagggcatattctgaggaactgggggttagggcttcaacatgtgaattttggggagtggacacagtccaactcataatatcctctctcagttctttctacctcccactcatggacactttccccctgctgatatactgtaagtggagttctgtcatgcactgagagaattttgtttgttatctcctgctcttcgtatttttcagtctctggtgccttgcatgtaaggtggaaggtgtctccagtgcaaatttattatgcgccaggagttagtagaaataagggaagatactgcagagatcacctctcttcttggtctcctattgacaattccaaaggctctctggagtcgggtgccaggtggccaaggacattaccaggggataccactttcattatctcctttttcccacggagcagtaattcattattagctgacaatcaaagagcattagaaatctgacaagatcctttgggtcctctagcaggcattttacacggaggctttctttaatggctctcttcttcctagtttcagccgtaagttttcatgttccagctttagggattcaaaagtaaatcatgtgaatgctgggaatagttacccttagcaaagatgtctgtgccagaagggagatgccaataaataattgaatctgtccaaaagtttcagaattccctcattatatatttgagagaagcaaaaatttgtctggtatctgacctgaggtttagttacacattaataaagatggatcatcccagggctgcagtacttctgctaagaaagaatattccagcataacctttgttatttccgagtcagtaaataatgtactaggtagagtggtgttttctgggacattagaaaagagacgttatttggactaaatagtgctgttcagtcaggattttcttcaatgccatttagcaaaccaactgtccttagtctgtccagctagcaagaatttgtataatgcaacagagagtgctgttcagtcaggattttcttcaatgccatttagcaaaccaactgtccttagtctgtccagctagcaagaatttgtataatgcaacagagtactttacagttttcacactttaaatgtcacaggaggggttcttcactaggcttctggaacctagtctagcaaaattagaggaaaggccctaaggagatttatctctgttaagagaaaaagttaacattttcaggctaaatagttgaatctactgaagataacaaataatgtctactatttcaaccctccaaagattgaagagtgttaggattgtcatttgtgtttttttgtggggtagttgaataaaattgggcagctaaaattttcagttccatgtgcctcctaaacaaaaaacaaagtaagtagtttgtgaattgactgtagacaaaatagaaactatgctgcatgctgttttttttgtaaacagatgacattttctttctttttttttttttttgagctggagtctcgctctgtcacccaggttggagtgcagtggcatgatcttggctcactgcaatctgtgcctgccgggttcatgccattctcctgtctcagcctcccgagtagctgggactacaggtgcgcgccaccacacccggctaatttttttttgtatttttagtagagatggggtttcaccgtgttagccaggatggtctcgatctcctcacctcgtgatccaccctcctcggcctcccaaagtgctgtgattacaggcgtgagccaccgtgcctggccaacagatgacattttctaaccaggcacatgccatccaatttacctgtcgatcataccattgtataaagcagcagaactgaaggggaaatatgattgttaaacacactgaattgcttttatgtcatttgagatagttggtgtaagtgtcttgactttttatatttggaaacattaaataaaaacataaattttttaaaaagggatgttaagatagctgttcatcctgatcttagtagtatcagtctgaaaaagcatgctgaaatatcttcatctgaaggccggcagagaccagctcatgtaaggtctggaggtgctttcttctgagagcaagaagaatcacggagcgtttcaaacacatacaaaatagacagcacggtgtgatgagtcctgctctaaccttcatccagtgtcagtggttagctcatggctagtcttatgtaacttcatttccccttgcccccatataagttttaggcacatttcagatgtcattttatccagaaacatttctgtatctaatataatcctagtaatactacacctaaaatgtaaaactaatttcttaataccatcaaaatctagctagtgttcaaatttctagttgtctcaaatgtcacttttagatttttattttacagtttgtttcaatcaggatcctactaaggtccacatattagttctcagattttaagcagaggagtgagtgacatgatctgacttacattaaaactctctatggccaagttttagagaatggattgttgtgggggttgttaagagactggaagtagagaaaccaattaggaggccgttgagtgtccaggaagtgagtgatgacaacttggatttgagtgacatctgggggatgggagatgtggaggaagcagatgtcacttgggcaggccatacttatttgtcacggttcatccagatttttgttttctgttgtctgtgtttatttgaaaatattgttcccaaagatttcattaatttagctatcaatatattgttgatggtgaaatcttaaaatgtattacataagtaaaatcaaagcaacattatagaatattgagatagagaaacattcatccatactttaatcaacttactcaaatttattccagcttatttgccattatatcattttgccagtgtataattatggcattacataatagaataagaaatatagtttgccacttaatatgttttatactcttttatctgtattatgctaaagagtctctgtagttacatgatattgtattgagcagattttaatgtttatgttacatttatttatttgagtcagggtcttgctctgtcacccatgctggagtgtagtggtgccatcatggctctctgcagccttgacctcccaggtcgagtgatcctctctcctcggactcctgagtagctgagactacaggcgtgtgccatcactcctggctaatttttttgattttttttgttgagatgcagtctttactatgtaagctagacagcttggaactcctgggctcaagtgatcttcccacatcagcttctcaaagtgctgggattacaggcatgagccaccacgcctgacctgttcctacttttaaaattattttattttaaattagtttaaatttattctaagatactatgaaaaatgttccagaagttagttttttgcatgtttttccctttctctctctttttttaactttttgattaaataatattattattattttttaagacggagtcttactctgttgttcaggctggagtgcagcggcatgactcagctcactgcaaactttgcctcccaggttgaagtaattcttgtgcctcagcctcctgagtagctgagattacaggtgcgtgcccccacgccccgctaatttttgcatttttattagaaacagggtgtcaccatgttgcccaggctggtttcaatctcctgagctcaggcatccacttgcctcggcctcccaaagtgccaggattacagacatgtgccactgtacccagcaaataataacttctctgtagagattttacttgaaaactaagttgatgaaacctgcagtcataattgataaaaatgaaggacaggtttgtactgcaaagtagaattatgcttaatcttgattactgggctcagaatgtgtatactttcattttgatttacatttatagacttccttattgaaggaatggagcatgtatatacctggcctgcagtgtttatcttatcccattcacacagcaatttgtaactaggggaaagtaatacctgccttatcttaaatatgatggttttacaaagattcctgtctttcactgtcttctgggaaccaggaaatagctatagttacctctaaaatataccctcatatccttttttaccgatgaaaatggcttataattgggactcataatgattttctttggtcttttattgtttttgaaacacgaagcagaacatttttattattggctcagaatgttcagctttaattacatctaatgaggaaatattgccagataactcttattgttttgttctttggtcattcttttggaaggtttacaataaatagattgggtaaccagaataaattaaacaatttaaaggatataaatagagaagaataagtttcagagattccacttaggctgggctcttgcctgtaatcccagcactgtggaagtctgaggcaggaggatcacttgaacctaggagtttgagaccagcccgggcaacatagtgagacctcatctctaccaaagaactaaaaaaaaaatagccaggtgtggtgatgtgggcctgtagtctcagctatgcaggaggctgaggcagtgggatggcttgagagcccacaagttccaggctgtagtgagctatgattgcaccactgcattccagcctgggtggcagaataaggctctgtctcaaaaacaaagagaaaaaagattccactgaggtcattagttcgtttattctatgttgatgtttagtcccccaattgttttcatgttttgcctttaagttctcgaagtagtggctgggggcggtggctaacgcctataatcccagcactttgagaggcctaggcgggcggatcacctgaggtcaggagttcgagaccagcctggccaacatggtgaaacgccgtctctactaaaaatacaaaaattacccgggtgtggtggcacgtgcctgtaatcaaagctactcgggaggctgaggcaggagaatcacttgaacctgggaggcggaggtttcagtgagccgagatcatgccactgcactccagaatgagcgacagagtgagactgtctcaaaaaaaaaaaaaaagaaagaaatactgccactttaagcatatttttatcttatctttacatttagaacagaaatatcaaattgatctttttcttaaaaaaaaacactaatttcttcaactgattctttggttattggttccacaataaaaatatcttttttgcataataaactctactttataggcttgttatccaaagtgcggttcaagttcagcagcattggtatcacttgggaattgatgagacatgcagaatttcaggccccactccagacctaatgaatcttaatttgtgtattaattcaattcccaggtggttcatatgcacatttgaaagctaacagggcgtggtggctcatgcctgtgatcccagcactttggaaggccaaggtgagaggattgcttgaggccaggagtttgagaccagcctctgcaactcagggatacccccatctctacaaaatttttaaaaaattcgccgggcatggcggtgcacgctgatagtcccagctgcttgggaggcttaggtggaaggatcacttgagcctgggaggttgaggttgcagtgagctgtgactgggccactgccctccagcctcggtggcagaacaagaccctgttcccctccccccgagaaaagaatgtaatgtcagtagccatattcacagaattttaaatttgagccatcttggcatgttaggttattaacaaactgagcatcttgacctcaaattgctggtacctgccattgttcttttaaccagaaaggagctgttagggaggaacatttaccattttgtgagttatgtgtgagtggcttctcttctgttgatctgtttgtgggatcctttgcaaaaccactgctggtaccttatgggaaaaaaaatcagaaatcaaatttcttttggaataaactgtgctgttcttagcagatcttgtctgtgtggaacaaatcatgtctgtaaagaatcacgtggtcaaaagtttaatatttagttctttttggatttgtcagaggacttaattgctttgttagattgttgtcttgttctcctctttggaacaatggctaggacaaaacacagcattggttagtgggagggtgggaggtggttgatcagccatgtgcctctgaggccacaaagaagcctcacaggtcatggtttccactgtcagttggtcattacatcctcctgttgaagattgtgtttaccaagctcatgtgctcatcatgaaacactgttagacattgatttgaaaacaataatttcttttattttgattctgtaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgtgagaagagaagtcttttctctgaccagatgtcatctttccttttctaatacttcaggtcttatgccctgttgtatgagtggcatagttcattgatcttatcacaggaaatcagtgccttgagtatacgtatatggttgttgaaagaattcagttcagttcatgttatcagacatcataaatgaaaaatcttcagtgtcgtaaaggataggaagtgttaatttctcctttttactcttgtgacttttctagagggtccttatatattggggcaatttttaaattacaattaaaaaaatacctagcttaggctgggtgcgtcggctcaagcttgtaatcccagcactttgggaggccgaggtgggtggatcacttgaggtcagaagttcgagaccaggctggccatcacggtgaaaccctgtctccattaaaaatacaaaaattggccaggcgcggtggctcacgcctgtaatcccagcactttgggaggccaacatgggtggatcacgaggtcaggagatcgagaccatcctggctaacacggtgaaaacccatctctactaaaaatacaaaaaaaaattagccaggcgtagtggcgggcgcctgtagtcccagcaactcgggaggctgaggcaggagaatggcgtgaacccgggaggcggagcttgcagtaagccgagatcatgccactgcacttcagcctgggtgacatagagagactccgtcccaaaaaaaaaaaaaattagccgggcatagtggcgcatgcctgtaatcccagctactcgggcggctgaggcaggagaatcacttgaaaccgggaggcggaggttgcagtgagcggagattgtgctactgcactccagcctgggcaacagagcgagactctgtctcaaaaaaaaaaaaaaaaaaccctagctcagtctcctgggtgtatggtcagccttaacagtacctgctaattgattgatacctttagttagagtcagcattttgagccacagtcatggccaactgagtgttttccagattgcacctttaatcaggtcgttgtatctgcgtagttttctcatgttgctgctgctgcctttgtgtgtgcatcatccttttttgtcccttcttcttctgatttgttcttactgtgccccttcataccaggggagtgtcatttggcagaagtttattgattttcttaaaaaaaacaaaagatgttgattgtctcttatgtgctgtttaaggaactgggcatttagcagtaaactagacatacaaggcctttagtagattttgtttagttgttgttactgagttataacttacataaagtacacaaatcttaagtatatagcttggtgaattttgacataaatgttgcttctgtaactacccagatcaagtcttggactttacattctagtcgaaggaaataaacaataaagaacaagcaggagggcaatgcagaaagcagtaggatgattagattaagtgtgactgtggtcagaaaggctgttctcaggagggaaggtttaatctgaactcaatgacaggaaggagccagtctttcaagaatcaagagggggccgggtgtgggtgcttggctgggcatggtggcccatgcctgtaatcccagcactttgggaggccaaggcagtggatcacttgagcccaggagttcgagaccagcctggggaatccgcatctctaccaaaaatataaaaattagctaggtgtggtggcatgccccggcaatcccagctactcaggaggctgaggtgggaggatcactcaagctgaggctgcagtgagttgtgatcgtgccagtgcactccagcctgggtgacagagtgagaccctgtctccaaaaaaaaaggagacgtgttcccagctgaggaaccagctaacatgaaattcctaggatagggatgggcttgatgagcccacagaggcagaaggcagccagtgtggttcggcctgggagtggcagagtgaggttggagagagaggagggagcagatcctggaaggctgtgtatgctgagattgagagtttccattgcattctgtgtgtggcagaatcattggagggctgcagacagggaaaggacaaacggtattttaaagaaaattattctgggtttggtttagagagaaaattggctggggcaagagaaaaagctgttgtccaaatgagagatcatggctgcttgggccaaggtggcgtagtagaggtaggaagaagtagatttgtatggctttcattttgaaggtagtgtgaataggacttgctgatggatggggtggaagaagtgaaagggaaaaaaagaatcaggatagcaccgagacttttggcttgagcagtttacttacgtaaaaacaacaagaagctaagtaaaaatgactcgggatagttgagtcatttttgagttgaaactgatagcacctagtgtgtgccaggcattgttctaggcactggggatgcagagataagagagtaaagttcctgcccacaggttgtttagaacacagtaagcatcaaggctgggcgcggtggctcatacctgtagtcccagtgctttgggaggctgagataggaggatcacttgagtttaggagtttgaggctgcagtgagctatgattgcaccactgcactccagcctggggcttgaggttttgccagatggtttggtagagttggagatgttagcaagaaagggattacaatgtaatcattacaatggatctaagccagtgagggagttcagaacaggggaggtgagccaaggtgagaaggtgttagggtgatgaatggatggaagaaagtgtgagctggatgctaggagggggtggttgcagggcacatacttggctttgggattgaagagagacatggttactaggaatgagcaggtgtagtgctgaccatggacgtgggagcctgagatgggttggatgacagggtctttggaggagaggaggtccgaaagctgagaggtatgagggtcccaaactgagggtatggatgttgaaccagcaagagttatgatcaaagtagcacacacaaggtccttaggctagtgacagctggctggagccaaacgttaagatccagattggtggctccaggccctcactcaggactaagctcagctctgtgccacgtgtcctttctgcacttacaggtcgtctgaaatgctctttatgcatagggctcctgtactgtggttttcttctttttgtgtcttccttaccaagctttaagtttctggatggcaaggaccatattatttatcagtatgtatatccttagtgtctaaaacagcgcctggtacttagtagtgtgtgtcgaattgagctttccctagatctgtatgtggatttgaaaaccattgaaatagatcctttgaattttcagactgagggctcctgaaggcaaggagcttgtttaatttagcttttgctttccctgtgaccagcactgtctgtgatgttcaggagatgccatctgtatctcttactctctctcttttttttttgagatggagtctcactctgtcgcccaggctggagtgcagtggcgtgatctcggctcactgtagcctccacctcccgagttcaaatgattctcctgcctcagcctcctgagtagctgggattacaagcgtgcaccaccatacccagctcgctgcaacctcctcctactggcttcaagtgattctcctgcctcagcctcccaagtagctaggattacaggcacaagcttccatgcccagctaacttttgtatttttagtagagatgaggttttaccatgttggccaggctggtctcgaactcctgacctcaagtgatccgcctcccttggcctcccaaagtgctggaagttacaggtggaagccactgcgcctgccctatctttatttgcacatatctccctttctctctcattgcattgtgctttgatgacaaagatggctaaataatcaccatgttttgtttttttcctttgtttatttcttgcttgcagtcagagtacctctcagcttttcccttcctcacggatgactacaaaatatgatctgcaacattatttgccatggtttggtaaatagggggtcctcagagggctcttgacagacattctattctacccttaattaacagcaatacatctgtctgttgtgtgcttcccccaagtgataggtactcttagactgtcccttggcaatctcctgcaatatgttttcagctcaagcagtgacaaactagaagtaaatttgatgtggattaacatccagtgaacttaaattttcataccggatatcatttataattgtttgacaagatatttctttctttcttttttttttttttttttttttttttttttgagacggagtctcgctctatctcccaagctggagtgcagtggcgggatctcagctcactgcaagctccgcctcccgggttcacaccattgtcctgcctcagcctcccgagtagctgggactacaggcgcccaccaccacgcctggcttattttttgtatttttagtagagacggggtttcaccatgttagccaggatggtctcgatctcctgacctcgtgatccgcccgcctcggcctcccaaagtgctgggattacaggcgtgagccaccatgcctggccgatatttatttctttgcagggtatgtgaaaaaattattttagtgcaggttgggaatataaattatctgtattgttataatagtgattttctattaaaatcaccatcaatccaattgcacttttttttgcctgatttagtattatttgataaaggatggatggttagggttttttccacatttaaaagtaatttgaaaagtattttgaagaaagtactgcaaaggataaagtagaatatgaaaaattactaataatcctatcactaaaaggattacaatgaacattttgatgtatttactttttttttttttttttttttttgagacaaagtcttgctctgttgcccaggctggagtgcaatggcccaatctcggctcactgcaacctctgcctcctgggttcaagcaattctcctttctcagcctcccaagtagctgggattacaggcgcccaccaccacgcctggctaattttttacatttttagtagagatggggtttcaccatgttggccaggctggtctcgaactcctgacctcaggtgatccacctgccttcgcctcctaaagtgctgggattccaggcatgagccactgtgcccagccaatgtatttacttttaatctttttctatgtttaggtatgtatttgctgtaataaggactggttatactgcttgataacattgtcactcaaacatatatcaagagcaattttatgccatttaagtttttttagcttttcatgttgaatgcatgcgtagaattcccagtgtatttgatcagtcctctgttgattgaaacgtaggatgtttttcccttttatcaataatactggaatgaacatacaaatgaatcagtctttgagcacttccttgaatgtttccttaaaatagattcctaagagtagaattcctgttcagagttttaagcttttattgtattaaattactttctagaaaagaatgtaccagtttatattctcagcagtaatgtgtgagaatatccgtttgcctttccagcactggatgaaaacaaaaattggtctatgtgatagctacttctgaccccctgcccaaggaacagaaaataaatggtatctcagtgttttaatattttttattaggctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtgagtagttcctgatttttaatatatgttctgtagttttcaggtaaaatttcctgaagattgctcatgtgaaataagtgggcatttaactgtataacataacagagttgagtattttgaaaattaatgtgttttcgttagtcatagtaaaagataggctggaattctgaaatcatcttgaatgttgcagactcctcttttcttagccagtgagactttatttccgaggcagatgactttttatgtgtcttcccagcccctatgtagattaaaataaactaatagaaataatgctgtggagtagcacatcagttttgcctggccagcatttcttacctagcattcttcactgctgtgtcccaactagtgagaaagagaaattctaaaagaaaagccagaggaaaagtactggatgggtgaatgtgagcaaagaatggtcagctgtgcaagaatgcagctttgccatggcaattgagtttgcaaatgttaacatgacaaagcatcaactaatctgagccactgcatattgtaccttggattagtctctgatgggtctggttggatagtcaaatctgattgcccgaaataaggtactggtttctgttagatctgctgacatttgctatttacctgtctgctctgtggtattcttagaagttgaatagcattcaacagatctgatatatattgtaattaatgtctacagaatattaagagtcacatttaatccatagctcaaacctccatcctgaaatcacatggccaccactaggaaagttttcatgtggattccgtttttttttgttgttgttgtttttgagacggcgtcttgctctgtctcccaggctggagtgcagtggcatgatctcagctccctgcaaactaccacctcccaggttcaagctgttctcctgcctcagcctcctgaatagctgagattacaggcacacaccaccacacctggctaatttttgttatttttagtagagacggatttcgccatgttggccatgctggtctcaaactcctgaccacaagtgatccactcgcctcagcctccctaagtgctgggattacgaacatgagccaccacacctggcccatttcgtctgtattaattagcaagaatgttctgtcaggagaaacttcccttcagttcttttggttacctggtgatacagtttgtgtaggaaaggcaggatccctttccgaaataataagttggtttccaatcatccttcagtgatgaacaattagttttttttttttttagtattatttgaatttatgatttaaacatagtcagtgtgtttcacatcattgcagttattatccggatttgttgagaactttccttctgaatggatgttgaactttgtgaaatgcttcttttctttctgttaaaatgatcccttagtctttcttctttagtttgttatggtgaattatgtttttttgtttgtttgtttgttttgtgtatttatttatttagagataagttcttgctctttcacccatgctggagtacagtggcacgatcacagctcactacaaccttgaactcctaggcttaagggatcctccatgccttccatgcctggctaatttttctcttttctttttttttttgagatggagtcttgctctgtcgcctgggctgcagtgcagtggcgtgatcttggctcactgtaagctccgcctcctgggttcacgccattctcctgcctcagcctcccaagtagctgggagtataggcgcccaccaccacgtctggctaattttttgtatttttggtatagacagggtttcaccttgttagccaggatggtctcgatctcctgaccttgtgatcctcccgcctcggcctcccaaagtgctgggattacaggcgtgagccaccgcgcccagcccatattggttgtttctatctcctttcttttgttaagtctggctagaggtttatcttattttattatttgtattttatttttaaacttctcagagattcaacttttgctttaatcagaaagccttaaaaacacttttcttctctaatgtatacgtttaatgctgtaaatttccttttaagcttgctttactgcacgccacaaatttggctatctttttgttattgatttctaacttaattgtgtaagtattggaaaacagtcattatgaaattgtctttgaagttttcaagactttattgtctaatgtggaagataaatatctcagaaccattagtatttgatttacatttgataagaaatgttaatatttgaggctttttggtaagtctcgctttgttgccttggctattcacagctgctatcataagcactacagcctcaaactcatggcttcaagtgatcctcctgccttagccttctgagtaactaggactacaggcgtataccactgcacctggctgagttttgtttttctttatttcaggtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacagtgagtattaaatgggctagtaactgaacgataaatgaaatattttgtgtctggcaccacctctttccatttaggagaagagggaagcaggctgagcttcagtaagtcttggaatacctcttctgattcctgactacagagtgtaataacctgagaatcagccagtttgggttaaaagttacaggaacagcagttcttgaaaatttctttcttgcgtgctaacctaataaaacaactaagtgtttaccagattatatgcagtttctaaaattatttttatgcttaaaaacctaagaatgatgatgttttctttcttagtctgaccaaagccttccgtctctcaaacttatttcttcagctactctagttttaactatttttcaacattattaggatctcttttccttcattctgggtatctgctttctctggaccaagcgctgttctaactgtggttgtgtcagtggacaacatgagtccttcccttgtggacagtcacttcttcatcccaatccattagcctattcttcactccctattttgtccatcttgtatttcatagtccctcatttcagcaatactctgccaatcctgtactctccctcccagcttctgagtagcgaaatcctgctgtggaagtcctcccaccagagcccattacctttctccatagattcagaacccaaatctcaaatgggccaatgacttagcctggcaaccataactcatctctcttacaaccttactaatatttaagccttctctactatctttgagactcctgacctccttcttccaccaaatgacctcatcatgtcacagaaaaaatgggtacccttactgacatttgtagccattctgtactcttgaccacctgttataatgtcttgccttctgcctgtggccagactttgctcacctggcttggaattccacccttcctgccttcttttttttttttgagacagagacttgctctgttgcccaggctggagtgcagtggtgcaatctcggctcactgcaagctccgcctcccgggttcacgccattctcctgcctcagcctcccgagtagctgggactacaggcgcccgccaccacgcctggctaatttttttgtatttttagtagagacggggtttcaccgtgttagccaggatggtctcgatctcctgaccttgtgatccgcccgccttggcctcccaaagtgctgggattacaggcgtgagccaccctgcccggccccttcctgccttgttagattcacagtgcattgccagggttcttctgttccttcactcttttgtagagatagcttcttcctttgaactgcttccttcctttggttttgaaacttgttccagtcttctgtttttttcatgtaatttcttttaaaggatattttaaattgttaatacagtgcctgctttttgtatcaagtgtaccttatgcagatgtctaaagaaaaagtaattccaccaatacttccatctctcttgaggcaagcagtgtgtgcgctgttcacgttgctgaaatgtttcctccatactcacacacacatgggtttttctgcacatggactcataaccagcggtgcttcgttaagctccattctggactcagaggaatgctaagcctcttgaggtgacggtctggagctcaccttgtgattagtgtgttgtgcctctgggacttgatattggtctctgccagagagactgagttgccttctatccatctgttcttgtttccgcttaaatgaacttttcaaaatgtaagccttaccatgtcatgctcctgtgtgcggcacggtcactctgtgtagaatgtcatcgctgctttattcccctgtagcagttacccccattcattctgtatgtttagctgttgctgtccctctctgcccacaggaatataaattccacagggagagcgtctgttgtggtccctgctgtggccccaggacccgtggcaaagagtaggcatgcagtaaacttaggtgaaaaactgaatgaaacccccggctgaactgaaattacctcagtgaaattgtgaacaagagctcgctgggaccttttgacatttgattggtgggtccagttagcctagcacaaatgccagctcccttcctggtgcctgcagggaaattgctggcctctgtcatctaattatacttgacagaatgctgtggtggagattagtgctaagtggttgcctgaagatcagtgcggtgaaaatgttacagctgtgattggaaacgtaaccctaactgtgataacagcttcaccttcttcgcaggttttaaagtgctgtttgcctagtcctattttgaatgctgattaaataagtttgaattggttaaattgcttgttttctcctcctttaattgtttaagaattggcaaaattaaaaaagtgttttctgtaaattatctccttggggcttaataccgagtaaaaagaaatgcaagttacctaaaatgtttcctatgtcttataaactagaactagagaatctttaaggaagaaaggttttggtttattttgttttactattatggcatccatttcttatttactatctaggtatggtatagacgcttaacagaaaagcaaatacagtgtcaacaaaaagtgacagcaggtcattctgccctttctttgaaagggggtcatagggattttctgctaaagggatttaaaattgctaacaggtgttagaagattggagatgattgtctgaaatagatctttaagattgcattggatttggagaagtgtttgtgggggctggggggagggggacaagacggggtggcccagttagcacagtggactgggcttcctctctcggtggcacttagctgatggcttggcctgcccattctgatgtcagtggaatgctgtcaaggctttgcacctgcagaacctggcaggtgcttgttcaactccattctggattccagagaatgctaagcctctgaggtgatggtctggacccacctttgtgaccagtgccctgtgcttcagggacgtgatagtggtctcctctggaggtactgaattgggtactgcattggtctgcaacaggagagtctcattcttcatacacagagaaggggcagtacatgtgtgggaagagacacagggagagcagggctggtctgacggggagggacaactgcagaggaaactgacttcaaaatatccttctctatttttacttgatgtttgtaattttgcactttctcctttttgctttagattcagagaattgaatgttttaagcctctaaaattaaagtatgtattaatagatctgttagttaagcttacagttggaaataaatcttaaaataagtaaaagaaggaaacattattaattacagcgttattattattattattatttttgagacagggtctcactctgttacccaggctggagtgcagtggtggaatctcggctcactgcaacctctgccgcctcggttcaagtgatcctcctgcctcagcctcccaagtagcaggaacaggcatgtgccaccatgcgcaggtgtgcaccaccatgccactagctgattttagtatttttagtagagatggggtttcaccatgctggccagcctgggctcaaactcctggcctcaagcgatccgcctgcctcggcctcccaaagtgctgggattacaggtgtgagccactgtgcccggcccagcattatttgtaataatgaaattattattattattattattattattattattttaggcagagtctcactctgtggcccaggctggagtgcagtggcatgatctcggctcactcaacctctaccttccgagttcaggcaattctgctgcctcagcctcccaagtagcagggattacaggcacctgccaccacacacagctaatttttttgtatttttactagagatggggtttcaccatgttggccaggctggttttgaactcctgacctcaagtgatccgcccacctcagcctcccaaagtgctagggttataggtgtgagccactgcacccagccaataatgaaaaattttaagagtccttaagtattcagcagtagataggaaatggctcagttattcaatatcaatttgagcaaatgttgtatactatgaaaaacaattacaaagatcatgtagaacaagtgaaatatgaaaaatgaaaggtatcagaaatgagaaaatatgaaatatatactgtttacagctatatgaaatatgtacatatatatatggagagagagagagagacaaaagagaaatgactaacaaaaatggttgtgtaatactttttaaatgtggaacctgacagcatgcttctaaaatttagatggaagagcggaaggccaagaatagctaagacactcctgaagaacagctaggcaaggagatttttcctaccagatgtcaaacttaatataaagtggtaattaatatagtgtcctttgggcaaaggaagatgcagagggatcagtagggccaaattgcatgcattgaaacagacatgctgtagtcggcattgcagctcagcggggtgggggatggacttggcaatgatggctgctgggatgcttgggtagaaaagtcacaagtggaaataattatatgagacttctatactatacataatcacaaagcaatcccagtgaattaaagattaaatgtgaaatgcaatactttaacaattttaggactaatataggtgaaaatcactggccttgaacctctggcctaaggagagatgtcttatgacacaaaaatcacttatcgtaaaagaaaagatggataaatttgtctacatttaaagtagacaaactttttccttattaaaagataccataggccaggcgtggtggcttatgcctgtaatcccagcattttgggaggctgaggtgggtggatcacctgacgtcaggagttcgagaccagcctgaccaacatgatgaaacccatctctaccaaaaaatacaaaaaatttggccaggcatggtggtgtgcctgtagtcccagttgctggggaggctgagacaggagaattgcttgaaccctagaggcagaggttgcagtgagctgagattgtgccactgcactccagcctgggtggcagagtgagaccctgtctcagaaaaaaggtaaaagataccataaagacagtaataataaaagccgcaacctggaaggtttgtcccacatgtagccaatagaaattaatatctggagctgggtgcagtggctcacgcctgtaatctctgcactttgggagaccaaggtgggcacatcccttgaggccaggagtttgagaccagtgtggccaacatgtgaaactccgtctctgctaaaaatgcaaaattagccaggcgtggtggcgcgcacctgtaatcccagctactgggaggctgagacaggaatcacttgaacttgggaggtgaaggttgcagtgagctgaaattgtgccactgcactccagcctgggcgacagagtgagactccgtctcaaaaaaaaaaaaaaagaaataatatctggaatagataactgtcagtaagaaaaagacaaaccagtataaaatggacaaaaggcaagaaaggaatttcacagaaggggaaataagaatgccttataaaaatatgaaaagttactgaaatcatttggtcaccaggaaattataaattcatatcacaatgaaatgtcattttatagacatcagatttcttttgttgttgttgtttgagacagagtctcaccctgtcacccaggctagagtcagtggcacgatctctgctcactgcaagctctgcctcccaggttcacgccattctcctgcctcaacctcccgagtagctgggagtacagtcgcccgccaccacacccggctaattttttttgtatttttagtagagacagggtttcaccattttagccaggatggtctccatctcctgaccttgtgatccgcccttctcgccctcccaaagtgctgggattacaggcatgagccaccatgcctggccactagaattattgtatttcttaagctaattgatagatacatggatgtttgatttattattatacttacattgtcttatatcttgtaaatacccttgtatgtgtgtttttaaaataaaggcttttaaaggaagcaaaacaaaaatctgaaacttaatcttttctaattttcatccttaattttcttcattccaaccagtatatacacagatcccttgttttatgttttgttttgactgagcttagcaattagacaactgcttacttttgtgttaaatagtttaacaagtcaggatgggctggatgcagtgactcccacctgtaatcccaacacttttggaggccaaggcaggaggatcacttgagctcaaaagtttgggaccagcttgggcaacatagtgaaaccctgtctctattttaaaaaaaaaaaaaaaggtcagcatgctttttaagataaaggaggctgggcacggtggctcatgcctctaatcccagcatttttggaggccagaaaaagtgggtgcatcacttgaggccaggagtttgagaccagcctggctgacgtggtgaaaccccgtctctactaaaaatacagaaattagctgggcatggtgtgcctgtaatcccagctactcagaggctgaggcaggagaatcgcttgaacccgggaggcaaaggttgtagtgagctgagatcgtgcccctgcactccagcctgggtgacagagtgagctttgtctcaaaaaaagaaaaaaaaaagataaaggagctgacttaaggaaatagaaagcaaggctgactcagcattgcaaagaagtgggtcatagggatttatagagactgggtgttgtagttcactatccatgtaaatgacccctagcaatgatttagtgttgctgctcccactaccactaatgatggtaataatgggtagatgccgtttattgcgagctttattgtagacacaggctcttccatccccacttagtcatgaggaaaacaggagctcagggtgcccagaacaccatagccagttcttggcagagctaggatttgaacttaagtgttatctgactttggattttgtgctcttaaccctgttatgctctacagagacaatcaggtgagtttagcctacagatcatataaggggagacaggatagatttagatgtctgaaaattaaattgtagaagggggttagaatttgttctgtgttatatactagaggcagtggtgacaaacacaggaaaacagatttcttctcagtgctagaaagaacgttttaatccttaagtctctccagcatctgtttatgacagtgcttcagcgcccatgacacggtgggctctcagcgagtaggtggtcatttctttcctgaatgaataaatgagggaggctggggtaagcatcctcatcactgaaactaaaacaagcagaccctgggtatgcttctgtttgggccactacagaagaaatcactatgtggcttaggaagctggactaaacaccttaagtccttttcaacaaacactcagctccaactgtccgaccctagttaggattctgggttccttaacccattagtaaatgtatttgaacttaatctttaggaagccttttgagcctatactaaaatcattataaaaactagaatgaatatttttgagggcaggtctcttcttttttactgctgtattcctagtgtctagcatatgcttgatgcatagtgtaaaccaaatctgcattgaattaattactgtgggagaaaaacatactgtggaagaggcaaaccaatgaaggcaatgaggatgtggtgttgtagagacttaagaaatggattatggtgggcacagtggctcacacctgtaagcctagcattttgagaggctgaggcgggaggattgcttgagttcaggagttcaagaccagcctgggcaacttagtgagaccccatctctaccaaaataaaaaataaaaaaatagccaggcttaatgacttgtgcctgtagtcccagctactcaggaggctgagatgtgtggatcacttgagtcaggaggttgaggctgcagtgagcatgattgcgccactgcattacagcctgggtaacagagtgagaccccatctcaaaaacaaaaataaaaaacaaaaaaaaaaacagatcaagtagtaagggtacaagttggttttaattatttttttattttttatttattttatttatttttttgagacagggtcttgtctgtcacccaggctagagtgcagtggcacgatcatgactgactgcaacctctgcctcctgggttccaagtgattctcgtgcctcagccacctgagtgtctgggactacaggtgcctgccaccacaggtggccaagttgtctattttattttatttttttagtagagacggggttttgccatgttgaccaggctggtcccaaactcctgacctcaagtgatccacccatcttcgcctcccaaagtgctgggattacaggcttgagccacagtgcccagcctaggtgttaagtatttttaaaaattcattttgtcagtgcctactgcagcaaggaaaaaaaaaaaaggacattctgtttgactttttaaaagtaagttttggccaggcacagtggctcatgcctgtaatcccagcactttgagaggccaaggaaggcagatccagttgagcccaggagtttttgagaccagcctggccagcatggcgaaaccctgtctctatacaaaatacaataattagctggtcacagtattgtgcgcttgtagtcccagctacttgggaggctgaggtgggaggatcatttgagcctgggaggcagaagttgcagtgagccatgatcacgccactgcactccagcctgggcaacagagtgagaccctgtctcaaaaaaaaaaaaagaataatgtaagttttggttttcattattatatccctgaggagtgacacctttttgcctttgacactagtagccaccagaaagtgtgacagagtaacccagcagtaatttattgacctgtcagaaggctagtgtggaactgttttttccctctataaagtcagttatcatgaacgtgagcaagaagcacttcatatatgtgataaattagtacagtagaataatggaaagcttccagtaccccttggcttcgtgacaggcattgtgcatggacgcttccctgcatagctcactcagtgttctgaacaaacccgtgaatttgtagcctgaaagagatgcaaataatttcacttggatctttgagctaattcagtcattttccccacagaccagagtgaactccgagcaggaacacttcctcattgtcccttttgggcttctttacagtgaagtgactgcatccagtttggtaagaatgtccttctctttggcagcttgtatgtgcaggtcatgttaggtcattcaacatcttcagatcagctaaatatgtaaaacccaagaaacaagaaagagcctatgttttatgtggtgtgttcagttagagaaaaacctttgagagaagttacaaatattgtaatcttgagtttgaatagtttctagttagggtaatttgaagtcctcttgggctggggtgcagtggctcatgcctgtaattccagtacttaagttcgagaccagcctggccaacatggcggtaccccaactctacaaaaaaataccaaaattagctgggcatggtggtgggaggattgtttgaacctgggaggtggaggccgaggtcgcaccactgcactccagcctgggcgacagagccagaccctatcaaaaaaaaaaaaaaaaagaaaagaaaaaatgaagtcctcttggtattttacatttttatttttttattttcaggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtgagtggctgccctggtagcatctcaaggtctaaagctgctgagtgaaaggcactgcacgtttcctctgaattgcccttgttgtttatagtcagtaaaactaattttgttgaatataaaaaaaaaggtgtaccactaagtttgactttcttaaaataattttttttccttttaaggggtccatatatcccatttaatttggaaaaacatgtaataagtctgaaaatgcctattagatttaacaattggccgggcatggtggctcatgcctgtaatcacactacttcgggatgctgaggcgggaggattgctgagcccaggagttggagaccagcctgggcaacatagtgagaccccgtctgtacaaaaaaaattaaaaaattaaccagtgtggtgcgtgcctgtacttccagctacttgggaggctgaggtgggaagattttgagccaaggatgttgaggtttcagtgagctatggttgtgcctctgaactctagcctgggtgacagagtaagaccttgtctcaaaaaaataaaataacagtaaacaaaacaaagtcatagagaattgagggagaggtaagatttcagggtgttgaagactgtggggacgtgcaaaatgacatcagtaagcaggcatctcgttcgagaagaatgggaaaagaaggagagggcaagctggggtggtgggtggagggtgctgtgggctcggggaagggtgtttggggtgtgggagacttgaacgtgaggacagtctgtggggacgagctggggaaagggagaggttgaggcctagaaaccaacctgtccagctccccgcagccaaccagcaggacccaggctggattgtgacggggaagaagaaaaggagcggctgggagaggagacacaggcagtgcaggctgttacgaggcttagcttccaagctgctcaggaaccctcctcctcagctgtgcaccaagccttaccccttctggtgtgaatgggccaccctgacaaagccccagacccctccgtatgaaagtgcacgtgcaggctatctgctcaatgtcatgtgaaagcacagtacttgagaagtatgctttttatcaccaattttatataaggacttttggggtttattgtacaacagatgaccttattgattcagtaatgctgtattttttttttttttttgagacggagtctcgctctgtcatccaggctggagtgcaatggcgcgatcgcggctcactgcaagctctgcctcccgggttcacgccattctcctgcctcagcctcccaagtagctgggactacaggtgcccgccacctcgcatggctaattttttgtatttttagtagaggctgggtttcaccgtgttagccagaatggtcttgatcgcctgacctcgtgatccgcccgcttcggcctcccaaagtgctgggattacaggtgtgagccactgcacccggcccagtaatgctgtattttaattgatcttggttttttttttggagatggagtcttgctgtgtcacgcaggctgaagtgcagtggcgcactctcaactcactgcaacctctgcccctcgggttcaagcagttctcttgactcagcctcccaagtagctgggactacaggtgcacaccaccattcccggctaatttttgtatttttagtcaagatggggtttcatcatgttggcctggctggtctcgaactcctgacctcaagtgatctgcccaccttggcctcccaaagtgctgggattacaggcatgagccaccacgtccgacctgatattgatgttttaatgtcatgtgtgttggattatttggatgaacattacctctggtttgtttcactctgaacatatggttcttatgtcaacatcgtggttttattagatacatcattgtgtgaatgatgtgattttttttttcctgaaagaatgcatgtcactccagccactaaaatgtttatggattttaaagaactattaaaggtacctttgacagtatggttatgaacagctatcacgtaacgtgtttttgtttgtttttctgagacaggatctcaccctgtctcccaggctggagtgcagtggcacgatcttggctcactgcaacttgcatctcctgggttcaaacgattctcccacctcagcctcctgagtaggtgggactacaggtgcatgccactgcacctggctaatgtttttattttttggtagagacggggtttcaccatgttgaccaggctggtctcgaactcatggcttcaagtgatctgcccaccttggctcccaaatgactgggtttatgggcatgagccactgtgcccagcctctttttaaaattatcaaaataattttgcttggtaaggaaatttcttcttgtatgagagctgatactttggaaggagttaaatgtggtattgtctttttaggttaacttttctctatggaattgataaagatagtttttgaatctttgaagcctgttactttagggtcataatgttgctgtctataggtcttgtctttagaagaccttcaaaaatggcatattctgaggccactctggggaattttaggaaacttaaggactctatgaacacttagatttttctctttgagagtcaattttacttaaatacatgtagagaaattatataagaaattatatataaattgtatatatataattacattatatatatacaaacttgtataaatttgctttcacctaatttttaggtgtttcaatgttatctacaacctaagataaaaagtacagaaaaactttagagcacttggaaaacctcctccttttttttttttttttttttttttttaggagatgagggtctcatatgttgcccaggctggctttgaattcctgggttcaggattcctcctgcctcagcctctagagtagcctcttgactacaggtgcatgccatcacatctggctaatttaaaaatattatttgtagaggcgggggtctcactttgttgcccaggctgacgtcgaacttccaggctcaagtgatccacctgccttagcctcttgagtgttgggattacaggtgtgagccaccatacctgatgggaagccttcttttgaaatgcactgagtcctcagaggagtctgtggtctgctccttgcactagatgcagtgctcattgtataattaaatccaggtttacatagcacttatatcagtgggaaaaagtctagaaagatgtggattttcttttgaggctctcccagtttaggggtagttttgtttttaagtgtgaattgttagcactggaaaccaagtttgtcttaagttcatagattgattttcaagaagaggacaaaaacatttcccttcccattttatttctgtgaggaaagcatttaccatatcatcagtcattgtgtaaccccaggttttccttcttcatggcgaccatttggtctctaggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggtcagtaggcatctaatctggtatttaaattacagcagaaagaagaataaagcaaaggaccagtcttcctgcccagctccacagagcattcatgcttcccctcaggttcttattctccggaaccatgggctcgtgtcagttggagagagcgttgaggaggccttctattacatccataaccttgtggttgcctgtgagatccaggtaggggacagccattccagtcactctgcagtttatttagatgtgtctggggttcacatagatttttttttgatacttatcgagtaggagaggagtctttgagcaatctctttgccaaagataagctcatggatttgggacttgatcaggacaaatgctgtttcactgattgaagttggcaaaggattactgggcttttcatttctaatttttaaattttcaaatatgtcagtcactaccatttatggagtactggtgtgtataggcctggcatcaggtgcttagtgtgtgtcatcgcatatgtgatgtcacgtgacccccacagtactctttgaaaaagcaggtatacagaagtagagactcagagacttgcctgcagcttacagctgtgagttcccctccgctccgtcagccgttagttcacgttctcccctctgcttcttgacttatgtctgtggcgtagtgaagtcccaagtcctttgtaggatcctgaaaggtgctgtgttttctcatttctctgccaactttggtgcccaatatttttgtcatgctaaagaaatacttctgaaagtaactttgtgatcagtctgtcactatccattctacattttttattcttacactctagagatttggtttcttttgaaacctacatttttattcaagtcatctgaccctcttgatctcagtaaggaactcaagccatgctgtgtgtgttttggaaaaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctggtaagaatggtgccaccacttgatgataaaccttttgttctaaaagcatcagtgttggtgttcttacagcaagtgcgattgctgtcttttatgcagtatctgaataccttcaccttcaaagtcatgaagaagcactagggttgtttaacttctgaggtaaattacaataaaatgtagaggtgaaggattcctggtattgttttattttttaaagataaccttgtgtttggactcagtggggacaagagcacagagaatgcgtaggcagctggatgaccagctgtgtcagctcagtccccaccatcccacaagcaagcgagagaggtggcacttttgaaatcggtcagtcaggtatttaggcttttgtcttaacagcaaatcctggctgtctggggcctgatgactgtgttccatgggtatccactccctgtccacagcgtgggagcccctcagctgcttattgcagggacacagagcccggcatggtccagaaggcgggcttatggggcctgcagcacacagggaaagtgagcccacactgtgataggagggcagacacacaggatgtgttctgtgttacagggttgccgtgaagaatttcattcttttgcaaggactggagagaaaattttatgtggaaggtagcccttggaaatgacctcaaagaataggtaggatcttagcctgcgtttgaaagcctggaaaaaaacaggatgacaggatgaagaggccacagcacagctgcagacaatgggagtggggagatgggaacatgcaacgtacggtgcacctttcaggttcatcttgactttaccaggatcattaaatactcagttcttagagctgtattagaacactgcccttggggtctcagtcccgcagccacatcatcagacacagggctctggaacagatcccttccatgctgcacatcagacctcttagatgggggtcacgatggtccgtcctaacgccacatgacctcaagtggtgtagatgtgaggacatgtcagtgtggggaaagaaggcctcagaggggccagtatccttgtatgctgccagccagtactggacaagtgggcacgttccagcctaagacaggcgtggcccttggaccagatcacagatgagatgggtggcttcaggaagcagggtggcttcaggaggcaggaagtttaactttcctgaaggtttggaataaaaagtattcataggtctgattcaggctatgttaaatgttcttactgaaattctttgcacttgggatgaatattgtccgctagaaaggaggaactgagggttttctgcctgggcgcgatagtcagtcagtggagtagactcaatcagtgacacagggacgaacagagaaggcagagtctagcgtaactttttgagttcatataatcagtgaggttgattgcattaattgactgtctactgttgagtcatgaacaggacacagttcttgccctcaggagtttatgacctaataagagagatggacaaacgattcccaaatgagccctgcccctgtgatctgtgcagtcataggcatgatgagagcttgcaggcagaggtgggtgccgattggtcaaggaggtaggaagaggagcaaaagctcatgaagaaggctgaagaagcagttagagttgggtggccagccagggtagtgaagctgcagggactcatagatggagaaagcttgagagtggggcagccatggcccaggtgtgcgtcaggagccaggtcatccagcatggctgtgcaaggtaaggagggctgaggttggcccagtcacacagcccctgcctcctggtaaatacggcgacattttgctgctcttctacttacagtcagtgtgagggaggagagaggggggtcagaatgcacagcagccaccaaagactgtgctgaaagcacatcctagaaggcggagagggggaagtcaaaatcaggtagaaactctgatttggtagggaaggaagataaggatgaatgattaataagtaaaacattcattacaaaaagcatgatgaatgtttactcagtgtccttaatgtgtacagattgttttaatattagaaggccatatagtttataagaaataaactagacagcaatcactaatcatagtccatgttttaatttagcatcggggttggcatatatgttgtttgctaataactgagtagagaatagttgccaatttccacactataatatatgttgcagccgagcacagtggctcactcctgtgatcccagcacttcaggaggctgaggtgggagaccaggagcttaagaccagcctgggcaacatagcgagattcctctccacaaaaaataaaaaaatttcaaaaagagagataatatttcatttgaacttctacagttagaaaaaaaatgctaaattgtcccccccccaaaaaaaatcaagatataatttcagtttctcaaagaaggaacaaatccatatatattttctctttctttttttttttggagagacaggatgtcatcatgttgcctaggctggtgttgaactcctgggctgaagcagtcctcccacctcagcctcccaaagtgctaggattatgggtgtaaactaccacgcctgacccaaatccatgtttttaactacaagccagatagtagttctgaggtctgagtattacttctggttttggtttaacagcatttaaaggggaagaataaagaaaaatccatatggtttcaggataaaatgatgttgatgagtcctgggtggtttattctgaagttgtggagattactgagttctggctctttaagcaaaaggaaacttgaattaataagaactgtgtttttctgcagatagtctttatggcagagtcattctcttttattattcctcaacaaagcatgctcagaaatgggaaaactgccagtacacacatttaccttatctttctgaggacaattatgaaaataaaacccaaaacaactccattcatgattgttattacctttttaaaaaaatgtaggccggtcacgatggctgatgcctgtcatcccagcactttgggaggccaaggcaggtggatcacctgaagtcaggagttcaagaccagcctggccaacatggtgaaaccccttctctacaaaaattagccaggtgtggtggagggtgcctgtaatcccagctactcgggaggctgaggtagaagaagcacttgaacccgggaggcagaggttgcagtgagccaaggtcgagccacagcacttcagcctgggtgacagagcaagactccatctcaaaaaaataaaaggaggccgggcgtggtggctcatatctataatcccagcactttgggaggctgaggcaggtgggtcatgaggtcaggagattgagaccgtcctggctaatacagtgaaactccgtctctactaaaaatgcaaaaaattagccgggtgtggtggcacgtgcctgtggtcccagctattcaggaggctgaggcaggagaatagtgtgaacctgggaggcggaggttgcagtgagccaagatggcgccactgcactccagcctgggcaatggagtgagactctgtctcaaaaaaaaaaaattaaattaaaaaaataaaaaaaatattgaaagagtgattagtaatgaagatggcccccaaaaaagagcagtacccagaggggagagagaattctgaattgagaggactgtttctagagtaccacagccagcagggcacaggccactgaagtgtcttgtatgtctgaccctgtgcagtccctccaagtcctgattctcttgtgatgtattgtgaaggtgctgtgagtgacttggttcaggtgcgaatctgttaggttgttgagcagacagctcttcagcatcccccgtattacctctctgtgctgggcaacaaatcactacaggcctggtggcttcgaacagcagccatttatttcctagcttctgtggggcaggagtccaggcacagcgaactcaacctagggtctcataaaggctgcattcagggtgttggctagggctgggttctcatcaggagacttgactcagaggatccacatccaggctcttctagactggggacagaattccttttcttagggctgaagcattcttggcagctttacttcttcagagccagcagtagagacagagactcttataagataggtgctaaactcttctgtgatacagcccatcatcaccttttgtgaattccgctacttagaagcaagtcagagatctcacctgtgctcaaggtgggaggggattacaggagctgggggcctggggccactgtgaagtctgtctgtcacacttaccaagtgtggccaggagagatgcagaggacaccgtccatgcccttagagatgctgtctgtgggaggactctgcagatgagttggtccagtagaggcatgaagtaagtggggctgtcttttaccacagagcacatggtcatgaggcagagctggaggtgaatttgaatgttgttgtattcagacgtaaagtaattttgctgagaaccagttgtcatgaggtatacttacttaccttacttacctaaagattatcacagtatttaaactgtaacttaagaggtaaaagtctattaagtatgttgatgaatataacctgcacagtggctggcagcaagtaaaccctgtttgggtgttcaactttaattttttgttgaaatatgtaagcaggagagtgcacctaccgcaagtgttcagtttgttcatttttaaaaactgaaccccctgtataaccagcagtcaataagagcaacggtagcagcacctcagaacacccccagcacctccttcagttcacttgtcccatcccaggggtgacaactgtcctgtctcccaggacaaccaaaacaaaggttgttttgcatcttctgcacttttaatgaatggtattacatggtgtatgttctttgcaggttggtctctttcactcagcgttgccttcaggagagtcatccacgtggttggtttagagcacattgtgtcactataagccttcttatgaagacactagactatccatctcctatatggatggacttttgggttgtttccaattgtggtttacgaggagtagggttgctgtccacattttagtacctggtttttggtgaacacatttgcttctgtggggtgtaaaattaggagtggaattactgagtcatagggtatgcatgtgttcaacttttgtggatgtttccacatgattttccaaagtgaaaccctgttttgagatctggaatattgactgtctttcactctccttggaccctagggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaaggtgcgtcctgcgtcggcactcagcgggggcttgggtgtgggattggaagggatgccagctgctttggggggagcgggtgcttgcttctagcagagggcatctgctgttgttgccactgttgcagtgaagccatctcttcacaccgctgctgttctaccaccagtgtgaagtatgagcagcagacattttttgggccctattgattcttgaactgatgtttgctcacgatgtttgctcaccggtcagaattggaagctgcaaaacctgttcttagcaagagcagactgctgtccctttcagggttcgttcaaagacttgtgagtggcatttggtgtatcagagcaggagccctgccagtgctcacatcactagacgatggacatgcagcgagtgtttcccccaagttaatgacagtgagagataggtgtcctgcccaagcatctggaagatgtggggagctgggaatagtctccatccctgcagacccacgccccactaagcaggcatggcggtcactcagaacacatggggccatcctgcctgcgtggggcagtgggagagctgaaatgtagcttccatgtggctggggcccaagtgcacaagcagcagggctcccaggcagcatggctgctcaggactgttgatgtgtgcctctccttcccaccctcagatccgagagcagaatttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcgttgagttctagaaggagcgagcatgctgagggctgtgtccacccctctggtcatgccccttgtaatgcatgcatatgtgagggtggcacatacaccaccagctttggggctcagattcggcccgggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaaggtactcactgccctgtcctcactacctgtctatgcgccttgctcccctcccctcccccctccccgtctcctctcttcaggcattgtcttagttactgaagtagcttcaaatggatctttaacctgtttgtgagattgtacagaaggttctgttctacctacttgattctttaattaaaacatttgctatgaggtgtgataacaatttccagcattcgaagttgttactgagaaatggccagtctgagcaacgtggtgcatttctgcagttccgcacgggactttggtcagtgcgtgttttgggtttcagaatttgccttttccatgactctgactgcagacagcctcttctgggcagtctgttgctgttggcagcggccactcccgagtgcccttccaccctcgctggttcaactttgactgtaaatgtcatgaatgtagccactagaggtcatatcattgaaagatgtcatttcagaggaatgggaattcagacagtctttgtcagcccttgataaaatgtatttatttgtacctcaaaaaaaaaaaaaaaaaccctaaataacatttttaaatgccacagaggagaaagacttaggagagtctgaaacccctcactgtgattccctctgtgtgcgggcatctagtatgtggagtaggtggaagatctgtctgaacccacccacgtagaaggaaatcctccctaagaatctaggctgctagtgtgcaggagttggtgccacgcagaaaggggctgaccgcatggttgaagagtcttagctgagaggtatgtttatattcttgtcaaaggaaatttccagaactgtctctttcacttgtcacaccttcattgagatgcatgtgtcactttagtggtgttccagttcccacatagaagcaggtttatagcaaagattctgtattcctgtctgtaatccctgctaataacattattttgcatatttacttattaattccacaggtcctgtttttccctgtgcttagagcatccttccagctgccattcttggaagagcttctcagagcaggggagaaagatgactctgcctgttgcttgtttttcatcttttggcactttgttgcggtcttgtcagttattctttctctcaggtgtgtgagggctgtgcaggccatgagcccagctggcctcctgtgtagagcccacgtgagggcagcactgaggaccttgttagggctctccagaaagcagcctgggtcgccgtgttcaaccaccagttacagctttgtgtgctctgtcccagtgatattcagatgtgggtgtgtgtcactgtcacctgggggcttcctgaacgatagaggtagggtccgtaccttctgaacaccatgctcactgcgagtgctgcatccaggtgtcattagcagagaataccactgtacgctgaccccagaggaagagagcttgaccacctggacagaaatccttgttccacctttgtgttttctctacctccttatatctgaagtttacttttgcacccttgatctttatcccactctggctaaaatatccctctttttggtgagaatgtgctttggctccatgggagtcctttactgggcaattgttccacttcctttcatgtgaacctcaaagcacagacagtcttgctccttttggaacatggagctgcatgttgagaagttgagtttttccttgaccaagcaaggacgactgtgtcccacacactcccctccccagtgaggcgagtgcgtggatgcctgcttcccatctgagaacctgaagaatgggtatttgggacttagggagctggggcttttctggaaaggactttcctttgccttccatttctccctcactggtgatggccattcccacagtgcaagtgttgccttctgatagaagaaggaacagtaatcacagttcaaacaggagttcgcagcccagccgaaggctgtgttgactttgttttgggcagcataacatgtaacctgaaatacatatatatatatatatattttttttttttttttgagacagggtctcactctgttgtccaggctggagtgtggtcgggctgtcttggcccactgcaacctccgcctcccgggctcaagcagtcctccctcctcccatctcagcctcctgagtagctgggactacaggtgcacatcaccacacctggctaaatttttgtatttttttgtagagactgggttccgccacgttgcccaggctggtctcaaactcctgagctcaagcagtccacctgactcagcctcccaaaatgctgggattatagggtgtgagccaccgcgcctggcataacctgaaataattttggctgccctctggattcaattgcaagtgaaatgaaggattagagatgaagatgtgagtctacactgcaagctattcagcccagggaaggactcttgtgttcccatgtgcacctcaccaggggctgtgttctccaacacccttcatgctgtgtggtagaaatgcagaggggcagtaagctcaccccttggactctctcagtgacctgtgttgagcacctaacctgtgcatggtccagcactgggaatgccagtccagatccaagttggccctgctcgtagatgaaaatctgatggtcagagaggtcagccgctagtgcaggttgcacagcctcgggtggagctcttgttccacccaggttgcctcagtcaagtatggaaagttactgggcctgtgttttgctttagaggcttgtcaagtgacagggaggtgaggggagtggcaggaggggaagctaggcacatcttggtttcttgtctgggttgtccatgagtggcgtatgtttctctgcatctcagtcattgctctgtgtcctttcttgcagaggaatgtgattctctgttcccataactggtcttgacagcagcttaacccttagctgtggtctgtggaggagggagctctccaccactggggacctgctgcgctgtgcctcgggcttcagctgtctcagtatgagagagccccgcttgtcctttggggcatcaaaattgggaacaagggttttgatgtctctgtgccaatggatttttatttgtatttttatttttattttgagacagcatcttactctggcccatgctggagtgcagtagtgcaatcacagctcactgcagcctcgacctctcaggccaaaagaatcctcccacctcagcctcctcagcagctgggactacaggtgcatgccaccatgcttggctaatttttaaattttttgtagagacaaggtctcactatgttgcccaggctggtctcgaactcctgggctcaagcaatccttctgccttggcctcccaaagtgctgggattataagcatgagctgtggtgcctggctgatagtttattctttgtttgtttgtttgttttgtttgagacggagtcttgctctgttgcccaggttggagtgcagtggcgcaatctcggctcacctcaacctccgcctcccacgttcaggtgattcctttgcctcagcttcccgagtacctgggattacagatgcccactaccacgcctggttaattttttttgtatttttagtagagacaggttttcgctgtgttggccagggtggtcttgaactcctgacctcaggtgatccacccgcctcagcttcccaaagtgctgggattacaggtgtgagccaccatgcctggcctgatagttgattcttgatatttgattcctttactaattttaaccacttgatttaaatgaacttaagcatttctcttgtatcaccttctcatttcattggcagtgatatcaggatgcaggtgcagccagccaaactgctgttgctgggataccatctctagagtgccatcatgtgagggctcttagcagtggccagcccagcagctcctccttcagatagtgaggcaggcctctggtcagggaaagacttggctcgggccacagcgctaagacatggcagacaggactcagcttcctgtcttggtgaggcagggcaacttcttaacgaaaagccaatgggcctcgagtcagacctggttcagaagagggttccctttgacttgttgactgtcgagagtctccaggctcccgggcaaaggttgcctgttccagcagcccatctgtccctctcggagctctgtgtcactggtcagcactgggtacgcagcatgctaggtggtaacccctcagcccatcccagtcagtccaagttcccctgtctctgcttgaggagcggtcggcctgtgtgagttgaatttcccgagtcagcccagctaggacgctctccatctctggtgttcactccgcactgagagcagcactgaaggaccaggcctggcatccaaagaattgtggtttctcctgtttctatttggttttggaagctgtcagtcatgtgcatgtgtgtaagtgctggataactgtcttagaagtgagctccagggtagccgggcgtggtggcgggcgcctgtagtcccagctactcgggaggctgaggcaggagaatggagtgaacctgggaggtggagcttgcagcgagccgagattgcgccactacactccagcctgggtgacagtgcgagactccgtctcaaaaaaaaaaaaaaagaagtgagctccagggaattaggggacattttcctgcccctgacccaatcaggctgcactgtgggcacagcgctgtgctggggcaggtggctgtgagtggaccgcaccccctgatgcccacccagcccactgtgctggcctgcaggctccacctcctgctttaagattggtgtggtctgtgagccgccttggtgcttcgctttcttctttttttctttggtacaaattttcagagttttccaaattcctcagctaaacactggtgtcttggggcatgttgtcatctcggaatgttttgggataagctccaggaactagttacaaactaaccacagtcaaaagaacagaacttacctgtgctcttagaatatgagcaaagctctgagcatgccttacgctgagtgctgtacctcgtgacagtttctgatgtcatgaggaaaacttactgacttttaaacagtaacaggaaagggcctcttccccttctgctccacagtgaggagtgggcaccctccctgaggtgctctgtgctcttgggtctgcattgggcttttgcttctgaaacctggaaggctctgtaggatttcttttgtggttaatatctgttcatcgtggcactgacctgtgtttccattatataccactgaaggctgcagctcagcctaggcctcgggcccatggcagtgcagtctcaggggtctctgctcctggaaagcctcctgcccccgccctgcctgcagcctgcctgggaggagggagagtccccatcgggccgggctcctgcagaccagatgtgcctttcatccacagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaaggtgagtgcttgtggtcctgggcacggccactccagaaggtgaaagtgctctgggagcttctttgtggtccaggtgctggctgtgggtggtgataagaatagtcacatgcatcaaagacaaaccagaactttatccagtactcatttccaacctagtcactcaggccagaatggaagaaattgctggccgggcacagtggttcatgcctttaatccagcactttgggaggccaaggagggcggatgacctgaggtcgggagttcgagaccaacctgaccaacatggagaaaccccatctctaccaaaaatacaaaattaggctgggcatggtggctcacgcctataatcccagcactttgggaggccgaggcgggcggatcacgaggtcaggagatcgagaccatcctggctaatacgatgaaacgctgtctctaggaaaatagaaaaaaaattagccggatgtggtggcaggcacctgtagtcccagctacttgggaggctgaggcaggagaatggcgtgaacgtggaaggcagggctttcagtgagccgagattgcaccacggcactccagcctgggcgacagagtgagactctgtctcaaaataaatacataaatacatacaaatacaaaattagccaggtgtagtggcgcatgcctgtaatcccagctactcgggaaggctgagtcaggagaatcgcttgaacccggggggcggaggttgcggtgagccgagatcgtgccattgcactctagcctgggcatctcaaaaaaaaagaaattgcaaagttaggcacacttgtgagtggccctggctaggagggagacgtgtgtaaatgacgatgtggaggactagtggtggccactcacaagagtctgcgcgccatactaagacacaccggggcccctctgccaaaacgaggctgaccccgaagatgtcctgccgtggtcccatccagcagctgtgatgagaggagacagcaggaccgaggggcaacccacagaactctgggctggagggcattggtccttctcccagggaggtttctgtccacatggagtgaccagacattcacaaaagaattcactaatttggatcagttagtgggaaagccagcatgcatattattattattattattattattattattattattattattatttttgagatgaagtcttgctctgtcgccaggctggactgcagtggcacgatctcagctcactgcaatctccgcctcctgggttcaagcaattctcctgcctcagcctcccgagtagctgggactacaggcatgcaccaccatgcccagctaatttttgtatttttagtagagatggggtttcaccatgttggccaggacggtctcaatgtcttgaactcgtgatccgcccgccttggcctcccaaagtgctgtcattacaggtgtgagccactgcgcccggccctgaatattatttttaagagacttttgtctctctctctcttttttttaaattaattatactttaagttttgggatacatgtacagaacgtgcaggtttgttacataggtatacacgtgccgtggtggtggcacatgtatgggtggcacccatcatctacattaggtatttctcctgatgctatccttcccctagccccacacccctgacaggccctggtgtgtgatgtccccttccctgtgtccatgtgttctaattgttcaatccccacttatgagtgagaacatgcagtgtttggttttctgttcctgtgttagtttgctgagaatgatggtttccagcttcatccatatccctgcaaaggacatgaactcatccttttttatgattgcatagtattccatggtgtatatgtgccacattttctttgtccagtctatcattgctgggcatttgagttgtttccaactctttcgtattgtgcatagtggtgcagtacacatatgtgtgcatgtgtctttatcatagaatgtttataatcctttggttatatacccagtaacgggattgctgggtcaaatggtatttctggttttagattcttgaggaatcgccacactgccttccacaatggttgaactaatttacactcccaccaacagtgtaaaagtgttcctatttctccacatcctctccagcttctgttgtttcctcgctttttaatgatcgccactgtaactggtgtgagatggtatctcattgtggttttgatttgcatttctctaatgaccagtgatgatgagcttttttttcatgtttgttggctacataaatgtcttcttttgagaagtgtctgtttatatccttcgtctgctttttgatggcattgtttttttcttgtaaacttgtttaagttccttgtagatcgtggatatgagccctttgtcagatggatagattgcaaaaattttctcccattctgtagattcccttttcattctgatgatagtttcttctggtgtgcagaagctctttagtttaattagatcccatttgtcagttttggcttttgttgccattgcttttggtgttttagtcatgaagtctttgcccatgcctatgtcctgaatggtattgcctaggttttcttctaggatttttatggttttaggtcttatgtttaacccctcttgagttaatttttgtatgaggtgtaaggaaggggtccagtttcagttttatgcatatggctatccagttttcctaacaccatttattaaatagggaatccttttcccattccttgtttttgtccagtttgtcaaagatcagatggttgtagatgtctggcattatttctgaggcctctgttctgttccgttggtctctatatctgttttggtaccagtaccgtgctgttttggttactgtagccttgtagtatagtttgaagtcaggtagtgtgatgcctacagctttgttctttttgcttaggattgtcttggccatacgggctcttttttggttccatatgaaatttgaagtagttttttctaattctgtgaagaaagtcagtggtagcttgatgggcatagcattgaatctataaattactttgggcagtatggccgttttcacaatactgattctttgtatccatgagcatggaatgtttttctatttgtttgtgtcctatttcgctgagcagtggtttgtagttctcctcgaagaggtctttcacatcccttgtaagttgtattcccaggtattttattctctttgtagcaattgtgaatgggagttcactcatgatttgactctttgtcaattattggtgtgtaggaatgcttgtgatttttgcagttgattttgtatcttgagactttgctgaagttgcttatcagcttaaggagattttgggctgagatgatggggttttccaaatatacaatcatgtcatctgaaaacagagacaatttgacttcctctcttcctatttgaatacactatatttttttctcttgcctgattgccgtggccagaacttctaatagtatgttgaatacgagtggtgagagagggcatccttgtcttgtgccagttttcaaagggaatgcttccagcctttgcccattcagtatgatattggctgtgggtttgtcataaatagctcttattattttgagatacattccatcaatacctagtttattgagagtttttagcatgaaggggtgttgaattttattgaaggctttttctgcgtctattgagataatcatgtggtttttgtcattggttctatttatacgatggattacgtttattgatttgcatatggtttttttgttatttggtttttttttttttctttcctgagacggagtctccctctgtcacccaagctagagtgcagtggtgcaatcttggttcactgcaacctccacctcctgtgttcaagcctcagcctcctgagtacttgagactacagacacacgccaccacacccggttaatttttgtatttttattagaggcggggtttcaccatgttggccaggatggtctcgatctcctgaccttgtgatccacctgcctcagcctcccaaactactgggattacaggtgtgagccaccgcacctggttgatttgcatatgttgaaccagccttgcatcccagggatgaagccaacttgatcgtggtggataagctttttgatgtgctgctggattcggtttgccagtatttcattgaggatttttgcattgatgttcatcagggatattggcctgaaattttctttttttgttgtgtctctgccaggttttggtatcaggatgatgctggcctcatacaatgagttagggaggagtccctctttttctattgtttgtaatagtttcagatggaatggtacctaccagctcctttctgtacctctggtagaatctggctgtgaatccgtctggtcctgggctttttttggttggtaggctatttattactacctcaatatcagagcttgttactggtctattcaggggtttgacttcctcctggtttagtcttgggagggtgtatgtatccaggaatttatccatttcttctagattttctagtttatttgcgtagaagtgttcatagtattctctgatggtagttcgtatttctgtgggatcagtggtgatctcccctttatcattttttattgtgtctatttgattcttctctcttttcttttttattagtctggctaaatggtctatctattttatcaatctttaaaaaaaaccagctcctggattcattgatttttttttgaaggcttttttgtgtctctctccttcagttctgcactcgtcttagttatttcttgtcttctgctagcttttgaatttgtttgctctttcttctctaattcttttaattatgatgttaggatgtctattttagatctttccctctttctcctgtgggcatttagtgctataaatttccctctaaacactgctttagctgtgtcccagagattctggtacgctttgtctttgttctcattgttttcaaagaacttatttatttctgcgtgaattttgttatttacccagtagtcatttaggagtaggctattcagtttccatgtagttacgcagttttgagtgagtttcttaatcctgagttctaatttaattgcactgtggtctgagagactgtttgttatgatttccattctcttgctgaggagtgttttacttccaattaggtggtcaattttagaataagtgcgatgtggtgctgagaagaatgtatattctgttgatttggggtggagagttctgtagatgtctgttaggtccgcatggtccagagctgagttcaagtcctgaatatctttgttaattttctgtctcgttgatctaatattgaaagtgggatgttaaaatttctcactattattgtgtgggagtctgagtctgtttgtaggtctctaagaacttgctttatgaatctgggtgctcctgtattgggtgcttgtatatttaagatagttagttcttgttgttgcattgatccctttaccattatgtaatgccctgctttgtctttttaaatttttgttggcttaaagtctgttttattagagactaggattgcaactcctgcttttttttttttttgcttttcttttgcttggtaaatattcttctatccctttattttgagccagtgcatatcttcgcatgtgagacaggtctcctgaatacagcacagtgacaggtcttgactctttatccagtttgccagtctgtgtcttttaattggggcattttgcccatttacatttaaggttaatattgctatgtgtgaatttgatcctgtcattatgatgctggctggttattttgcctgttaactgatgcagtttcttcatagtgtcgatggtctttacaatttggtatgtttttgcagtgggtggaactggtttttgctctccatatttagtgcttgcttcaggtgctattgtaaggcaggcctggtggtgagaaaatctctcagcatttgcttgtctgtaaaggagtttatttctccttcacttacgaagcttagtttggctggatatgaaattctgggctgaaaattcttttttttttgagacggagtcttgctctgtcacccaggctggagtgcagtggcgtgatctcggctcactgcaagctccgcctccagggttcacaccattctcctgcctcagcctccccagcagctgggactacaggtgcacgccagcatgcccagctaatttttttgtatttttagtagagatggggtttcaccatgttagccaggatggtctcgatctcttgtcctcatgatctgcccgcctcagcctcccaaagtgctgggattacaggcgtgagccactgcacccggccgaaaattcttttctttaagaatgttgaatattggcccccactctcttctggcttgtagggtttctgcagagagatctgctgttagtctgatgggcttccctttgtgggtaacccaacctttctctctggctgcccttaacattttttccttcatttcaaccttggtgaatctgatgattatgtgtcttggggttgctcttcttgaggagtatctctgtggtgtttctgtatttcgtgaatttgaatgttggcctgtcttgctaggttggggaagttctcctggataatatcctgaagagtgttttccaccttggtttcattctgcctgtcactttcaggcacaccaatcaaatgtagctttggtcttttcacatagtcccatatttcttggaggctttgttcattccttttcattcttttttcttttaatctttacactttatttcattaagttgatcttcaatctctgatatatcctttcttctgcttgattgatttggctattgatgcttgtgtatgcctcacgaagttctcatgctgtgtttttcagctccatcagatcatttatgttcttctctacactggttattctagttggcaattcctctaatcttttttcaaggttcttagcctccttgcattgggttagaacatgctcctttagctcagaggagtttgttattacccaccttctgaagtctacttctgtcagttcatcaaactcattctctgtccagttttgttcccttgctggtgaggagttgtgatcctttggaggagaagaggcattctggtttttggaaatttcagcctttttgcactggtttttcctcgtctttgtggatttatctacgtttggtccttgatgttggtgaccttcagatggcgttttcatgtggatgtcctttttgttgatgttgatgctatccctttctgtttgttagttttccttctaacagacaggctcctctgctgcaggtctgttggagtttgctggaggtcgactccaggccctgtttgcctgggtatcaccagcagaggctgcagaacagcaaagatcgctgcctgttccttcctctggaagtttcgtcccagaggggcacctgccagatgccagctggagctctcctatatgaggtgtctgttgacccctgccgggaggtgtctcccagtcaggaggcacaggggtcagggacccacttgagttggctgtctgtccctcagcagagcttgagtgctgtgctgggagatccaccgctctcttcagagccagcaggtagtaacttcagtctgctgaagttgtgcccacagccaacccttcccccaggtgctctgtcccagggagatgggacttttatctataagcccctgactggggctgctgcctttctttcagagatgccccgcccagggaggaggaatctagagaggcagtctggctacagtggctttgcatagctgcggtgggctctgcccagtgtgaacttcctggcagctttgtttacactgtgaggggaaaatggcctactcaagcctcagtaatggtggatgcccctccccccaccaagctccagcatcccaggtcgacttcagactgctgtgctggcagcaagaatttcaagccagtggatcttagcttgctgggctccatgggggtgggatctgctgagcaagaccacttggctccctggcttcagccccctttccaggggtgtgaagggttctgtcttgctggcattccaggcgccactggggtatcagaaaaaactcctgcagctagctcagtgtctgccgaaacggctgcccagttttgtgcttgaaacccagggtcctggtgtcatgggcagccaagggaatttcctggtctgtggattgcgaagaccgtgggaaaagcgtagtatttgagctggaatgcactgtttctcaagccacagtccctcatggcttcccttggctagatgagggagttccccgactccttgcacttcctgggtgaggcaacaccccaccctgctttggctcgccctccgtgggctgcacccactgtctaaccagtcccagggagatgagccaggtacctcagttggaaatgcagaaatcatccaccttctgcgttgatctcactgggagctgcagatcggagctgttcctattcggccatgttgcctgtcaccctgacatttgtctctttacgaacacagtatttctgtctgttgaagcttcaccggggagagacctcctttactcagtttgattcattaacactcagcattgctgagcagtcattgtgccgggcacatgcccagtgctattgtgcgtacatctcatctcattctcaaagtaaccctgagagataggtcattttcccccggctggagcagaggaatagggagctcagacagggcggctcgcgagaacgaggttgtgcgtggccgagccctgatttggacagaagcgcactgccttcctcactgagtctttggtcacagcagtcagccccggcctctgtgcagggggacgctctgaacgtccttactgtgcttgtgtgtagggcttggggtttctgacagaaattctctttctccataaaccttgagggtttcctgtgcaggtgtggtcacaggccggagggtgaaaatgctgactgccctggcatgtgcccaggtcccatcaggaatggctggtgcagcctgtacttctcttggtagcccgctgacaaaggcggtcttgtttttgtcaaagatggggcagtcttaaaatgaatacaaataagcggctcaagtttgagaccctcacggagcaggtggtttcaaatgtcaggctttgaaaaggaaatgttgagaactaatgagagaagcaggtctccaaagcctattccttgagggcttttgggcatcagctgcttttcccccaagctccctgctgccagctctcttgtccactaggctctgagcagccttggtgctggcaccaagaagaaccaggggcacagggacccctgccaggaggctcccgccagcatcctcagggccgtaagctccaactcaggtttttactgaaacctcagtgtgcttctcagtcctccggggtcagccttgctggagccaccttgttgtgtgggactgactgttgctctcctgggccgtcgtcatcctgggagctaggcactcctcctaagaggacctcttcaccggtttttgtctcgttctagaccagccactgcattacgtagttgtgactgaaatttgagttgctgaattgtttttcagtgtcacaccgctatttactattcaggccgccacacacaccaggccctgctgctggttgtctccctccagtgaagctttgtctgagccattgctgtaattacctgccttagagcgagaactggaggtagtcagcttgagctgtgggtcatgtggcctcctcctagtttctgtgcacatgtacacagacatgtgtctgccctttggagtctcctgggatctgagtaacctggattgtttttaaaaacaagtcaaacaagatatgtggagtttccccccgatgtgtgaggctccttcagcagggctgtgatggcagctgagtggatggggacaggctctggccgtgctctgtgatcacagagctgtcagcaggagaacccacaggaggtctgatctggcccttggcatgggctgaggggagaatgtgccacaggtaaaatgcaggctggctgccagaggtcagcaccttttcccggttgaggctgtatgctcactcagctaggtggtatggcggcctttttatggacacctggcttctggaaggtagctgccaacgtggtacttggggaggcgagccagctgttagggtgggagcagaggccctgggagctcagaaggatgatgatagctgctggttcaaaatacggacctgctgatcctaagctattaatcttaaacttctgaaataaagacagagatggaaggagttagaatagtgctggtccatattttccccgaaatgagaagtagacttggaatccttttctatatccaggatcctagttcctgcattttttcctctggttcttattagcatttttcactttaaaaagtaaaaatacgtattacagttgccaagtttaaattattgggataaaatgccctaccacagaattaaaaccaaaataatgctcatgtgatgtcccttaaggtggtgagtgggttcaggaccctcagccacctgctcagcagggagaaggcagggagggaggggtccctactcgcacaggacagcgggggacaggccagggcataccattcgagtccatcacagaagtggctctggcagactctctttggaataagaatagaaataagttttgtatctgaagttggttaagtttctctgaaattcgcatcagtcaacacccaggtcacagcttcctttatcctctcttggagaggatcagggaaagggttgagagagccctgccttctcagagggcggccgagcgggctgccccatctgccatggaggcaggtacaggctcatggcgtggcgtccacagctcctaccatatccttcttgcttctctgcagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgccgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgtgctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagtgctgtgctgccttcagcggcagcgggtacctccacgcacctaggtgccatggagcactctgggcctcaggagttcctacctccagcctttgagggtctctttggattgcttggtgggagggttttgccacactggatcagatgtaagtgcagcctcggttcagacagggtggggttctgccacctgccgtgtggggtcagattgccttggacctttgctgaagctggtccaaaggaggtgggcagaggagcggatattggaccctcgtaaagcagtgtgatgttcactcagatgatggcagctctccagagcgagtgccctggggcagcctccgtcctagcatcagccacaccatgcccagcagagcgggccccatctcctcagggggagcggcgcctgtgtgcccatagccctttcccggttctcatgaagcgtggcctggaattagcctggggcagctggcagggtgggggtgcttccagcttcccaaaggtaaagcactgagagtttggggcctgggcctcctgtgctgctcctaaccactcagctgactcccctggccctgatgtgtggcttgatttttaaacactaaacagcttgtggtgcctaacctgtcagttgctggtaactttgtaggccgtttacgaatggacagagcgggtgcccgggtaagtgcaaggaaggcgcccccaggctgtgtcctcagggccgctgtgctccttcacagatggccactcctgatgctgggtggagtttttgcccccactccttgccttacaggccatctctttccttttaattaacttccagcctaaacggctttgttcttttggatgttgacgtcacacaacgtgctgtgggagttatgcacgattttctactggctgttttgggggagaccaggtgttgtagacccaaatttagacttaatttcagtactactagtacatgcccttagggtgacagggcagacttctcgtcacataatgaaagcgggacgtcgctcctttagtcgtcctcagcttgtgctgcagtctgtctttccggcggggggacccaggcctgggacggagtctggtgttgtcagcacactgcccaccagaaggagctaaaaactaccccgagactgagtctgtattttatgatattagctccatccagccgtacagtagagtagaccatattttaagtttcttgtcttggtaaaaatctgtagagtaaaataaaatggcagtttcgtgtgtggggctcccccatctcaagctgccctttgagatctgggcaggaacccttaatcccatctctcacctcacccactagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaa

SEQ ID NO: 36966 - DNA, 12668 bp, Homo sapiens; identical to SEQ ID NO: 36082

SEQ ID NO: 36967 - DNA, 190956 bp, Homo sapiens
ggccgctgcagggagaacggactccgggcggagggcagccaatccgtttcagcgcaggtcttgctcgggttgggcttgccactgcctggaacatacctgtccccctggcgcaacactcagctggctgcgacggcaaccccgagcctggacactgcgccaggtaaggagacacctcctactcccctctcgctgccagaatgacatctcggggggcctcagggctggctctccaggggctgcaatttggcattttgggtttcctgggggtgcagtcttctccctgcgccaaagcagttggtgaactgttcggtgaattccgcgcccagctggaggctgagatgtcaggatttgtcttgcaaagttacttcatgttaatgaatcttgggaggttctctgggtgcagattcctgccttggagtgtttggcttctgagtacgataacgtgcgttgatttactcccctgagctcaaccccaccctcagcttttagcttcttggaagggtctccagcgtccacacgtggcgctgagcgcgcagagctgtgggtctggggctgtgttgagtgggccagaggttctttacggctgctgcattatggactcactccgggacctttaaaaaaatcgatgcttgagcagcaccccagaccaattactcagaatctctgggggtgggactttgagcattaacatatttaaaacttttgtcaggtgattccaaagtgcagtcgaatatagaaagcagcgaactacagcagtgattcgctgtgtggcatctggcccgcagcagcaagcacctggtaactttgagaaatacaaacaaaatctagggctctagctccgccctagacccactgaacctaaaaccctgaggctggtgcccagaaacctgtgttttaatgagccctccaggtaatgctagtgcttgctcaagtttgaaaactgttgggttggaccttacttaatcagagaagacacctgcaaatttcccttcaccaagggaggaggcaacagaccacttttcagaagaaccttagttatttattagtagagttttgcccatattgaaaaaaaaaaagcatactggggactttgaaagatcttataaaggggagacttaagcatcatcgaataatttttaagcagtagaatttgtatacttgctttaggagagaataggaatttttccttttctaaaagttgaaatgaagccaaggaagaaatatacatgagtcttccagctgtaataacaggaatctttgacccctgatgaaatgttcctggatcatcactgtcatcagtgcaggttacagcattcatatgcgtattttgtcttttcctaaagtagttgagggtttaagggattcatgccaattctctttagtgaaagggaattcagtgttgcaggcctctggattattgaagtggaccattttttttttctttttatagatatctgagatttcaaaattttggctaaaatagttccagctgtttctaagccattagttcaaaaatagaatgactttgcaaatgggcttaaatggattagaaatctgacactggataagaaaatctagaataggcatgactccaatcccagcacatgcgtgctgcaatgaacacagggctaactgtaccaagacttcctgtacagagaacatttattttccaaactgctttttttctgtgccaatttgtgactgaggtatataaacttgttaagggttaggtactaagcttgtatttagagaatctgggggaaatttagatagtggttaggaacaggaactttggtctgaggcagacctgggttcaagacctgctcttctgcttctctgtgctcttggatagttgcatagcttctccgagcctcattttccttatctgtgaaatgtggggcgtactagtacacttacctcataattcacattgttgtcagagttaaataatgcttctaaagtgcctagcatagtaagttaaatatttgttagctcaaaatacaaactcatgtatacacaccatcaaacaacataatcctcaaccaccttaaaagaagatctatgttgatacatgattagatttttatttaaataccaactgcactcttagaaggtgactatatggacatcctcaaattatccttataatttgattacatactttatatggaactttctggaaaaagttttagattagcttcaaatcaatagcctaggtttttttaagtcactgtggtgaaggatttcaccttctggtagcctttataatgtattaacattcatatttaaatagccgtaaaatctggttcttcagaatacttttctttgtaaaagaaaatccaaatgagagagcatctaaaagtgagatggtgtagtctccaggaaagctagtttagaagtactatctggtgtttcttaggttcttaacagagtgaataaaggaaaccctatccagttacatcatgatttgttcaagaaaatataagaggaagcaaaatgaggacacagagcaaggacaagcctaaactggcaaaaagagtaggtgaggtaatgagtccttttcttccttagctgcaataatttcaaaatgcttcaagtcacacacacatgcatacaatcaattcctttcacattatttgattggaactgatctctattatcctcttaggaccaagtagatctagtgaaaatatttatggtattaatgccaaaaaagatgccaaatgattctgtactttgaaattaatttccattctcttttattttagcgataagttgaatagtgtattactgagaatgccttttatgactcatctggcatctttaaatgcaagaggttgtaacctgctaattaccaatcatatatgacttctataagactaaacataaagcaagttccggcatctaagcactttagtaagtcctccattcaagaaatcagatcttcattaggatactttaaaaattataatttaatgttattaaaatgattagaattagaatttaatgttattaaactaaatgtaattccaatttattataaatagggttttctatttgactcactgtggaaagaggaggagtagctgtggggatgaaaaagaaggtcagaggcatacctgttgttgggaaaaatggagacatataggagcaagttcagattctcagtaatcaaatgctgtgttctggataacttaactgaaaagctaagagagtctatgatgttgcaattcagagtgacagatggggcagcactgcttgcagtgaatggccaactaggaatgatcaatattgcaatgccccacagtgacttcatgactctcctgtcataggtatagggtccagagcagatataatcataaagaagttgtgcttggtttacataacctggctcacttagaaatgttctgatgagagttacctggcattcatttaggttcattttcagggccctctttgttccatagtggatggttttactattaaggtcagtcttgaaactgttgtgagtaaggcctatcacaggaaatggatacgtgtttttattttgtatttattatctttggattatatttctcagcatgcaatagtaattctttagtttgcttcattattattcttgtgagaaacaaagttgaaatgtttatttctggtacgtggtccagtctcataggaggaaaatgaaccatgagtctaaattccccaactttctgcatagactcttggttaaagacaaggtactctgcagccagactgcctagccctgaatcctgacctcattactttctagttgtttaaacttggacaagttacataatcacttttgcttctgtttcctcattggtaaaattggggaagtagaacctacctcagtagggctgttgtgaggagtaaatgagttaacatatgtgaagttcttaaaacagtgcctggctcatagtaagtgcttaataagaatttgctattattttactttgggccttaatgaatgctttaagctgaagctctcttttctgttttcacctctgaaagtgagatcctaaaaggaaatagtaatttaggttattaatttggtgttcccatgatttttctgttttatttaatgggataatttgtctcagaataagtgaggtacttaaagtttctcagaaaataataaatttagaacaacatttttgtaaggtcccagttgatactactgtggctggccagagaccacacctagggaatcactgctttaacccactggttaacccacttgactggacatttgaatcacctgagaacagttttttagactgtgttctgtgttagaatgtttgaaatttattgtgaaaagagtaaagtaatcatgtcatttataaagagagtccctggaacatatctacacactatattcatgggattctcatgtactcatagaatttttagaatggttagggatattagaatttgcgtaatataaatgagggaacaggtttggagatgtcattcttagccaagggctcatgaagagttagtggtggcactggataacaattcatatttttttagtactttaatcctacttagtacacttttcattcaactgtcttgcattccaaaaaatcagataatgttgacaaagagacgcacaatccaacttacagaatacaactggaatactacagttatacctgttccacttatcacagtttaatttcagggacatttacttaaaatatttctttaattaaagagcactgaaagcaatatgtttacaatgccaagaaaataaatctgaagttatcagttgtgaaaaagataattttttcacctttgtcacttcaaagaattcaatataattttttctccttgttgtttcttggacattttggtttttaccaatgaaatactcagataaatctttgaaaatttcaggaaacattgacaattttctgaagtccaagcttagtgaccttctgggaatcctgccagatgcttgtgtttgattcagtgcttagtttttgtttggacttgtcttgttttcatctaggtcaatttagccatgattgcagtgttatgctaccccttaactgtttgtttatgtactcattggtgtcgagaagaaaagactaaggaccaagaaaagagatttttttaattcaaagtaaaatgttctagcgaagtttgagctttttagaaagttcttttaaaaagattctttggaattttagtcttttgcattaattacgtaatggagtaaataaaagcactcaaagcttatttttatatttttatgagaacctttaaattcataggtgattcaatggaaacaacttattaaaatattaaattaatatactttaacatttttagaccttgttgtatacgtattttgcaactttattaggaagagagagtttggttccacttatagggtatgtataggcatgtgttttccagcagtactcagaagatggaatattaaagataaaacagggaggaacattccttgttagtgttcacccattcatcaaataactattaagtgtctaccaagtggttggctatcttaggtaaaggggattcagacaaaaagttgctaaagtctgtttcagagagtctattaatagccaatctgctgtttcttttttaaaaatgaaaaactcccttcaattcattattgaaaaatattttgtaaataccttgaacaatgtagaaggcaaaatgcttctaatttaaatttaaaaacctcaacaagcatagcatgatgtatcactggatttcttaaaccatttttgattgtcgtttgacataatactatttattaatctttagaaagtgttcaatgtggtttgaagtaatgtcttggcaacaagtggagagagattatcccagagagaagcattgtggagaaggtaaatacccaggtcctgagaatcaggctgctctccaccgtttccctattgatcatcacctgttctctttggcagtttgcctttggatcattttacagctcttttactttttttctccctgttcagattccttgttagctagcaacactaggctgagttttgaaatgagataaagagaaatatcaactagggatgatatgtgtctcagttagcccaggctgctaaagtaaaattccatacagcaggtggcttaaacaacagaaatttatttctcatgtttctggaggctagagagtccaagctcaaggtgccggccaatttggcttttgaaagggctctatttctggcttacagagagtgatctttttgttcttttctcatgatgaagagaaagaaaacaagctctctgtctatttataagggcctaccagtcctgagggcaccagtcttgttatctaattacctccgaaaggccttgcgttcaaatatcaccatgttgggagttaaggcttgtacacatgatttttgggagggcagctttcagttcatagcaacatgataattgttttaaccagagtggtataggaatggacagagctcctacttgggtgcctatggaatggggagggagcagggttgaaaagggaaagtaagatgcagagctcttaatggaagcagaggcacttggaacctaattcaaacttttgtatttttgtaacgacagcaaacatgtgagtgtgaagtgtgagcgataggtacctataatctaaattatgtgtcatttctacactactatttagataatgttaatattgacatgtcaaatactaaataaaggccaagaagaccctgggctgggaaatggcttctcatccagcctgccaccaacttactgagatgctggaagcttagaaaagcctgcagtaaggagagttagacaggtgtgcttgcaaagttctctttcattttgccatttgtatatttttcttagttaaaagcaccattataggccatcatggaacatctaaagggttgcatctgagagcatctctatatagagtttaagtcagcatgaagtcattggatcctttaggaaattggtctactgagaaatgtagagtttatttattcctaagattcctattgaggtatatctcagttcattttatgctgctataacaaaatacttgagactgggtaatttataaagaacagaaatttatttcctcacagttctggaggctggaatctaagatcaaggcactggcagttctgttgtcaggtggaggctgcttccagggtggcgcctcatggctgcaccctccagaggagagaaacactgcatcctcacatggtggaagactaagggaaagccagctgaaagctgcctgaaacctcttttataacagctttgtattattctgttctcacactgctgataaagacatacctgagactgggtagtttatttaaaaaaaaaaaaaaaagtttaatggactcacagttccatgtggctagggaggccttataatcatggtggaaggcaaatgacacatcttgcctggtggcagacagagaaaatgagagccaagcggaaggggtttccccttacaataccatcagattcctgagacttattcaaccccatgagaacagtatgggggaaatcatccccatgattcaattatctcccaccaggtccctctcacaacacattggaattatgggagctatgattcaagatgagatttgggtgggacacaggcaaaccataccaggctttaatcccattcatattggaggagcccttatggcctaatcacctcctaaaggcctcaccgcttaatacaatcacattggcatcatgtaaattttggaggggacacattgaaaccatagcaacatacttgaatgttcactgaggatggttgttactgtgaatggtgagtaataacagctttttcttccaaacaaattgtaaactctttttcatgatgactaaacaaatttatctttgacatctatgtggaaattatataaaaaatttttttcactggtctttccaacacttgaaaaaaaattttaaatttgaattatggctttttgttggaaatcatgtttatatgagtaatcaaattatatttttgagctctaaattacatgtttcccaaaatgttaacagttgtgtttgggttgtgagatggtagacgtttttatgcttttctttgttttctcatgtgtatttttaaatacatgtattatttttatgatgcaaaaatgaatacttagatacatgctttgtatatggaaacatttggaattataatttcaaattcctatacaagtgagagataatgattgttagaatgtgattaattgatgttcctataattcataaagtacatgttgtgccagatgtacttagacactaattagagatggtaatatctggtgaagatgaaataattatttctaaaaagcagaaaatattattactccttgtgaatgcaaaaaaatagttacatgctctaatacattgaggccatatagagtaatagctaagattatgagtgttgtatggttgtggctctgacatttaccacttgtgtgactttgtgcatggtgcttgaccttttaaagcttaatttgctatgtgtcaagtgtgtattcagaggacctacttcatagtatggtcagaaggtttaaataaaacaatgcacataaaccctttggcataagggctggcagatacaaagtattcagattagttcaaattagttattatcataagtaattttctcctaagctttttcacacttacatttgaatccctatgttttggaaagcttgttgcttctttaggtgagaatattcttcatgtaactgaggacctggagcagaggcaaatccagattttagccattatccacctagtacttgggagagggaactgagaatgcaggagaaaggtatctgctgaaggtggcagggcagtggcagctctatcagaagcttttgaggtaaagctttgtggctgtaggtgttgattctggggtccatgaggctgtcagtctttgctgtaatggcacagttgtagtcactgtggtggttgggtgagactgagggtatcctcaggtctcgcttgtaactgcaagtggtttgtggtgagctcctggatttagcaattgtggaggctttttttttttttttttttttaagaagactgccccgagtttcagcatccactgccttctcagcaggtgccttcatgcttctgcagtccagatttgctgtaacagtatagatatgcatcaatttatccattcaacaaatatttattcagccttttccatagagtagatgaggtgctagggatgcagccctaaatatgacatgattcctgtcctggagcactcagtttgttagtcagtttccccttagattctctggatgccatgattggttgtcatatcacaaggctcccagccctaatcaattgctgcttatagtagagtactttgagcaggttgttgattgtttcatacccagtaatgtgaaggctaataattggaatatgtggtcagatctatgttctcctcaaaactgtggtgaagtctgtgtatgtaatgtacataaatttttacatggtatttagactaaccacgtagtctattaagctaaaaataaaacaaaaacaccataattgaattgaatgaactgaggctttatagaatacagctgtggaggcactgggagaatcagaatcaattacttttagactatacatctcagaatactggaaaaaatgtgaatatttttgacctctgattcattctaaattaattaaatgaatgtccagttgcctctgtagaatagttagagccatttatgtatgtgtgtttccttaactgtgcctctaaatatttttaattttcaggtagagagtgtaatttcacattcgacatttttggccagacttatgacattattaaatgctaaggttgactaatttaataaatgtacattttaaattattctatgccactttggatatggttgctaagttgagttccaaatctcctttctagtaacctgtcatatttttgagcctttggcctaaagagcctaagcgagattagagaagcaattatatttttacattttcaaacttgatttgaacactaatgacttaatttaaaacctaaatgtgtttatgctttctactttatctactctttcattttatccctaaggattagcatttatcataaagttaactgaggaaaacattttcctttttaaaaatttcattgtttttgtattgccaatgcttagacagggcaaacctgttttactcaagggagtgtcctcaggtaatcaggacagtatagagctgcagacttttcaagttgcaatgaagacatgtagccctggttctttagagtgcactactttgctactgtctattactgtagactctagagaattttaaaatttggctttttttcctttcgaatttttcttttcctgggatttctgttttctcagagccatctattgataggttctcacgtaaaaacagggagaaaaaggcacattttgctctcatcaaaagctgtaagaatggatttcagtttttataaccattgttttcaatagggagttgagaagttttaaatggaaaaatatagaaattttaaactatcaagatggagaggcaccaccaggaactcccaaatagtcattactgtatatttcatcactttcgcagcaaggaggtattgtcagctgtaaaaacattgaatatatgccatatgagaacaagaggagcaatgagtagacaagtttaatttcagtggccattaggtacttagtagattgaggcaagccatagccagattgcttatgatacagttgtgagatggactattttaaatacaatttttagaaagcaaactaatactctgtttaattgagttccatatggtctaatgctagaggtaagcactgtggaagatatcatctgtttttgtcatgatttgcttcatggaggagatggggcttgacccagccttttgaagcatgcttcagtttgaacaaatgtttctgtttagacacactctagttaacacaagtcatagggctggcagtatcctacaaattgttgttcgtgatatgagtattgtttatcccaacaattcttgatgccttaacccctccctatagcatacatattgagcatagtttccaataccaaacacctccaatgatgggaaactttctattttagggaaatccccatctattggaaacttttttcttaaactgaaaaacttctccctggagtttccaggctttagacctagttgtgtactctgggagtgacagaaacaagccttatttctttttccatgttcccagcatttgaagacagctaatatatgccccaagtggaacatcatattctgaaaccacttctttgagatggtttgtgtttatatctccactcttgtcagccttccctaaacacattcagttttgatatctatggccattggttgcttaatagaaaggatgtagccgtattctttcctcaatgtagttcaagagcaaattaattcttgacagccagttcacatgaatgaattcaatttggtatcagctaagaccatttagtcaactcagacctgttgctgttaagccactttattcctaatgagcattctacaatccaaattttggatcccagaagttttgtatttcttttgaattttgccttgttgcagtggtctcttatttattcagttaagattttttttttgtccaaagtcttctattccatcagttagtcatctttcaaggtatgctttgtctagaaatttaatttgcaagccatcatctccctcattcaaattatgaataaccaattagacagggaaaagcatagaactctaaaacataccaccagaaacctcctaccaggctgacatcaggtgttattcttcattagggggccatttaaatagtcttatatccaactgacattaattcattttcatttttgaactatcacgaacagtattcccctgatgtcagcctagtacagctatcaaagaagtacaggttagttttatatgatctatttttgacacttagcaagcactgcagagtgttcagtgactcattccttttataagttttgtaagtgctcacaaacagaagtgaggcttagaatattaaacaatcagaaaagccagaacatcagccaattggagtgggttcagatccagtcaaaacaaatgtgcatacacaatctgtacagcaaccttgctttgtaccagctgaatataggcctggttcacaattgtttttaaacttcaggcttgtgggtttaccagaggcatatatatgcattgctattcatagctatttctgttcccttttgcctcccatttctttattgcatatacagattacttataccaagtttctgtaagtttatggtgtttattacctagaccctgaacattaatctataagccacaaattaaggtgtgttttcagataagccttagagctatgaatggaaatggcttatttaagggactcaatataacttgcctagtaggaatggaaggtttaggtgcggagaagtaggaaataagatgtttcagtatgcacgaactgaagtccttgagtggaagcaatcactggagcaggggaagatgttgtgttttctggatgaggggcagtgatcagttggctaagaatacatttgtcaatagtctgccaaaaaccaaaaggccaaaagaaaatgaccaatcaggagaaaggatagcttttaagagatgaatatgagaaagcatgacaagagtgattaagagtgtgtgattttttaagcagaggaagataaaggagggaagtgcgagagtatgggtgagggagctattgaattgggaaatgaggaggtcattagtcttcaggtgagcatttctgctggtgatggagatgaaagtgcaaattttttgtattttagaaaaaaaaatcctaaatgtgtactattagggaaaacgttgccttttgtattgattatgaagcagtgttaaaaatgatgtttaacagtaaatgtgtctttagagataatagaaaatatagaaagtaaataactttatagaaaatgttcatgacaaaatattgaaagaaaatggttacagtttcataacttatttcttaggaagtgcatcttatataaatatgaaatattcctttttgatcctgtttaatacttttgctttgaattctatttttcatactatatttattttcttttattagtatttacctagtaaattatatttctgcccctttatattcaacattttctgtcactgagttttaggtggatttcttgtaaacagcatatacaaagactttaaaaaacacaatttcaaatttttctggattccaaataggcaaattacccattcaactttattatgattgctaatatgtttggactttttccttgaagtttacttatgttttctgtttttaccatgctttcttgtcttttattataatgattttttctgttatttggaattgtttgctttattttccttttctaccagtcatctctggaagttataatcctatttatatcataattgttataattacatttctacgtattaactaaaacatattttcctattaatggctgattggtatcaattaccccctcattgttttttagcttcacttttgtgatgagaagtctctagacaagctaaatttatttctttttaggcatcctgcctctcccccaaacacttaggatttttttgctctattctttgaattataacttttcacaaaaatatgaaataggtcttttttttttgcctattcaagcagcttgatatttgtaatgctttttcagtttgaagaatcaaatgttaatttagctctgaaattttttcctttaccgtttctctcctatatttctccatatgtctctttttagttttttcttctgaatattcttctgaaatattttgtaaaatctgtgttcttttgcattgtaatctggtagaagttttcaacttgattttccatctagctatttccatcttcaactatatccattattaagtttttaattttctaagatactaattgattttctctttttattcactaatattcttacatatatatttgaatatatcaattagatttaactgagtccttttactgttattaactgtttctatggctgttaatgtattcattgagctcatggtttttcttcatgttgctggtttttattgatatttgttcactcttatttgttgcctattttcgtgtttgcaattttgtatttaagactatctggagcttgcccccaataattataaagttgggcaatgtattagtgtcttatttattggatatggctgcttcttctcttgggttttgcttgtggggaagctacctggggcctgtcttgtcagtctagtctaagtgcccaaactcatagattactgtggatacaaatagaaggagttgcacagtgttcaagaggccactcttcctcatttgtgtaaagtatatccttctctgaaaggcacctacctctgtcagagcacttttcttccccctgctctgagaattcttttacttccagctctgagtattattgttcttctaatcttcccagcaatataggctatggagttgtagaggtatcccattcagtgttaatctgacaatattcaaaagcacctgtaattatagaaaggaacaagagtcattttgatatctgctttattacttctactatgtagtgaacattttggaccaagcaatatgtggctctagggatcttgtttgcaatttcttatgaaaagcatttggatgatgtagtaaaataagagcatctccttttggataaagtctgacatactgtaattctaagactgcacttggcacatgcttgagaaatgtctgtttttcaggatgaacgaagtccagtgcagctgtttctgctttacaccattgaatctgaaagtccttataacagaacgtagccaactgactttggagtgaacaatgagataggagagtttcccacctcatgaatctcctgctttgtaggaagcaaacttgataacaatactgtcttgagtttatacaacataaccccttttagagatctgttctgcaagaatttttcaaaatatttaatgacagtatcaatgtttgtaattcactttgtcacactagtctaacatagcagagtttaaaatatctttttaaacattgcatattgttcttgttttctaagatgtgaggcaaaatatttactaattagaatgatttttagttctcttgagttgctttttcccaggatgttttcattttttactcagttggaagtatagtattgtcaattttcagaatgccagacatagatttattcaaatataagaataagacacattccagtgcccaattatatgtctttcccaactctccacaatttaaggttatatgtactagttctctcttgccatcccacttggcagatagtcaacatttgactgtagtgttcatttgctaactttttttgtgtgtgttgaaaacaatgtcaaatagtttaagaaatctcatatgttggagtcctaaaccatatactgcaagaaatcagttggatttttgaagtgcttgttactcatttaaaaggaagaacattttcatgggattatttttcatcttgatagcttagcaatcaaaaaacttatgaaaagagaatgatctgaatgttaccgtatatgtctttggagctctttaaaagtaatagaactagcgatagatattataattttgatcataaaatgttaattatagaaaagtcataacatattagatctagtggatccagtttgaataatgaaactgaatgactttttttgcagcttagaaagctgattattaaccatgtatttactagtatacataattggtaaaatatttaagacaatagaatggtagccaattggaaatggaagagattctcaaatttgcttatcttctcagcccctggttttacagaggagatactgaagtctagccaggcttgttttcttgctcaaattcctgcaatgtcttagtggtcttggttgggatacagagagtctagttctcagtactatcctcttttacccacacctagctgaataacgccaggaaagaactgaatattgtgactcatcacttttaaaaaagttgctgttaccgaactgaatataatgcttcctttactaacaaatgcaggatgtttatcatttttccataccagagcttccttttatatggtaagaaatcgcacaccaagttatttttgaagatagtctttttattttccgttcttttaaacatagtcatgttttatttgggtctcctgaatgtcaggatggtattaattcacattgattgtttcttcctcaggaaacctcttctggcatccttagtaaatggcagtagagtcatctgggaggtaaaagaagattgtaccatgtgaggtgtgttttattcttggctggtcagcaagcatttttcctgtagaaacaaaaggctggcttttgaactggtggtgctatgaagggtaggtaggaaaaagcatggcagtttatttgagggaagggtagaaaacactgattggagctcgtatatttaagtaagcaattataaacctttcacatgggtgatagaaactaagagttaagatgaatttattttggaaatgaaaaatttgaaactaaattgataaatgacatgtttcccataaacatgtacagctagcgtatttcaaatttgtattttctcagttgaaaataagaaataaaacatttaaaattgtgcaatattaagcatgtggtaaggagttagatactcatacaaaaggtattttgcaattgattatggttttgaagtgtgatttcttcccttaaacatcaaaaaataataaggctgataaaaatcatcaccttataaaacatgacaatactttatgttaataacaatacaaactaaaaaaaattatattacaattcatcctcatcaaggatgccatttgaattaatataagaagtatatcttttccttaaaaaaataaaatgaggctgtacggaattaagaaaaactttggaaacttgactttttttattttaggagaaataaaatgtaattatactcttagcacttgaaggatgctaaacattgagtttgctttatgatatttcttgactgatttatcattgagagaccgtactattaaaaaagagtaaaatgttgactgagttctttgagattgatacaagattcccccagcctttcacagagtcataggacactggactagaaaaacctagtatggaaattgttatgtttccatatatctggcttagttgggactcctatagaaaaatgactttcaattttttttacaggacccacaggaagaaataaattttacattgtgacacatctgtatttattcgaaatatgtataccaaatatatcataatatttaccttttgtacatgcaatgtgctctgacattttctgttcccttccattctattaaacactgttggtcatagaccactgagttgatttcaagatcaaccaatggatcgtgatttgcattttaaaaaacactaccataaaaatccctccagttttttgttgctgctggtggtggtggtggaggggatgaatttgtacttataggagattcttattagttctgtttgtcaaataaatttcaggtacacagtcagattacgttttctggccccatgatactcatggccaacgagctgagtggaaattaacatatatttctgcactggaacatttattttcagtgtgagaacctccagagctctttacccttaccttggaaaatgaccatactcctcagactcaatcctaaaatgaggaatgtggagcagagccactagacagctcatagtggacgtagagtatgagcaaaaaataaatgtttgttgttataaggcacaacaatttttggatatatttgttactcagcataatctaacctcttgtggttagtgtacgataattcaattatgtgttttgctggtggagcagagtctcctttcgagatattaactttatctaaaacatatgtaagtttaaaaatatgtttattatttctgattttaaaataatgcatattctgttgtttttgagacagggtctctctctattggccaggctaaagtgcagcagtgcaattcaaactcctgggctcaatggttctgtcctctcaggctcctgagtatccaggactacaggcatgagccaccatgctcagctaattaaaaaaaatttttttttgtagagacagggtttctctgtattgcccaggctgggcttgaactcctgatctcaagcaattctcctgcctcagccttctaaagtgctgagattccaggtgtgagccatcatacccagccaaaataatgcatatcctttatagaaaagttggaaagcatcaaaaaataaaaattacatatccataatgctattatctggaagtaacaatttttgacatttctatgaaagagatataatatcacataattagcttactatatagttttgcatttttttgcatttgttcttttattgatatttttaaaattgtcattaagtattcttggaacatttgaattttatgcctctgtagtactccatcatatggatgaaccagcaattacttagttattcttgtactttagtcatttgttttattccatacaaggagttttaatggactaaaaatctcacccttgacactcaaaagcaaacagtaagccagaccagaatccatgtccactcactctgcttagcgtcagttgcatctccccattactcaaatcctggcacacagggggtctatatattcacctgtcaagtaagcattttcatctgtccatacttttttagaaaattaagcacaaatttcatgtatgaaccatttcatgtccatacatgaaatttgtgcttaattttctaaaaactaagatgctttatatttcttctcctctaccctctagcaggaaaatttggtttatatttcctgaattctttcagggaaagacatcactatctacaagacgttcaagccagaggctggggtcattctctttctcctgtccactgcaatcaaacagtcataggacctggcccgttttaactcctgaatgcctctcaaatcactttctgctctcactgtccttcaggcccttactgcctctcatttgactgctgccataaactttccatcttcctgtacaccattctccctactgctgccattgtgagctttctaaaatgtgaacaagaatatgtttctctctgctaaaaatccctcctgtagtaaactttaaagacaaagtccactcctcttcacttaatgcaaaagaccatgttcctgctctgtttcctgagtacctgccccatcattcatttccttcacccctcacccctttcccactctccatgggcggttcacttcataaataccttttcactgagcacatcttgttctttagtgattttaagcattttcaggtactatcttcctgtcttcttaaggtcatctagcaaatccctggtttgcctttaattcacagatgaactttacttcctctcagagaatgtacccatttcctctcagccagccaggaactaggtattcactccaccaagctcccagtgcctagcacatacctccattaaggtctctattattgtattgtagttatatatttgatatcttttcacaaaaaccctatacttgctgaggctatcactaggctttctcatctgtgtatcctcagtgctttgtacattgcctgaataatagtagatgactgtgcatattgtggaatgaatggataaacagacaaatagtagtgggaaaatatgtattaaattttatctcttgatgattctttcttttacaatctaaacaaccaagcttcatgtatttttcatatcagaaccaactgtcaagacaggatctgaagttcatttactctgaagtgtaataactgataaaaatttatgtctcccaagggggtttttattgaacaaggatggaatgcttaatctaaagaaaggaaccttacttagtagaatttcccacaggcttaacaagcgtatgggatttgttttaattggggattggaggtgggacttagaggttttctctttactccaaatagtccataggctttgtctagatatgagaccagttttcttgcttgctggctcacagcatgaactagcatgtcatattacacagcacattcatttttgtttctattatacagcatagatcatatgaacttcacatctggtaaacatttgtacattgaatgtgcagctgccaagaattgtggtttcttggtagcatcccagtgacgctgagtcaaggtcacaaaaccagcattgcagagttttcatgatctggaactgtatcctgcttttacttattgagaaagttgctctcttagttcgtttgaggacctgtcatggcaccattttaagtttggaaaataacttgggcgattcaaagtccattatactgtttgtgggctccccctatacgagccatcccacagagatgggaatcttatctacttaaaaaaaatccaaagaaagtatttcttaattcttctcagtgacctgttttcaaagtttgatagtctcttcgaaagtttcattgtcataacaacataactcttccctaatttagttttatcaccttgcactgttttttatggaagtgaggaacattggattttcatataaactgcagtgctgaagataccagtgcattgcaccataaaagcaaaccaaacaacaccatcacacaaacaattcaagataaattaagttaggaaaatggggtttcacagtgtgactcaaattaggcttgccagttagctttggcctccaaatggaagtctaacattttggtgtgtggtttatattttcaacatccttagtgaattctgtcttgaaaagccagataccattaatataatggaggaactggtttattttatattgatataatatataaagcttttaaaaatgtttcatgatagttaccttttccctctgggattatgaggaagagggacaaatatctatctcttgaaagttacagtagaatcattagtagatgtgttcatatacattaaataacgaggaacattttgtaaaaagttactttgctcttctttctagaaaggaatgatataacattcctatatttccaggtgaagaaagcaaagtgactttttttggtatacacctgactgtaaaagctaccctgtaggtaattcggctatgccctacacttatttttctccctgatgttaaatgaattaacaattggtaacattcctaaaattagatttgaaaagaaaaagtcaagatatttggattctttaaacaattctatgtactatttgtactcttattcttgggaagaatatttgaaataaggtgagaaaaggacatcatgaaatgcaggcataatactctttgtaacttccagaaacatgtacaccacaatgaagacaggatgctctgtgattaatctatttaaacactgtatgcttccagggatctcctacccaggaaacaaagcccacaggaagaccatcacataggaatggtaagacatctcaggcacttgggtgactagctgtgtctaattttaccttctgccattctagaattactcaaacttaatttcaaaatactcttttttgttcccgtaattattgtgtttcttgtctttttaaagtaattaaattttaaaaagactaaaaaaattaaaggccatgaatatgtttaaaatttggaatccttttgtttttatgccaaagttctcatcagattattttctgatgtagattatttttcattgagtacctgaaaatagcacatcctttggacaggaacaagctgaaaatttgcccaagtggcaacctgtaggcagccaaataccaggtctctgctgtcaagtacatttttgttgccttcattccactagctaccatagattctgtctgggctagagtagagaacttagctacttaaggctttcaagtttccttactgaggagtgagtagtagcccactcaaagtgaagctctaaaagagttcagaaattttgagtcattctatcactcagcagcaggtgttggaatgaatgaagaccagttgacctagtggttagtttcttgatagcttggggggtttcaaaaagatttaaagaaatgattgttgagtacaggggcagttgtttgctttagtagaaatcttattgtaacttgcataatgtcaaaggaaaatgaaatgttttaaggctttgtggggaaaaatttaaaatttgtggctttggaggagtcagtggtgtttaaactaatttagtggttaaagtgatcattttttagaatttgagaaaagggcaatcttttctgacttttttttcctggagggtcagaattttgtttttctttccctgtttattacattttagttttatgttacaatttacactgcatgcatggtatcttgctcaacagcattgctgttctttatcaccatgagtttgatgatgagaggtaggtgggaaaagaggttggtgtgatttggttcactagttgtgataggttaagtagtactttttgttaaataatggagtttaatttaactataatatttcagcatatttgtccaaatgaaatccagtatgtcattgttttcatttaatggcccatattgatgtgctttttccattaagggacttggtaaaacagggaaatatcagagaaagaacggcccataatgtcgatgtttttgttttgatttagttacatctgctgatttttagaaacccaatccttttttggtattaaatatgatttttaaaaaattcgtttatgtctcccatattccaaaaagactgtgaattattcagtagcatcacttattgacataaggtatatgggtttcagaatgagaagcattaaaatagtatttttgttttaattacatataaaataaagtacagactatgacacacttttgctaaagaaaattgtaagcctccacgttaagtcatggaattcagctatacatggctatttgttctctttgtttaagaagtaattattgtctgtctactatttttatgtcaagaactatgagcctgagattttaccctacttgcaagctaactagtctggtacagttttataggtgttggcagagaggagactgttgagtcagggacaaaagactttattactcacagcttcatgtttgcattggttgctttttcccctaagccccgtggggtgatatggaaggacccagatagatgctatgtgcatagtgggtgtgtgtcatggctgaagaactccaagctcaataaatccccagtcttataaaaagggtactagtaaatctctccaatgtttatactggaaaaaattacctttcttattccagtcaggaaacaaatttgcccttatcccaggagagagacactgtctcccaaggctgtaggggatgtatctcaacatctttgggaaaataggtggaaataagatgcacagaacactccatgagtatcttccaatactttacagtttaaaaaaataaaataaaatgtaaaatcttaatgcatgtatcaattaatttacttctcataaggtgaaagccttttggtgactatcaagatgaatcatggcacattttgttactctggcaatagctaatgatgttacacacttgagcatctttgatttaaaggtagtttaccatgaatgcattatgcaaatatcattctacattgcttacaatttttatgttttttttaaaattaatattatccccttacccaaaaccccaatgtaatagctgtaattatcataagaaacatttactggtgactgccagaaaattttaatgtgttttgtttggcacattaaacaaatgtgctaagcatgtaaagaaaattgcataaacctagtacctaaatttttagaggaatttaatatagtttttaaatttaatgattcagttacttggaaaagcaaataaataagtgtttcagtaagtcatgttatagaatgaaggatattacttatggcatccaaagaaagcctgaataaaatatgaaataagaaagtacagtctttcccttcatattagagggacacttttacttttcagtgggaagacaaaaataagctcaagacaataaagaggaaaataatattaaaaaaataacatgctcctgtcctctcatctactgatgttactgtcagtcatgatcagcttgacttcagatgaaaagacaacaaatacatgaactgattatcccagaaagtaatgttggaagaacacggtttatcccagaagtgactggtagagtaacagcaataaaagcttatccagggattccaatttttttttttttgttctgaatagaatgtggatatctcttactttaatataactttgtcagcatttaataaaaaaaaaatactgattgagtcacatgatactcactggtatgagagcaaaaaatgtaaaaggatggtcaaagtcaaggacatagattaatccactcaccctccattgtcaaagccaccaagtaggcttcagttttttggaaactgtaagtactaatctgtgtgactcactttgaaattcttgcaaacattccctgggagtcccttttttttaaagaataggagcttacactgaataaaaagatatctgattgataacctcatgaaaatcctctaggctgaaagccacagaatctttgtgtacatgatttttttctgaaccttaaatgtaaccagatgtattttcttttgatactctcctactcaactgatttaaatgaatgatttgtcttctaatgggaaatctgtgtttcatcatagaaatggattacatgtcttaaatttaattactccctagagaagcaatgcctcttttgttttatattctttaaatgtactaaagacttatataacaattttattataggcatgaaatattagagctttttagatgaatggatggagaaacttgaaaaatataaccaccattatcatgtgagtgagtaaagtataataaaaatcctcatagacaacattattaacctcctattttacaattagttgcctgtaaagctaaaataaaataaaaggaaaacactttcaatttttttttttgagacggaatttcactcttgttgccaaggctagagtgcaatagcacgatctcggctcactgcaacctccacctcctgggttcaagtgattctcctgcctcagcctcccgagtagttgggattacaggcatgcaccaccatgcccggctaatttttgtatttttagtagagatggggtttcaccatgttggtcaggctggtctcgaattcctgacctcaggtaatccatccgcctcggcctcccaaagtgctgggattacaggtgtgagccaccatgcctggccaacactttcaattttaaatggactctatagttcatggccaaagaataaaaagcaaatataagccatgaaattgtgtgtgtgtttagtagctttctcgatttgcttttaaattgttttttggcaatacttaatctatttcaaaaacattttgattctgaaatagaagcattaccatggaaacactgatagtaaaagaatagagctatgtcaaacctgatacagagaagaatatccaataaattcaagtctttataatattttattttttattttttaaagagagtcttgttctgtcactcagtgcagtggtgtggtcatggctcactgcagcctggaactcctgggctcaagcagttctctcacctcacctcctgagtcactggaattataggtgtgtgacacgacagtcagctaacttttaaaaattttttatagaggcagggtcttgccatgtcgtccagactgttttaaaacttgtaggctcaagtaatcctcctgctttgatctcccaaagtgctgggattataagcatgaaccaccgtgcccgacccttttcaatattttaaacaaattgagcttttaccttaactgccttatttgggcagaggaatgtgaacatggtggctgattcctagtttggaacctaagacttacaaacttcaaagtcagtttcattaattaaggtccaattatcaatccttgaggtaaagcctctatttattgactaaatcagtgatttctaatagagggatttggtgccacagagaaatttggtcatatctgggaacatctgtggttgtcacagctggaggtgatgctaccagcatctggtgggtggaaggatgctgcaaacctcctaaaatgcatgagacagactccacaataaagagttaatgtggtttcaaatgccagtagttgagaaactctggactaatatacataacagtacacttaatgcatgaagaagaactacaaaatatcaattaacaagaggcagatttttcccttaagaatggaattgaattgtgtagtggaaagcagaggtcatatgacctcaaagggactttgctaaaactgtgggctccacctttttgtgaccagcttcctttaaatatctcagagcctctctgtgctcttgtaaaattgaggtaatagtatagtttctacttcaaagtcttgtaggattaaataaaataatatgtgtaattgcttagtccattgcctggttcctataggatctcaataaaagtcagctatttttcaaagtatgacaatgaagaagagccttgtagcaattagaactgtctaaagatagaatggtttgtttagaaggtagcaagtttcctcttctcggataagttcaagtacagtgcggacatcttgtgtccttccgactctgttatgagtgaatggcattccatctttcttagttatacagaaccattcttaaataaaacataaagttttcgtaaaacataaaggtttttcacaagtctttagcagttaagaaattttaggtgagaatgacaccaaataagcatagacaacactgatattgttcagcaattttaaacttcctttgtgttttaataccaaatgatgactaacttttttgcaaacatattccctttgttccttctactaatcagtgtcagttatttgcttggattcccccaggctattttctctgcttctgtagcaccagaattctttgtacatcttttgtgtggttattgcctgttacaagtcctggctggcctgccatttatctctccatataacatgacattaattgtgcactccttgtatgccagtactgtgcaatgtgctgtttatgtattatgccatttgataagcaggcaataaatgttaattcaatgtataaatatgttaggcataaatgcaatattgattgagcttcaatgcattatataccaatacagtctattattgaaaattgaaaaaataaacaccttgagcccaccctctaaaaactctttttctgaagaaacaggataatttgtagtaaacttcctgtatacagttaagtgccttgattggaagaattgtgattattatatcttcataacacctcagtgtttatcaggcatttaataaatagaggtattcagtaaatcaggcactcaatacatatttgcttgaaaaatgaataaagtgtaagtcagtggatagatgggcaaaaatattcattgcaacaagtcagctgcttgacaaaatgctatcttaattgggtaataaaatgaaatgtatcctgatgatatcacgaatgataattgatgtgtatcatcacatccatcgtcaggatataataatatgcttcaattatgcagtagatgctttattgcaatttttttgttaataacagttttgtaaaccagatcatgtttatttattttaaataatttgaatttgcaaaaagtcgagacgcttgaagaaatggtagtttgttggcaagaggtcaggtgaataaggcgaatgaagcaaaagtttgtagcccaatgccttcaacttttgaagtgttggttatatggtgtgcagttgggcattgttgtggagaagaattgggccctttctgttgatcaatgctggctgcaggcattgcagttttcagtgcatgtcatcaatttactgagcatacttctcagatgtaatggtttcgctgggattcagaaagctgtagtggtgtagtggattagaccgacagcagaccaccaaacagtgaccgtgacctttttttttttttttttttttttggtgcaagtttggctttgggaagtgctttggagcttctgggcttggctcaaccactgagctagcagtcgctggttgtttgcataaaatccacttttcattgcatgttacagtttgatcgagaactggttcattgttgttgcatagaataggagatgacacttcaaaacgatgatatttttgatttttgctcagctcatgaggcacccacttattgaactttttcacttttccaatttgcttcaaatgccgaacgaccatagaatggttgacactgagttcttcagcaacttctcatgtagttataagaggattagcttcagtgattgctctcagctggtcattgtcaacttctgatggctggccactatgctcctcatcttcaaggctcttgtctcctttgcaaaacttgaactaccactgcactgtacattcattagcagttcctgggccaaatgcgttgttggtgttgcaagttgtctctgctgctttaagacccattttcaactcgaataagaaaatcgctcaagtttgctttttgtctaacatcatttccatagcctaaaataaatgtaaaatgagcagtaagtaataagacattagtaaaaaaaataaagcaataaatgtgcatttaaatagtgtataacataaccacatttatttaagaatgtattccaatatcaaatggcaaatttcaacaaggcaaaaaaacacaataacatttgcaccagcctatttccatctaagagggagctgttgtcttatagatttataacaataacaagccatatggtgattttactatacagttaaagagcaccttttgattttaggaagtgttgggaaatgtactaagaacaaaacaatgatatggctaacaactttcatgaattctgttgtttttcttactctttttttttttacaaagccatatacttttatgctaggaaataatgttagaggacagttctgagtattgaatattcatcaagtgcattttctttacactttgaaaataaggtaattcagcaaagtttgactatccccctaatattttgtaccaagtttgtgatccagaaacatttttagtgtattcctcttaaaagagggtactaaattgtatttagacaactttatagtacagactaagcaatcttctcatttagggacacagaattttaagtactttgcatagtgtgtcataatatgtgaagctcttgaggtttcatcatgacatgtcattctcatgtgagacagattagaattggcttgccatccccttttacatatgcaacctccagctctcagaggtgcttaagcaatcaggaggatcacatacctggtgctttgcagttaggactggagttaactggagttggaatggttttgctctgtgttgagaagtgagtgaagttttcttgttgttcctaggatactacatgtgggtggaagccttcttcatgtttaagccatgcactgactcctataggttgtttccagagcaataacattatgccttttcccattttaagagagacagtgtggtagattggagagaacacagtttggggagtcaacgcactgaagttctgatattggtctgtcattatacttaatattggttagaatatttaaccttattgtgcttcagattctatctgctaaacaatgaaattgggttggaaggactttctggtacctttcagtcatttggtttatgtttttgaggaaaattctctttatttttctatttatagggagtttcttattgaaatgtatttaatgtgcagtcttctgaatttctgagaaaattcatggttgacagtgctgtggagggtgagagccacatttgggatggagttctgttcagacaggtagttatctgagataaagcattgacttaattggtgattttgtttcagatgacccaggagtgggaacccaccaagtggagtcctccttatttattggtccagttgtttagacagaggacaccattcactggaactaatatagtgtccatttacagaaattttaattaaaaagctagcaatatacttttattacacttgagagtattactctgcaacactatttctttttatttggaaacttaatatattttctaattagtacccaaactctacaccttaaaagtttcttaaaaatatggattggccatatttttattagaattttaacatttgaagaatatgtgcacaactgaatgtgtttgcttaatacagaaaatacttgtaggttgctttggaacatctaatcaggtcttaccttctaaatatatattctcatgttcttaattttcagaaagaaattattctgtaattatcttgttattttagaaataaaagtgatactgagatagatgatctcataagatttttcattgtttaaaaatgcaagcaggtatggaaaaatccagcttagtgcccatgtgttaagaagttttggcctgagtaaaaagatatgtcaggaaagtatagcttcaatattctacaggtggttagagaaaagaattgaactggaatcttctcttggtcagaggctgcgaataatgttgacctagcattggctgtgtacaactagtgagtctcacatctgtatgatgttgacccttatcaagaatttcttttgatgattcccatgggaattatttggttaacagagtaaaaagagatggggcagaattttcagcacatttaaaagttatcctagtatgaattgggctttaaaagacttctttggtcaaaaaaggaaagttaggcgtgtgtgagcagaagagggataaatttttgctgtttgtatatttggttgtatcaacttttgggtctacttggttcatactttcaaagctaaaatatgaatttcctaaaaataaattatccaaaaataataatgttggtcctctctgtagggttggatgtatctgagttggcttggttggttggaacacggccactaatgcagcaataggtcccatatcgcagtggacaatatagtgttccacatgtgttctgtccactttgtcctagccagtcattccactgatatgtggctccaagagaagccatcagagaaagtgtaggtggattagcataaatctatcaccattgtgaaaaaatgaaactaaatgtcttaccagtgacaggtgagccattaaaatacttaattgattgcctgtaacatgtaaggaattgtgaggttagagaattattggctttaaactctgccctcaaggaactcacaggcaagtagtcaagcagttggaatatatacacatatacacatgaatatgtaataccttacaggaaaatgacagatgactgcttgcaattagcagataatgcattataagtattcaggaaaaggagattcctttcaaccataacaatcacttgtttttccactcgtgcttttgcaaattttgctgttaaaaaatttaaaggaagggaagaaaaatattatttatttagttcttacagttggttagagactgtggaaagtgcttttatgccattttacttagcattttacttaacaacccttcaaggtagatggggtagatttatccttgcttttagagaggaggatagtaagattcagagagaattaagaaacttgctttagtcacacagggagtgagaatttaagcatgttttaactgaaaaccagtagtttcgactatgccatagtttctagtagtatgttcagggaaatgcaaaagtgcttagatttgggcaaatctccagaaacatttccatcttgatccatagttgcactgccaggtgaggattgtggacccttctgcaagtagtgtatgagtctggagtcagaagggtgtccaaagagaacacagctgcaggataaggtttcctacatcagtctttgaaaagcagatatttgggataataaaggatatggaagaagagaggtgctacccacactctcagagatattattgcaatgggttgaagatttagcaggaggtgagaaaatggacggaatcaaatgaagacttctgtctcatcaggctttgccatgaggggacggaaataaaaggacatgccaataaaagaatcaagggaagaacaatactttaagtgtcaaatttctcagttttgaaattgcctgccacacgtatataacataggacgttaagcatttgtgaacattgttaggagatagttactggatgtgatgaagagctgaccaaggttatgtgactggacgttttaatttaaagttgactgttcagctatatattaacctgccctttggctctttttatttgttgtgcctaaaagcattgagtcacataaaagaaacttacatgaagcaaagtcaaagactggagtcaatcctgggttaataatgaagtgcttaaataagggtaaaaacttttaataaatggaaaacataagacaaaaatctttttaaaatcattaatgtaaaatataaccattttggttcttatttttgttttgcctaacaaccatatgccatgatcaaatggatttctaatttgcaaaaaatgttctaaatgaaaaaaaaaaggggggccttgactgtttagggtagaatgttgagtctattttggttatcatgattcagtaaaagctattaaacccacagactctgctagtctgtaatagaggaagtccttgtccctgttctttctccaacattggaatcagaggataaccatactctagattctatttattctggcacaacttagttcattggatttgtttccaatttaaatgatatctttgccaggtgaagttggtaatgattaaaggaatttaaaaatatgtattcaattcagtgagatgcttttcacatatttagctatcatttagaaattccattcatgataggatggataaatattttaagttgccagatttatttttatagttgaaattagcccaaattgccaacttaagttggattgcaacaaaccagttcagggtttccatggaaacatgatttcatcccatctatgaaaaccattttgtgttttctcctttatcatggaacttgaaattctgcaatgtttttcctgtgattcctgctccaagaaaaagaaaacaggtttccaattatacaaatattcacatttagcttattaaagtttaactccaagggacattttaatttagggagatagacaatggctatagcataaaatctttcctatttaggtaccactttgtgtttttgttatttttgttttttatttttaaatacttgggtcaccctccagtcacaattgttctaagctatgttaaattcatacttctaatatccctattatttggtgtttagctgatttagaaatcttcaggaaagagctgtgacattcttcatttttactttctcccatgcctggcgcaaataggttctcagtaaatatttattgaataaatgatggatctgacatttgtgtgccttctgtgggcttagcactgttaagggctctgtagtacacacacgaaaaatgtatacaatatactatttttttttccgtaaaggagtgctctacggagggaaaataatgaaatgtatgtgcttgatacttattatttaacctcatatatgccagagttttactattttgtttaatctttacaacaatcattgaagggctagtgaattatactgatgtcttcagatgaagatactgtggctaagcaaggctaggtaagttgcccatgagagtgattgttgggccaaggtttgaataccagcccagcattggcaagtacacttgctagttggagagacaagtccctccacacaaagcaattagtgagctaggaggtattattggctctgaggagttcagacaaggaaagattatgtagatgagggtaatcatggataatgtaagtgaaaacatcactacataatgagctctataccatatactaatcaatactacatatttgtattttatctattgaaataaaatgtcttggcttttggacttgtttattaaatgtatacaattttttttaaataagactatgaaatggcatacagatacttttgttgtagaaacaaccaaaggaatacgtgcaaattgatttatcatagagtcacagaatatcagactggtcagtcctctactttttaatagaaaagaaaactgagtctaagatagcagtcacacctaattttttctttctctcttgcttaaattcatatgatggcagaatcaggcaaaactcagtcttccaacatccagtctaatattctttaagctgtgtaatgctttcattctttcatttgcagcataggtacctattaatgaataaaaataattataagaattttgagtatatatcattcattttttcatgctccaataaactattatataaacatgttgtggtgaaaaccatgcatttcacatccttgtgaacatattcttagagatcattgagatgttaagtgctctattaagtgaggtgaaaatgatgctctgtatcaattcgttacctatttttctgtgccttttccttggttatattttgtttctttgctgactccaagctatagttttttcctaggtcttctcttgggttccatgtagtgttaagcacttttgtttttcatgattagttgttttccttgaaagggaaaagtttcaagtttagaaagataattataatcattcttaaatgctaagtccttatcaatacatcattagtctaacactagaatttctcgtataaacctagaatccctcggagtaggaataggtattttattggtagcaaacctatgctataaaatttcttattaagtagtgtatattcacagtaagaataatattcttttggtggggggctgtgttcccgattagcaattaacattaaataatatgtatcaatggtgatctcagaatagcaatcacagaaccaggataattcaaagtagaaaaataatgatccaaactttaaaaatgaacctaattagagagtacaaatcaattatacaaggctccaagaaccataatgcatttctaggaaaccctctattgtattacatatacaatttgaatataagaaatgttaatgaagtacttagcactaatcttgcttgcccttcttagaattaagaataatttaggagtgaatgatttaggttagaccaaatttcttaaactttccaggaaatttgagttgataccacctttttctccagtgcctacgtcacaatttaaaaatctttcaaactcatcaaacttggttagaaaaatttgaaaaataattactcaactcttccttagaattgctgacgtatgcaatgaacaaatattcattgggttttgataaaagtggtatagattgatgtattttattaattaggctggcttaaattagttcaactggaaactagggactgggagaaggggcaattaaaaaataagtagtttgaatttttagaggcttacccagtgaaatagcgtttgtttaaaaaaaatggtgacaatcacagtaatttaattatgtgtatcatacattcgagtgacatcttcctctctcccccagtttggtaattcttctagaaacactgcaaatcagatgagttgtttttgccttttgttttgctttgttttgaattgaggtaaataattcaatataggactttcctgcctgccacggctgtttacattactaccctgcatgctctgtgagaataatgctgctattggccacacctaagaacaggaaagaatatttctgacatattttttagtaactccaactattaaaaaggtttaaagtaagagtaaaacaagactaactgggttaatttttttctaactcattttagaaacaaattagaaataaataaaaatttgtattcagaatacaaattccttggtgactgtgcattacaaatattttctcccactgtgtggcctatcctttcattatatatacatatacatatatatgtatatatacatatacatatatatgtatatatacatatatacatatatatgtatatatacatatacacacaaaatttacacaaatatagaatttgctcttgctatataaagattatatatatttataaataaaagtatatatatagaattctacataaagcttatatatccagttgaatacttaaggacttaaaggaaacacaaccaccttgctactgtcacacacatacattttttttaaatggtgaatatcatctaatgtcctgtccatgttcagttttctctgattgactcaaaaatatctatttacattcaatggtttaaattaggatctcaacaaagtccacaactgcatgtaattgatgcctcttaagtttccttacccttgtcataccatttatttattgaataattttagaatttctagatttcactgattttgtcctcttggtgtcatataacacagtactgaatttcttttatttaggtagctatagagacttgagtagattcaagttttactttttattggcaaaagccattcacagaagagggtgatgtgctcctcctattatatcttgtttggaggaatatatgtcttattctactttaatgatgttaaggtagatcagtgggttcacatgtagtacagcctaatgcatctgtcataaattttctctctaatcttccacctaacaatattagcagccactggtagtccttgcctagatttattattcattaggggttgaaaaacatgaattttgaatactgttactctagaatttattgtttctccatcatgttttattaccttgaaatatcatcatgtaggaaaagtaggataaatgtttattctctttatttgtgcccatttattagcagccttcaaaggtgacccatcgtgttttcttatatttgtcattgtaagctcatatgtagttcaagctatttaaattattctttttttattattatactttaagtttgggggtacatgtgcagaacgtgcaggtttgttacataggtttacacatgccatggtggtttgctgcacccatcaaatcgtcatctgcgttaggtattcctcctaatgctacccctcccccagccccccaccacccaacaggccccagtgtgtgatgcctcccacctgagtccaggtgctctcattgttcaactcctacttatgagtgagaacacgtggtgtttggtttgctgagaatgatggtttccagcttcatccatgtccctgcaaaggacatgaactcctccttctttatggctgtatagtattccatggtgtatatgtgccacattttcttaatccagtctatcattgatggacatttaggttgactccaagtctttgctattgtgaacagtgccgcaataaacatacatgtgaatgagtctttatagtagaatgatttataatccttgggtatatacccagtaatgggattgctgggtcaaatggtatttctagttctagatccttgaggaatcgccacactgtcttccacaatggttgaactaatttacactcccaccaagtgtaaaagcgttcctgtttctccacatcctctccagcatctgttgtttcctgactttttaatgatcgtcattctaactggcatgagatggtatctcattgtggttttgatttacatttctctaaagaccagtgatgatgagcatttttcatatgcttgttggttgcaaaagcgttttcttttgagaagtgtctggtcatatccttcgctcactttttgatggggttgcttatttttttcttgtaaattcatttatgttctttgtagattctggatattagccctttgtcagatgagtaggttgcaaaaattttctcccattctctaggttgcctgttcactctaatggtagtttcttttgctgtgcagaagctctttagtttaattagatcccatttgtcaattttggcttttgttgcctttgcttttggtgttttagtcataaaggctttgcccatgcctaagtcctgaatggtattgccaaggttttattctaggatttttattgttttaggtcttagtttaagtctttaatccatcttggcttaatttttatataagatgcctatgtcctgaatggtattgccaaggttttattctagggtttttattgttttaggtctcagtttaagtctttaatccatcttgggttaatttttttataagatgtaaggaatggatccagtttcagctttctgcatatggctagctagttttccaaacaccatttattaaataaggaatcctttccctgttgcttgtttgtgtcaggtttgtcaaagataagatggttgtagatgtgtggtgttatttctgaggcctctgttctgttccgtcggtctgtatacttgttttggtaccagtaccataatgttttgattactgtagccttgtagtataatttgaagtcaggtagcatcatgcctccagctttgttctttttacctaggattgtcttggctatgtgggctctttttcggtttccatatgaaatttaacatagtgttttctaattcagtgaagaaactcaatggtagcttggtggggatagcattgaatctataaattactttgggcagtatggtcattttcacgatattgattcttcctatccatgagcatggaatgtttttccatttgttgtgtcctcttttatttccttgagcagtggtttgtagttctcattgaagaatccttcacatcccttgtaagttgtattcataggtattttattctctttgtagcaattgtgaatgggagttcacacatgatttggctctctgtttgtctattatttgtgtataggaatgcttgtgatttttacacatagattttgtatcctgagactgttgaagttgcttatcagcttaaggagattttgggctgagacaatggggttttctaaatatacaatcatgtcatctttccaaatatacaatcatatcatctatttgaataccctttattttttttctcttgcctgattgctctgaccagaacttccaatactatgttgattaggagaggtgagagagggcatccttgtcttgtgccagttttcagagggagtgcttccagtttttgcccattcagtataacattggctgtgggtttgtcataaatagctcttatgattttgagataacattccatcgatacctagcttatggagagtttttagcatgaagggctgttgaattttgtcgaaggccttttctgcatctattgagataatcatgatttttgtcattggtgctgtttacgtgatggattatgtttattgatttgcgtatgttgaatcagccttgcatctcagggatgaacctgatttgattgtggtggataaggtttttgatatgctgctggattcagtttgccagtattttattgaggatttttgtgtcaatgttcatcagggatatttacctgaaattttctttttttgttgtgtctctgccaggttttggtatcaggatgatgctggcctcataaaatgagttagggaggattccctctttttctattgttggaatagtttcagaaggaatggtatcagctcctctttgtacttctggcagaattcggctgtgaatccatctggtcctggacttttttggttggtaggctattaatttctgcctcaatttcagaacttattattggtctattcagggactcgacttcttcctggtttagacttcagagggtgttagtggccaggtatttatccatttattctacactttctagtttatttgtgtagaggtgtttatagtattctctgatggtagtttgtatttctgtgggatcagtggtgatatcccctatatcatattttatcgaatctatgtgattcttctctcttttcttctttattagtctggttagctgtctattttgtggatcttttcaaaaaaccagctcccggattcatggattttttgaagggtttttcctttctctatctccttcagttttgctgtgatcttagttatttcttatcttctgctagcttttgaatttgtttgctgttgcttctctagttcttttaattttgatgttagggtgtcaattttagatcttttctgcttcctcttgtgggcatttagtgctataaatttccctccacacattgctttaaatgtgtcccagagattttggtatgttttgtctttgttgtcattggtttcaaagaacatctttatttctgccttcattttgttatttacccagtagtcattcaggagtaggttgttcagtttccaagtagttgtgcagttttgagtgagtttcttaatcctgagttccattttgattccactttggtctgagagactgtttgttatgattttcattcttttgcattttctgaggagtgttttatttccaattatgtggtcaattctagaataagtgtgatgtggtgctgattagaatatatatatatatatatatatatatatatatatatatatttatttatttatttattttgttgaattggggtggagggttctgtagatgtctattaggtccacttggtccagagctgagttcaagacctgaatatccttgttaattttctgtctcattgatctgtctaatattgacagtgggattttaaagtctcccattattattgtgtgggagtctacatctcttggtaggtctccaataacttgctttatgaatctgggtgctcctgtattagttgcatatatatttagggcagttagcccttcttattgcattgagccctttaccattatgtaatgcccttctttgtctcttttgatctttgttgatttaaagtctgtttcatcaaagactaggattacaacctctgctttttttttttttttgctttccatttgcttggtaaatattcccccatccctttattttgagcctatgtgtgtctttgcacattagttggatctcctggatacagcacactgatgggtcttgactctttatccaatttgccagtctgtgtcttttaattggggcatttagcccatttacattgaaggttcatactgtgatgtgtgaatttgatcctgtcattataatgctagctgcttattttgcccgttagttgatgcagtttcttcatagtgtcaatggtctttacaatttggtttgtttttgcagtggctgctaccagtttttcctctccatgtttagtgcttccttcaggagctcttgtaaggcaggcctggtggtgataaaatctctcagcatttgcttgtctataaaggattttatttctctttcacttgtgaagcttagtttggctggatatgaaattctgcgttgcaaattcttttctttacgaatgtagaatattggtccccactctcttctggcttatagggtttctgccaagagatctgctgtgtctgatgggcttccattcgtgggtaacccaacctttctctctggctgcccttaacattttttccttcatttcaaccttggtgaatgtgacgattatgtgtcctggggtttctcttctcaaggagtatctttgtggtattctctgtatttcctgaatttgaatgttggcctattttgctaggttggggaagttctcctggataatatcctgaagtgtgttttccaacttggttccattctccccatcactttcaggtatgccaatcaaacatagattttgtctttacacatattcccatatttcttggaggctttattcatctcttttcactcttttttctctaatcttgtcttctcgctttatttcattaagttgaccttcagtctctgatatcctttcttcctcttgatcgatttggctattgatacttgtttatgcttcacgaagttctcgtcctgtgtttttcagctccatcaggtcacttatgttcttctctaaactggttattctagttatcaatttgtctaaccttttttcaaggttcttagcttccttgctttgggttagaacatgctcctttagcttgaaggagtttgttattacccaccttctgaagcctacttctgtcaatttgtcaaactcattctctgtactgttttgttcccttgctagcgagttgtgatcctttggaggagaagaggtgttctggtttttggaattttcagcctttttgcactggtttctccccatctttgtggatttatctacctttggtctttgatgttggtgacctttggatgggatctctgaatggacatcctttttgttgatgttgatactattcctttccatttgttagttttccttctaacagtcaggcccctctgctgcaggtctgctggagtttgccataggttcattcattccagatcctgtttgcctggatatcaccagtggacgctacagaacagcaaaaattgctgcctgttccttcctctggaagtttcatcccatagcagcatctgccagatgccagccagagctctcctgtatgaggtgtctgtcagcccctactggaggtatctcccagtcaggatacacgggggtcagggacccactgtggaggcagtctgtcccttagcagagcttgtacactgtgctgggagatttgctgctgtcttcagagctgtcaagtagggatgtttacgtatgttgaagctgcacccacagcctccacttccccctggtgctctgtcccagggagatgggagttttatcttatcagaccctggctggggttgctgcctttgttttttctttagagataccctgcccagagaggaggaatctatagaggcagtctggcagcaatggccttgctgagctgtggtgggctcctcccagtttgaacttccctctggctttgtttacactgtgagggttaaaccacctactcaagtctcagcaatgttgcatgcccctccccataccaagctcaagcatctcagactgctgtcctagcagcaagaatttcaagccagttaatcttagcttgctgggctccatgggggagcgacccacggagctagaccacttggctccctggtttccgccccctttccaggggagtgaacgattctgtctcgctggcgttccaggtgacactggggtattaaaaaaacaaaaacaaacaaaaaaactccacagctagtggggtatctgcccaaacggccacccagttttgtgcttgaaacccagggccctggtggtgtaggcaccagagggaatctcctggtttgctagttgtgaagaccatgggaaaagtgcagtatctgggccagagtgcaccgttcctcccattacagtctttcatggcttcccttggctgggggagggagatcccctgaccccttgcacttcccagctgaggtgatgccccaccctgcttcagctcgccctctgtgggctgcacccactgtccaaccagtcccagtgagatgaactgggtacctcagttggaaatgcagaaatcacccaccttctgtgttgatcttgctgggaactgcagactggagctgttcctattcggccatcttgcctggaaattaaataatcaaatgacttcgtctttagtcaatggaagcctttcaaattggctcttgggtcccgttgatctaatcccagtagattttgacagttttcttgttttcagaatgacaagatatctgtcttatgtctcacatgccccagatctggaatctgctatttttccaaagagctttggttccttttaatggaaaatgatatttagaaactgcaattgaggtgctagagttacttactgatgattttattcatatcacttgatgtctcaaagagtgctcatttccattcatttcctttcactgactcctcttttgtctatgccatttattttgatttactatcctgtattatttaaccttggatatgctaacactgtattttctaagtaggcaaaccaggcacatccaggactggaactcacatcacttgacttgctatccagaattctttttggtgtatcatgaatgaattggaaggttagatagttggagaaaaattttgacctgagttagaaattttattagtcttagaagttttattagttttccatttggaaaccagtaaaataaaatattttgacaatattttattgtcaaaattaaagctgagtcaagaaaaacaagtaagaaattaggctaattaatgtaatgtaagaggaatttagagctagagaaaaaggctgcatttataagcagagtttaaaatcaccaatggaatcctgtggcctgttttcagtgcatttgctggcacaggcaaataaaatacactgtacaccatttcttggcttgtactggtctcattatatagacatgtatattcttttgttgcttgaatatttagaagttgctatggccagattagatttttaaactattcatgcaaactccagacaagcaagttactgcagttctctctttcatgtgtggttttgacggatattatgtaatatagtgtacaacccaatcaagaaatacctaccctgcagtgtgaaaacagactctgaaactagcagtttaaattagatggggatgtgatagtggttaagagatcacttaggtggataccactgtagactaagtgtgagatgaggaaggcattatcagtggggtcaaataagaggatgatagaagagatgctggaagtagaaaaagatcgaattaaaccaacatttattgagggtcagtgatttgccaagtacgatttgaggcactaatcatgcagtgatgaaagagaatggcaaagtggtcctccttatgagttatccattaaatttaggggagataaggaagatggatgtgtgctcttgggtttttagcttcaaaaatggctagaagccaagccattactgtagcaatgggaaatgctgtgattttccctttttcctccagaaaaacaatacacagttttattaattaattgacacatctatgatgcctttacccctgcatttttggtggtatactctttagttaccttttcacactacatttttaaaaaatatatctttctttggaaagagtaaaaacttcagtcttgatcatctagattgaaagatagtttaatctttcatctgtactatccttgattagggttaatcaaaatcagtgttttaggggatttcctttgattctgaactttttcaattggaaatggattattattctgttcttatacttcaagccaggtattcaaataatattaaataatattcagtaactgagggaagagtaaacatttttatgaaacaagtttaaaaatgaatgctttagtttctcattaatttttagtatactaaaatgtaacagttaaatagtgggttggctataagtctttatgcttcttattcaagcatttattgtcattttaaaaattgaaatgtatttttgtctataattatgacaatagcttctatttattaagagctcactaattgtcagacccatttctttgtggtttccatactttaacttatttctcatagctttatgagaaattaatacatataaagacacatacaaatgaattcttaaatttttaaatgccgcatatctacaactatctgatctttgacaaacctgacaaaaacaagaaatggggaaaggattccctatttaataaatgacgctgggaaaactggctagccatatgtagaaagctgaaactggatccctttcttacaccttatgcaaaaattaattcaagatggattaaagacttaaatgttagacctaaatccataaaaaccctagaagaaaacctaggcaataccattcaggacataggcatgggcaaggacttcgtgtccaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcagcctactcatctgacaaagggctaatatccagaatctacaatgaactccaacaaatttacaagaaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagtgagaatggcgatcattaaaaagtcaggaaacaacaggtgctggagaggatgtggagaaataggaacacttttacactgttggtgggactgtaaactagttcaaccattgtggaagtcagtgtggcgattcctcaggcatctagaactagaagtaccatttgacccagccatcccattactgggtatatacccaaaggattataaatcatgctgctataaagacacatgcacccatatgtttattgcagcactattcacaatagccaagacttggaaccaagccatatgtccaacaatgatatactggatgaagaaaatgtggcacatatacaccatggaatactatgcagccataaaaaatgatgagttcatgtcctttgtagggacatgaatgaagctggaaaccatcattctcagcaaactatcacaaggacaaaaaaccaaacactgcatgttctcactcataggtgggaattgaacaatgagaacacatggacacaggaaggggaacatcacactagggcctgttgtggggtggggggaggggggagggatagcattaggagttataactaatgttaaatgatgagttactgggtgcagcacaccaacatggcacatgtatacatatgtaaccaacctgcacgttgtgcacatgtaccctaaaacttaaagtataataatttaaaaaaagcagatcatgatgcacccatgcttaaaaccctttaatagacacacttcgcatttaggaaaaacaattctaaactgaacataatgcttgtgaatcatgctactttactttagtccctgtcattcttcgtcttgctcccacatgcatgactcactgacctttctgttcctgggacaaaccaaacttactccatcaatggaatggaaatcttgtccccagatctgatcaagtgtggctccttcatgttgcttaagtgtcagctcaagtgttacctttttagagaggccttctttgacctccaaatctaacagagcccttcctctcctcctggcctcaagtgatacattactgttttcattatacacttaccagtatctgaaatgatctcatgtatttatttagtctctggcacaaactgcatggaagcagattccttatttagttttgtcacctctgaattcccagcacctaaaagagtatctgccacatagtaggcacttaataaatgtttgtcgttgaatgaatgtaatggaaaggattctggggtcagcaaacttggtttttgagtctgttgcttttgagtacatgcaggaggcaaaccatatgacccaatcaggccttattctctcaacattctcaagattaaataaaccaaagttttctcaaagcagttttaaaagtataaattttaattatcacaataatcctttgatgacagataatatgaatcattgttttcatagttgaaaaggaagatacagattaccaagtttacctctcttttttctaagcattagaaaaccactaagaaggatgttctttaagttatagttagttaatggcagtgttaactctataatctggatttcttggtgtctatttagcctactatatattccatattaacaggtgagctcagtttaaattcctacattctggtaaaaataatttcttctttttctgtcacccattaagaattatttatgtaccattaaaaggttgattaaaaaaaaaacagaattccatatttgagaaggtagcatctatatcaatattctttacagcccaattcactagaagtgaggcaagtaaccaaggactttctgctgttgaggatgtaagcatcatttaatggagaccctacaactgtaatagttaccatcacaagcaggctttaagcagttctggatacaggttagacccaattctgcaggtgaattgcagcactgtacctctgtctctgtggtagcatttctcacaaggttttgtgggaagagtggagaagggaaagattcaatgtctatgtccaggatctctgactccaaatatcatcctagtccttctacatctgtagagcccctttcagttaataaaaaagaaaactcatgttttaattagtaatgtcattcttgagggaaaccattattttccatcttagttcactcctgccaccatagttattccaaattcatatcaagacaaattttaagcatacatattctaaagcttttggaaaactagaatataggcaaagtgtctaatgacccatttaatttcttactgagaaggaagatgagctatgatatagtatttccaaatgacatgtgaaatagatctgaaagcatggcctccttactctccctttcactttttgtttcttaatataaaatactttttgtttgcttagtatgccattcattggtctatggattgtgctgcaggccttgttggcctgtattctttttttctcattttaatcattatttatgtgaggtttaacaattttaccccagctttttgaggtaagactgacaaataaaaattgtatatattttaggttgaccacatgatgtgatataagtatacattatgaaatgattaccacaatcaagctaactagcatatcaattacctcactaggtatcatttttttctgtggtaaggaaacttgagatctattctctcagctaatttcaagtataaaataaattattaactgtagttactatgctgtacattaggtctccagaatgtattcatcatatatctcaaaatttgcaccctttgaccaacatctcctctcttcctcctccccagcctgggttaatcaacattctactctctgtttctgagtttgacttttattttttagatttcaacatgtgatcatgcagtatttgtctttctgcgtatggcttattcacttagctcactgtcctccagctttatccatgttgttgcaaatgggaggatttcctttttttgtaagtctaaatagtattctctcctgtgtgagtgtgtatacgtgtacacacaccccagtttctttattcattcttcagttgatgaacacttaggttgtttccatatctcggctactgtaaataatgctgcattgaatatgggactatagatacctctttgagatagtgattttatttcctttggaaacatctccagtagtaaaattactggttcatatagtagttctatttttaatttttttgaggaacctctatactatttttcataatggctgtaccaatttaaagttccaccaacagtgtacaagtgttcccttttctccaatcttcaccaacgcttgctatcttttgactttttgataatagccgtgctaacaggtgtgaagtggtgctactttgatttgcatttccctgataactagtgatgtagtgatgttgaacatcttatatacctgttgaccatttgtatgtcttctttggaaaattgtctatttacatcatttgcctatcctttaatcagttttttatttgctattgaattgtgtgggtttcttatgtattttagatactaattctttatcagatatatggtttgcagacattttcttccattctgtagattacctttttatttcatcaattgtttcctttgctgtgcataaacttattagtttgatgtagtcccacttgtttatttttatctttgttgtctgtgcttttgttgtcaaatacaaaaagtcattgccgagaccagtgttattaagcttttcccctgtgttttcttctaggagttttgtgatttcaggtcttttgtttgtctttaatccattttgagttagtttttgtgtatgctctaagggtccaatttcattcttttccacatggatatctagttttcccagcattatttgttgaagagactatcctttcttgacattttgtggaaaattagttaactatatatgcgtggatttatttcttggttctctattctgttccagtggtttgtgcatctgtttttatgccagtgccatattgttttaattactatagctttataatataacttgaatcaggaagtgtgatgcctccagctttgttcttcttgttcaagattgctttagatatttgggtttttttgtggttccatacaaattttaggacttaatttttctatttttgtaaaaaatgccattgggatcttgataatgattgaactaaatctatagatccctttgggtggtatggacattttaacaatattaattcctccaattcatgaacatggatatctttccatttatcagagtgaagaattgtatctgtgtcttcttcaatttctttcatcaatgttttagagttttcaatgtacaggtatttcacctccttggttaaatttattcttgagtattttattccttttgatgctattgtaaattatattcctttcttaatttgttttaggatagttcattattaatacatagaaatggcaactgacttttatatgttgattttgtatcccacaagtttattgtatgtacttcttttaatactttcttggtagagtctttatggtcttctgtaataagattatgtcacatgctaatagagacaatcttacttcttcctttccaatttggatgccttcatttctttttcttgcctgattggtttggctaggacttccagtgctatgttgtagagaagtagtgagactgggcacccttgtttcttcctgatcttagaggaaaagctttcagcttttaaccattagtataatgttagctgtggatttgtcatatatggcttttattatcttgaagttcattcattccatgcctaatttgttgagttttttgaattatgaaatgatggagaattttgtcagatgcttttgttttggtatgtatttagatgatcgtataattttattctttgtttttaatgtggtacatcatgtttattgatttacctatgttggaccatccttgcatctcagggataaatcccactaggtcatgcatatgacactttgaatgtactgttgaatttagtttactagtaggttattgagaaattttacatccatgttcatcagggcctgtgattttttttcttgtagtgttcttgtctggctttgttattagggtaaagccagcctcataaaatgagtttgaagtattttcttttctttaattttttggaagagtttggggagaattggcattaattctccttttaaagtctaatagaattcatcatgaagctgtctgctcctggaccttttctgttgggaggttttgtttactgatttaatctctttactagttctaggtctgttaggattttgtatttcatcatcattcagttttggtaagttttaagtttctagaaatttatttatgttatgcagtttgttagcatataatttttatagtagtctcataattttttgtgtctctgaactatcatttataatggctcctctttaattataattgtatttattcaagttgtctctcttttttttcttagtattctaagttaactaaaatatatattaaaatactcacaattctgcccctctttccctcccccaccacatttgtttcaggaagacagagagactggggctcagattcttaaaaccagggagatactattcctgatattgtagaaatttcaacactatttttacttttgggaaaagaacaaccaaagacaaaaacttttagcacctaaatacacaaagtatggtctatggaccagcagaatcagcatcacttgggagcttgctagaagttgttttagtacgttttctgttgcttgtaagagaatactcaaaactgcataatttataaagaaaaaaattatttcttatggaggctgagaaatccaaggtcaagaggccacatctggtgaggcctccatgcttgtggggactctctgcagagtcacaagcccgcagagggcatcacatggtgaggggactgagcatgctagctgaggtctcttttccttttttcataaagccaccagtcccattcctattctagtccattaatttattaatttattaatccactaatctgtgaatggattaacccattcgaaaaggcagagccctcatgacccaatcaccttttaaaagccctgcctctcagtactgctgcattaaggattaagttttaacatgaattttgaggggacaaacattcaaactgtagccaaaatgaagacccttcatctacaaactaaagctatgtaatcagtatctacattttaataagatctctaagtgatttttatacaccttaacatttgagatatgggaatgctaaaggtcacctgattactctgagtatcaaggctttataattttttcgcttgtagaaattctgagttatactaccctattttgggttgctaatttacttctctaccaagggaatagggactttttttcttatttaccattttgcattgccccatactagaatttataaaactttggtgcatgttagcatatgaggagattcatttatttatttttaaagaataattggtctcttcccctacaatctgaagctactggattagggttagggcttccatatgtttaacacactccctattcaactaagtgttaaaacttgataagcctaacttcatttgaagtgtacataaacatgtgtataatgaaatatttatgaaacacaccagttttaatgattaaataacatggtaataatatgaatttagtatccttttgtatcttctattttaatgattgtcaatttaaattataataacatcagggaattaactttgcccaaaaaatctgaatgaattacatataaatagaaatactgagatatttttggtagaggaacttaataacttaattttgaggcttttgggaagaaaggtggtgaaaatttattaggacatgttgttaccataaaacagcacatcctggtgatgactcaccaaaaatgcctctcagctggccatggtggctcacgcctgtaatcccagcactttgggatcatgagatcaagaaatcaagaccatcctggccaatatggtgaaacccagtctctactaaaaatacaaaagttaactgggcatggtgtcgcacgcctgtagtcccagctaatcgggaggctgagggaggagaatcgcttgagcctgggaggtggagactgcagtgagctgagatagcaccactgcagtccagcctggtgagagtgagactccttctcaaaaaaaaaaaaaaacaaaaaaacctccttttgtacctttataactctttatgcagaggggtgggcctaatttggaaattgacagtaatggactagttttttttcattgaagtataatttatagacaataaattatacagatataacacatctggtttaattgccttagatgagttcatatatctgaatactgactttgcaaatgtagcctatgtctgttacccaggaagtttacttgtgccactttcaggcaaaggtttcctgatttctaacaccatagattagttttgcctgttttggggcttcatacaactagaaacatactgtatgcattattttgtgtctggcttctgttattaaatacaatgtgttttaaatttattcatgttgtttcctataacagttcatgattttttgattgctgattagcatttctttttttaaattttttaatttttattttttattatactttaagttctgggatatatcaacagaatgtgcagttttgttacataggtatacaaatgccagggtgatttgctgcacccatcaacctgtcacctacattgggaatttctcctaatgctatccctaggcccccaccccctgacaggccctggtgtgtgatattaccctccctgggtccatgtgttctcattgttcaactcccacttatgagtgagaacatgcggtgtttgattttctgttcttggaatagtttgccgagaatggtgattcccagcttcatctatgtccctgcaaaggacgtgaactcatccttttttatggctgcatagtattccatggtgtatatgtgccacattttcttaatccagtctatcattgatggacatttgggttggttgcaagtctttgccattgtgaatagtgctgcaataaacatacgtgtgcatatgtacctacagtagaatgatttataatcctgggattgctgggtcaaatggtatttctagttctagatccttgaggaatcaccacactgtcttccacaatggttgaactaatttacactcccaccaacagtgtaaaagcattcctatttctccacatcctctccagcatctgttgtttcttgactttttaatgattgtcattctaactggcatgagatggtatctcattgtggttttgatttgtgtttctctaatgaccagtaatgatgagcttttttcatatgcttgttggctgcataaatgtcttcttttgagaaatgtctgctcttatcctttgtcgactttttgatggggttgtttttttttcttgtaaatttgtttaagttctatgtagattctggatattagccctttgtcagttggatagatggatagatttcaaaaattatctcccattctgatggtagtttctttttctttgcagaagctctttagtttaattagatcccatttgtcaattttagcatttgttgccattgcttttggtattgtagacatgaagtctttgcccatgcctatgtcctgaatggtattgcctaggttttcttctgggatttttatggtttaaggtcttatgtttaagtctttaatctatcttgagttgatttttgtatacggtgtaacgaaggggtccagtttcacttttctgcatatggctagctagttttcccaacaccatttattaatagggaatcttttccctgttgcttgtttgtgtcaggtttgtcaaagataagatggttgtagatgtgtggttttatttctgaggcctctgttctgttccattggtctatatatctgttttggtacccgtaccatgctgttttggttactgtagcctcgtagtatagtttggagtcaggtagcatgatgcctccagctttgttctttttgcttaggattgtcttggttatgtgggctcttttttggttctatatgaagtttaaagtagttttttccagttccgtgaagaaaagcaatgggcagtgtggccattttcatgatactgatccttcctttccatgagcatggactgttttcccattcgtttgtgtcctctcttatttccttgagcagtggtttgtagttcttcttgaagaggtccttcccttgtaagttgtattcctaggtattttattctctttgtagcaatagtgaatgggagttcactcatgatttggctctctggatttttttttttttttttgagatagagtcttgccctgtcacccaggctggagtgcagtggtgtgatctcagctcgctgcaacctctgcttccctggttcaagcatttctcctgcctcagcctccccggtaactgggattacaggcaactgccaccacacccgacttttttttttttttttgtatttttagtagagatgggtttcaccatgttggtcagtctggtcttgaactcctgacctcgtgatccgcccacctctgcctcccaaagcgctgggattattggctctctgtttgtctgttattggtgtatgggaatacttgtgctttttgcacattgattttgtatcctgagactttgctgaagtgcttaccagcttaagaagattttgggctgagacaatgggtttttctaaatacacaatcttgtcatctgcaaactgagaaaattcgacttcctctcttcctatttgaatacccagtatttctttctcttgcctgattgccctggccagaagttccaatactatgttgaaaaggaatggtgagagagggcatccttgtcttgtgacggttttcaaagggaatgcttccagtttttgcctattcagtatgatattggctgtgggtttgtcataaatagctttactattttaagatacgttccattgatacctagcttatggggatgctaatatcatgctaggtattagcatgaaggggtgttgaattttgttgaaggccttttctgcacctattgagataatcatgtggtttttgacattgttgctgtttatgtgatgaatcacatttattgatttgtgtatgttgaaccagccttgcatcccagggatgaacctgatttgattgttgtggataagtttttgatgtgctgctgggttcggtttgccagtattttattgaggatttttgcgtcgatgttcatcagggatatttgcctgaaattttctttttttgttgtgtctctgccaggttttggtatcaggatgatgctggcctcataaaatgagttagggaggattccctctttttctattgtttggaattgtttcagaaggaatgataccagctcctctttttacctctggcagaatttggctgtaaatccatctggtcctggacttttttggttggtaggctattaattactgcctcaatttcagaacttgttattgctctattcggggattcaactttttcctggtttagacgtgggagggtgtatgtgtccaggaatttatccatttattctagattttctagtttatttgcgtagacatgtttatagtagtctctgatggtagtttgtatttctgtgagatcagtggtgatatcccctatatcattttttattccatctatttgattcttctcttttcttctttattagtcttgctagcagtctgtctattttgttgatcttttcaaaaaaccagctcctggattcattgattttttgaagggttttttgtgtctctatttccttcagttctgctctgctcttagttatttcttgtcttctgctagcttttgaatttgtttcttcatggtgtcgatggtctttacaattgtgtatgtttttgcagtggttgctaccagtttttccttgccatgtttagtgcttccttcaggagctcttgtaaggcagacctggtggtgataaaatctctcagcatttgcttgtctctaaaggattttatttctccttagcttatgaagcttagtttggctggatatgaaattctgggttgaaaattcttttctttaagaatgttgaatattggcccccactctcttctggctttgaggatttctgctgagagatccactgttagcctgatgggcttctgtttatgggtaacctgacctttctctctggctgcccttaacatttttttcttcatttcaaccttggtgaatctgacgattatgtgtcttggggttgctcttctcgaggagtatctttgtggtgttctctgtatttcctgaatttgaatgttggcctgtcttgctaggttggggaagttctcctggaaaatatcctgaagtgtgttttccagcttggttccattctccctgtcactttcaggtacatcaatcaaatatagatttggtcttttcacatattcccatatttcttggaggctttattcattcctttttattcttttttctctaatcttgtcttttcactttatttcattaagttgatcttcaatttctgatatcctttcttctgcttgattgattcagctattgatacttgtttatgcttcatgaagttctcgtgctgtgtttttcagctccatcaggtcatttatattcttctctaaactggttattctagttatcaattcatctaaccttttttcaaggttcttagcttccttacattgggttagaacatgctcctttagcttgaaggagtttgttattacccaccttctgaagcctacttctgtcaattcgtcaaattcattctctgcgcagttttgttcccttgctggagaagagttgtgatcctttggaggagaagaggtgttctggtttttggaattttcagcatttttgcactggtttctccccatctttgttgatttatctgcctttggtctttgatgttggtgaccttcagatggggtccttgagtggacgtactattcttttctgtttgttagttttcattctgacagtcaggaaactgtctgcagcaggtccactggagtttgctggaggtccattccacatcctgtttgcctgggtatcaccagtggagtctgcagaacagcaaagattgctgcctgttctttcccctttccagggaagctttgtcccagaggggcacctgccagatgccagccagagctcttctctatgaggtgtctgtcggtccctactggggacccaggataaacgggcgtcagggacccacgtgaggaggcagtccgacccttagcagagctcgaacgctgtgctggcatgtccactgatctcttcagagccgtcaggcagggaaatttaagtctgctgaagctgtgcccacagctgcccttcccccaggtgctctgtccagggagatgggagttttatctataagttcctgactggcgctgctgccttattttcagagattccctgcccagagctgctgagtagtatttcattgtatgaatatatcacacaacttgtatattgattgtcctgttgatagcatttgggttatttttagtttggaattattatgaataaaactactgtaaacattgctaaagtcttttgctgtggacacacaatttcatttctctaggttacatatctagcagaaaaatcattggccatagtttaaccttataagaaactttacctaacagttctctaaagtgattacatctgttttcaatctcaccaacaatgaatgaattccaatttcttcacatatacatgtaaacattggatattatgtcttttaattttagctatttttgtaggtgtgaaatcataccttactgtggttttactgtgcatttccctgatggctagtgatgatgagtactatattatgtgcttattggccatttctgtatcttcttttgtaatatgtctgttcaagaccttttactcatttaaaaaaattgtgttgtttttctttttattatctatatgttttctgatatgagtcatttgtcagaaatatttaatgcaaacattggcttgcattcttaaatggtgtcttttaaggaatggaaatgtttaattttgatgaaatctcatgtacttattttaaaactgctagtggtttctgtgtcctgagaaatattcatcttaatccaaagttgtgaagatactctcttatgttttttctttgaagacttatagttttagtttttacatctagatctatgttccatttaattttcttatgtgaaatgaggtaggagtccaggttcattttattccatgtgtttattcagttgattcagcaatgtttgttgaaaagactttccttttctatccaactactttgacatttttgttgaaaatcaatcgaccatgtaagtgtgggtctgttaccgaaactctattgtgttctgttctatgcctatctttatgtcaatatagtaccatgctttcttgatttctgcagcttatagtaagttgctatggtttggatgtttgccccctctgaaactcatgttgaaacttaatctccagtgtaaaggtactgggaggtgggtcctttaagaggtgattgggtcatgagggttctgttctcaccgttagatacatccttttcatgggttagtttattagtgggttaccatgggagtgggttagttatcaggaaagtagttctgttataaaaagccaggtaggttctctctcctgagccccctcaccatgtggtaccctgcaccacattgagactctgcagaaaacccccaccagctgtaaggtcctcaccagatttcgcccttagactttggacgttccagccttcagaactataaaaaataaatgtattttctttataaattactccatctcaggtattgagttataacaacagaaagcagactgacataagtcagtatcagttaatatcagttctccaactttgttattaagagagttctttttcaagactgttccaattcaaaatcatttgcattttatatctgttttagaatatttgttaatttaaaaaattgggattttgttgaatctatagaacatatgtggagggtggacatgttaataatattgagtcttttaattctgaatatggatctctccatttatttggtttctttaattttgcaatgtttcagtacgggggtctttccatatttcattagcttcatttccacatttataatacttttgatactattgaaaatggtatttttttcccaataaagaaaccattaatcttgtgtcttgtgaccttgctaaattcactttgttctactattgtttttgtagattccactttctatgtagattatcacgttttccataaaaaatgatggttttattttttcctttataatctttacatgttttatttctcatttgtgcccatggctgtagctagaactatccttgtacatttttgaatagaaatggtatgagaatgtatccttagctacttactgatttaagaaggaaagaatttagtatttcacaactcaatgtgatgttgtatgtcgatttttttatagacagcattcacattcataggttaagtcctactcttagtttgctgaaagttttatcataaatgagtattaaattttgttaggaacttttgatgctctaccaataaattgagatgttcatgtgattttttttctagtctcttaccaaagtacattatataagttgaattttgagtgttaaaccaatcttgcatctctctaataaatcccacatggtcatgatattttaaattatattgctagatttaattagctagtattttgttttagatttttatatccttgttcataaagaataatggaaaatttacttgtatgctaaatcaatggactgtaattttcttactttgtaatatctttgtctaggttttctttttaattagggttatgttggcctcataataaaaattggggggagttcacttctcctttattttcatttaattccaccaaaacaaatagttttattttatttttttcccttgactgttttgtagaaattgttggaagaaattactggtgaagctatctggaccaggagttttctttgtgtgaatgtttttgattaataatttaacttctttaacaaataattggaccaatttcaataaatagtgtttttcaaagactttgttcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtagtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaaaaaaaaagactgttcatttcgcctgtccacttacccttttaatgtttatacaatctgtagtggtgctttctatttgaatactgacttaggcaattatttatgttttctctgttgtttcttggttataattactaaggcatatcaatatatttatttgtccaaagaattaactttttaattatttattttttaattgtctttcaaatttatatttcatagttttttataccttttctacttttctactttttttctacttttttattgtagtttttctagcttcttaaggtggaagcttagatattggtttcttttttttaatatatgcttttaaagctaaaatttctctgtaagtgctgctttagctgtatcacaaaatatttgatttaaaaaattattcagtttgaaatatttaaaaacttttcctttgactttttaaaactcatggattatttagaagtatgttgcttaatttcaaagtattttaggactttcacttctgaaaatctataggacaactacagatcctacagataatagaaagatgataagtggacaggtgaaatagccaaagtcctagaaaaatactatttattgaaactggtccaattatctattaataagttacatttttaataaaaagcatttccgcaaaacttcatatccagatgccatcgccaatattttctaattaaatgccctttggtcaaggaacataatctgtatggtttcaattttttgaaatctgagacttgttttctctccagcatattgtctttttggtgactgtttcatatgcattacaaaacaatgtgtcttcttctgttgttagttggagtgttttgtaaatattaactaggtgaaactggttaataatagtgttgtcccaaccttctgttccactactaattttttctgttctaattaaataatactgaggactggatattaaaacttcacattatttttaatgtgtctctgcttattttttttcattttttgtttcatatatttagaagctttaatattagatgtctacacatttaggatttttatctctttctgattgaatgctcagtttattaccagaaaatttctgtctaaaattcttactgctgtccctctgtaggtaatgtatcacttttcctctggccacttttaggaattttatattttattttgattttcagttgattgaatatgatgtatgtaggcatgatttactttgtgtctcgcttggggtttgctgaagttctttgatccgagaattgtggctttcattaattcggaaaatttttggccatgtcttttcaaatatttcttcattctctccttttcaccagaaaaatttacttatatgctaaatcaagatcacttgatattgttccataagttctagatgctctattccttttatcatgtttttatgccttggggtttcattttttgataatttctattgacttatcctcaagtttacttatcttttcctccagtggatgcaggtaaacccgttgcataaaccattttctgatgtttgtttaactgcaagcatttttctttgtatctttttgtatagttttcatctgccttctgaaatttcccacatctttgtacgtgttttccatcttattcactagatcctttaatgtatttatcactgccattttacaaacactttttgctacttctgatatttagataaactttggatctgcttatggtgtttttctcctgatcaggaataaaaatttcttgcttcttttcaagtcttggccactgttttatatttgaggaagtctctgggtacctggagaggaagagggacagactctctctaggctgttctatactgttgccaactttctatggactacttatctactccgtatatttagttaaggctcaccagaaggaactgctgaatgaaggaatgcttgttgcgtggcagagactcctcagatttccaatctgttacaccagctttgagtgattttttatatgctgtggcaaattccttctcatcagtattccctttctgccagagattaaagcagttgtgaatcatttctatatgacaaagggttaataacttctggaatttggttcttttaggtttctttaaattatttcatttctgctgggcttaaaaagcatatgaatttgtactttatctggtatgtactcattgttgtgaatgacaatctcttgcaactttctacattctaaccagaaatgaagttcttggacttattttagatggtgtatgaaaactatgtaactgagtctttatgaattaaataaaacaggtcttaatgtttacaattacatcttattttaaaaattaaattccatcagctgtatcttagacatattttcactaaatactctttgagtgtcccttaaatacaaacccacgtttaaaagaaaaatgtttgctaatattcagatagtaaaaagaatgagataaggttctacaggctacgcccaaaggataaatttgagtaaatattttgcaaaaagctcaaattttagaaaatgtgtatgcttttctgaagacaattaagaattaaggtttatcatggtctttagccactattcattgtcctcctgcattaatatatttaacatttggctgttttaaacagatttaagttaattctaatagtcacaaaattagctgtacttcaattggctcttgtttcaaaatgtaaatgtataatggctagatgttgactttaattaatatatttaacttgccttttttttccccctaggaatcctaaaaccaaaatattagaacgaaaacagaaacatggctcactatattacatttctctgcatggttttggtgctgcttcttcagaattctgtgttagctgaagatggggaagtaagatcaagtaagaactatcagcattgtccttttttgttatcaacaaattaatctggaaattaaactaggggagttcaagtaatggttttaaggatctcattcttactgtctttgattctgtaactccctaaaataaatgaattgctatgttactcattaactgagaagaaaagcttccctcagagataattttgagatgactctatggcaatagtttattcaattaacacatcaagctttggaacaaacagtctggtattgagtccatgttcagccacttttgaactgcatgataggaagataaagaaagccttctagattggttatcaggactgaatgagataatgcatgtcaaaggcttagcacagtacatctcagtgaatgttattattgcttgtaggaaagcttgcctatagagataaagagctatattaattatagttctgttacccagactatcatttagagatagcacacttttttttaaaaaaaagtttgcttatgttcacattttaaaactcataagcatcctactataaattaactaaggtctctataaaagttaaatgagatggtttgacaatttgattcaacttggcttaaaatttattaatacaataatatttaaagcttgcttaacacttctatagtttaattcatgcaatcactgtataatgtggatgccctttcctttgtttttttcttgggtggaaaacgggattttaataagttaaggggcttacctagcatcatacagcttgtgagggcagtaactagtatttgaaccatgtttttgctcttcagtcccattccttttctatgatgtcattcatctctctaaggaagaggttctcaggatggatattatgtctagggcttataaatggcattatttgcttgtatgcccatgctgttgactaactttacagttatgaaatacatgctctgtggccctgtgacagggagaagggtaggaagggccaagaataaccctcttagagtgaaaaccactgaatcaggtggcacacaaacactaacagcttcagacaacaatgagtctcagtatttaggaagggccaacattgaaaagctctgccaacaagcttttctatcctttcgtctccctgcaaaaaaaaaacaaaaaacaaaaaacaataaaagcataaccctttaatcctagtccatccagcttccaagcttccaaaaataacagaaaaattgcattcccttgggttaggaagtttgcctctggacagaactccatttctgctgtccctactttgacctctggcagtggccgccatggcagaggttgttggaattgtgtcccttacaccttctgaggatactaccacctgcagtagaacactttaggaataatgtcataatcacagacacatttttgagacaaatccatattttggcaattctttttatttttggaacttcttgactgctataaatttaggaggggatggcaacctaactgtggaaggtcaggaaaggttttatgataaagccgacaggcaatcagggatctgaaacaagagtattagtcaggtgaagaggaagacattctaataaaagggaagagcaactgcaaaggcccagagttgggagactgacacagactaaaagataaactggttcgttggggcaattccaatagtttggaatggctaacagaatgcgcagaaaagaacagctatatttgtcttcttctctaacttctgttcttaaagcagcaataatagttattatttatagcctgtatgataatgagataattttatattcatgctttgttttacatttagcatgttagcatttgtaacaggggaagtctttttctttccacaactgcttataacttgttcaaatgtaacttgcaccaaagatggtatttttttttccccaaaaggaccttaggatgtgttgaccagatgtgtttcctggtatcttgaaacaagaatctctatctctactaagcaaggaatagctttatacctttaaccatagattgttagtacaagctaatgctctgacattattcactgaatatgagacatcagacctttagaaactcatcttggatataatgcaagagttgattcattgggtgatcttggttcatttaacttttatcaactattaatatatcaaagatgaaattttattggttagctaagtcctggagttggtagaaaatttgtttttaatttttttctccctattcactggcttatatttttgtaatatttcacgttagcattaagctaaacatatttcacagacaatttaaaataagcaatgatattagtgtatagctgaaactcatatatttaaaatctctccctttttgctttttatataaaagatgtgctatgatggttttcttttgcacttaggttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaaggtaagccttaaaatgccttaatataatttggaagcaattaataattgtgctttttacattttgatataatttcttcattaacactggtgtaaattgttatatttaatgtcaattataatgttacaacatttataatgttataaatgttatatttatactgtgagcataaattttttgtgttgtatgtatttaggataaattttggtttttagaaataagttacaaatctatggaaaatacaatattttgtaacatttattatttttcctttcaattataacatgtctattgtagaaattgtagaaaaaggcacaaagaataaaaatatatataaatcacacataatcatatcaccccgttaatgagtttttctgtactttacattctagtttttttccttttttccccagtgtgttttagtttatccttctgcctaaatcaagatactattgcatatataatttcatactttatttttgtatgatatactcttgtgtatacaatttttatactctattcataggatagcagacaatttcctactgtaatttattttaaatttttcctgtttttgtacatttagtttatttctaagttttgctaatataaatgacaaaaatgaatattcttgtacataattctgagctagaatttcattatttcttcagaaaaaagcttcaaattactgacatttttaaagttgggggaaaacgttaaaattgcactttaaaaagcttaacttccctttcacagaacatttgaaaataacagtttattaattatgtttatatcatttcataaaatctaacttcatgttcatgataactgcatggtatgggaaggtcccagttttggtaaatattaatcctattagggcatagatatgctaatattcagattattttaggggagagtaattttttgtatctcttatttttaatattataggcatttagtgtaccatattaaagtaatattcatataaagtgaatattagtttgtctacaaaaactcccaaagtgggtggcttcacatttgacaaaaaaatcctgtgtgtttatgagttaggaaacaaattatatcattaattcctctgttttcttcatatttgcttgtgggatatggtagagaaaaactttttaaattttcatatttaagagaatatagaaaattaaacgtcttcttccatgaaactttaaataaaggtactgtaataagtacaaatcaccaccatagttcttctttttatgaatctctagtagttagattttgttgacatttatcatactgaacaggccaatgggatttaaatttttaatatgtggtcatattagttagaattctttgattttgaagccaggtatatttcattcttaaaacagacttttcctggagaaatttcacttatcattcatttttatctttaaatataaatgtaactgataaaatgtttgttcaatatttgcttcagagactttttctgtggatctgtattttggtaaatgcattctattttaatgattctaactacacatgaaagagtagatgtgcttagaagagttaaacactcttttagttaaaatgtatcatctataaacacaatcaaaattgaaatcttgccaaatatattttcatccacactcgaaaagatataaataatttatgtgtctaatcagttcacatatctgttgcacaatagccatcttttaaaatgtttttgaaaatgcacttatggaatttatatggatgttttctgcactcgacttttttttttttttttttttttgaggcagagtctcgctctgtcacccaggctggagtgcagtggtgcaatctcggctcacttcaagctccgcctcccgggttcatgccattctcctgcctcagcctcccgagtagctgggactacaggcgcccaccacgcccggctaattttttctattttttagtagagaacgggtttcaccgtgttagccaggatgaatctctatctcctgacctcatgatccgcccgcctcagcctcccaaagtgctgggattacaggcgtgagccaccgcgcccagtctgcacttgacattttatactgtattagagtatgattaatgcattaaactaaaacattgctatattacaacagccacaaaccatgtaatctgtatttgaatcatttgataaattcacatgctttttctttgacacatacttaacttctatgttgaagtgttaacatgtaggatgaccatttcctaatactgtttatttttatactctgctgtagttgaatcacaacaaaatattattgagttaaataatatttaccacagtttattccatctttatggacctattatttctctggaagagttgtctctaatactctcctttctctgataggtgatgattcctttatctgtgtaaaagacttgtgctgctgctgcagctactactgctagtactactactactactacttctactactaccacttcctcttctactactacttctttttctactactacttctactactacttcctcctcctcctcttcttcttcctcctccttctccctcctccttcctcctccctcttcctccctgctcctgcctccctcattccttcctcctccctcctcctccttcctcctcccccttcctcccccttcctcccctttcctccctttcctcccccttcctcctctttcctcccctttcctctcccttcattcttcttcttcatttttctctttccccctcatataaaacacattaacatgaaacctagtcttctaacaaatctttaagtgtacagtattgtgaatcataagcacaatgttgtacagcatatctttggaactttttcatcttgcttgactgaaacctccctccttccttccctccctccttctcttccttccttcctttcttcctccttccccccctccctcttttccttcctctttctttctttcttttttttggtaatggccagcctaacatgtatgaggtaacatttcattgtagtattgatttgcatttctctgatgattagtgatgttggacatttttcatatacctgtggccatttgtgtgtcatttttggagaaatgtttatttaagtcctcaataaaattccttaatcagttttttttttgttgctgagttagagtttattatttattttgaatgttaacctcttatcagatatatggtttgcaaatattttatcccacttcatagattgtctttttacagagttttttttctcctttgctgcacagaagctttttagtttgctgtaatcccagttgtctatttttgctttttttgttgcctgtgattttggaataaatccaagaaatcattacgaggctgatgttatgaagcttttcctagttttcttttagaaattttatagtttcagatcttatgtttaagtctttattttgagttgttttttgtgtatggtgtaaaataagggtccaaagttattcttttgcatgtggatatccggttttcccagcactattgattgaagagatcctttccccgtcgggcagtcttaccacccttgtcaaagataatttcattgatgcatgcaagagtgttttctgggctctctattctgttccatttgtctatatgtttgtttttatgcctttaccatactgttttgattactctagctttgcaatatattttgaaatcaggaagtgtgaggcctccagcttagtttttgtttcccaagattgttttgactgtttgaggtcttttgaggtttcatataaattttaggaatgctttttctacttctataaaaaacgttattgggatttttatagggattgcattgaatctgtagatcaagttaggcagtatggactttttaaataatattgtctaccaatccatgaacacaagatatatttccatttattccttcttcagtttcttttatcaatgttttgtagttttcagtgtacaagtttttgattctttggttaagtttatttctaagtattttatttttatgttttataaatgagattattttcttaattttctttttaaattgttgttactgaatagaaacacaactgatttttatatgttgaatttgtattctccaaatttgcttaattggtttcttctaaccattttttttggcatggagtcttttatgtataatcattagggttttctatgtttatgatcatgctatctgtgaacagagataattttatttcttttgtgatttgaatgccttttatttcttttcttgcctaattcctctggctagtacaatgttgaatagaagtggtgaaattaggtatctttgtcttgttcctcatcttagaggaaaagcttttaacattttatcattgagtgtgatgttagctgtgaacttttcaaatatggtctttattatgttaaagtagtttccttctattccttacttgttgagtgcttttatcataaaatagtgctgatttttgtcaattatttttctgcctccattgagatgatcatgttatcttttccttcattctgtcaatgacacatttattgattttatatgtcaaactctttcatcctgtggataattcccatttggtcatggtgtatgatgttttcgatgtgctgttaaattcagtttgttagtgttttattggggatatttacatctatattcatcagggatattggcttgtagttttattttattatggtatctttttctggctttggtatcaggttaatgctggccttataaaaatagtttagaagtgtttactcctcttcaattttttgaaagatcttaagaaagatattaattcttctttaaatgtctggtagaattcaccactgaagccacctggtactaggcttttattgttggggtgttttgattactgatttaatttcctttaatctctagttataggtatgttcatatattctatttattcatgtttcagttttggtaggttatatgttctaggaatttattcatttcttctaggttaccaatttgttgatatatagtcgttcatagtggtcacttaaaatcctttttatttctgtggcatcaattgtaatatctcttctttcacttcctgttttgagtcttctctgtttttacttaatttagttaaaggtttgtcaattttgttgatttttccaaaaaagcaactcttagctttgttgacttctttccattttctattttatttattactgcttaaatctaaattatttttttcctcctgctaacttcgggcttagtttgtcttttttttctgtaggtccttgaggtataaagttgtttatttgattatttgatatcctttttcttttttaatgtaggcatttattgctataaacttctctcttagtactgttttcctgcatctcataaattttggatgttgtgattttgtcatcacgtattttctaactttgtctctgatttcttctttgacctgatggctattcaaaagtgtgctatttaatttttacatatttgtgaatttttcaattttcctcctgttgttaatttttagttttattccattgtggttggaaaatatactggtatgatttcagccttcttaaataagacatgttttgtgatttaacatgtggtctgtcctggagaatgtttcatgtgcaattgaagggaatgtgtattctgctgctgtttggtggaatattctgtatgcatctgctaggttcatttggtctatagtattgttcaagtcttctatttccttattgatcttctgtttgaatgttctaatcattattgaaatcctctactattattgtgtttctttctatttctcccttcagttctgtatatgtctgcctcgtatttttgttatcatgatgttggctgcatatataatcataattattatatcttcctggtgagttgacccttttatcatagtaggatatctttctttgtctcttgttatagttttgtactgtgtgatataagtatagacatctctgatgtcttttggctaccatttgcatggaatatcttttttcattttttcacttacagcctatgtgtgtccttaaatttaaagtgagtccttttcatttctcttttcttttcctttcccttttcccttttccccccttcccttccctttctttcccttccttccccttccccttctcctttccctttcctttgtctcattctgttgcgcaggctggagtgcagtggcatgatcatagctcactgcagcttcaacctcccagactcagtcaatcctcccacctcagcctcctgagtagctgagactacaggcacatgccaccatgcatggctaattttgttgttttttgtttgtttgcttttgtttttgtttttgtagagatggggttttgccatgttgcccaggctagagtctttcatagatagtatatagctggatctgtagctctaaaccattcagtctctctatgtactttgattaaggagtatactcacttacatttaaggtaattactgatagggaaaaattattgttgccattttggtaattattttctgtctttcctgtagctttttgtccctctttttttcttttactgtcttcctttgtgttttattgctttttttgtagtgatgtcctttatcattttatttatcttccgtaggtattttctttgaggttatcataggggttacatgaaacatcatgtaattataacaacttattttaagttggtatgaaattaaattacatataaatattctatatttttgctacctgtcctttgttactgatgccacaaattgcatctttttatattttatatctgttaacatatttttaaagttacagtttttaaaaatgcttttgtcttttaacttttacaccagaattaaaagtcatttatgcacactgttacagtattataatattgtgtgtctgtctatatatttacttttatctgaaaaatttatactatcttatgcttttatgttgctgattagtatacttctgtttgatcttgaaggactccttgagaatttcttataaggcaggtctgatggtgatgaactttctcagcttgtgtttatctagaaaagtctttatttctccttcatttttgaagaacagttctgccagacatagcattcttgtttggcaggttttttctttcctttcagcactttgaatatgtcatcccactcctggcctgcaatggtgctattgagaaatctgctgatagtcttatcaaggttcccttgtacataacaagtctcttttttcttgctgctttcaaaatgtgatctttgcctttaacttttgacgattagattacaatgtgtctcagtgtggatttctttgggtttaacttagcatatattaggcttcttgaattcgagtatccatatcctttcccagatttgggaagttgttggcctcatctctttaaataagctttttgtccccttttcaccctcttcttttttttttttctggaactcgcaaaatgcatatattggtatgcttgatggtgttgcttaaatctcttaggctttcttcactctttctcttcctttttctttttgtttctctaactggataatttcaaatgaccaattattgagtttgctgattcttttccctctgcttgttaaagtctgctattaatcatctttagtaaattttttcagtcattgtatacttcagctaaagtatatcatacttattacctatatagctgactatgtaatgctaatgattattcttaagaaaatattctttataagtatgattaatatataattatagatgagataatatgtccgtctgaagaactttcatgaatagatgggacccaggttaagttttttccagagagacagactaatgatatttgagctatagaaatataagctgcttgaactggaaagaaaatcaagaacagaaaatactttttaccccttaaatgctaagaatgcaagaaaagaattttagtgttcatttttgaattaaataaattaaaagcattatccaaagttgtatgactagttaataggaaatcctggatgagaatgataaatcctgttccattgtttttcttttccataggtgttatattgtctcatattgctattgtctcaattttttgctaaagacaatacattaacaaatatttatatttttgttttacttttatcccttattttttagagaaaaaagcatattaagatctcactcttaaatgtgtaaaatacttctacattttctcagaaaatgtattcatatacatttatatactatacatttgtatacatatgtagattttataattctaatgatagaatactatattgtctagtatttctcccttgatttttcttttattgtttgaatagtccatgattaaccaacttttattgcttttgctttatagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaaggtatgcattatatgttgacacaacttttttggggggatatgtctgtggacatgtcaagaattctttaagcttacacttgctcttctttttctagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaaggtaaagatgcctgggataataccatgattatgatattcatggggaagcactattgggtttatgtgtgttggggaaaagagggctataattttaacatgattggaaatatttttactttaaattttaatgtttctgtgttgaagaaaactaacaaagaaaggaaaattgtttcttgatcaatatggggacaaatgctgagggggaactgacatattttgagtgcctactactaggtaccaggcacatttaattataatagccatccaataaagaaaccattgctcccattttgcagacaaactaatattcaaggatgttaagttctccctcaaaatagaacagctaataagtgatgacatcaggaattaaattttggtctagttgacgtcaaagtccatattggtctgttttacactgccatgttctacaggatatttacatgaagacatatctgttagaatattaaataccagatacataataggtatgaaatttaccttaatttaggaggacattttatttaccctaatggaatacatatttaatagaatatacaaacttgaaaaagtttattttcaaaatcatgttttcagaatccagatgcaataataaaagtaattaagttttgctcattattatgatagtctaaagccatattacacagtttaggaaatatatatggtaatatatataaagtatgcaatttcttcatttagtaattatattacatttaaaaaattgttatttgctgtcttcattaaagccagtgtgccagattctgtaagaaatgacaaatgaataaggcatgtttcttaccttcaaagagcgtatttacaataggatattcaaggcaactggtatgaaatagaagtacaaagtgttagtggagtgtggatgggaaaatgtgttctaacataaaataagaggaaatctgcataaatgaaataatttttgaactggaccttgaaggatgtatagcattttgatggagatgaatataagggcgcattaaataaatgattcagtattgagtcatcaggtgtgtaataaaatgcagggtttttatttagagaatgcaaagtgactctcctgtgtttacagtataagatgcatggaagaaaaagctatctaggtgtaagcccaatttatgaggggcctggaaagccatataatgtggtttggactttattcagtgaatgtttcatcaaaaggtcttgaccatagtgtgtcatggtcaaggcaatcttctctacttctttttcttcttctgtccataaataatactttcaactttatccttaaattaggccaggtcctggggatacagaaattaataagatggaacatctcccctaacagaactgtagggagagagattaatcctagtggtgatctgaaggatggcttggaaatgaaagggtgagagatctagatagatttgaaaattattgaagtaaaacaagagttccatgagcctaaattatggtagtgacaatgcaaatgaagaaatgaatttgagtcaagttgaagaaatatattgggtagaactctgcatctggttagttactgcaactcaaagaaagaaacttatgtttagaggatgctattacgtagggaaatggggtcaagaagaaaactctggggggtagttcaagtttattttgttgcatacgttgttgggctaattgtgaaacatcctgaaaaattattctacctagtattagaattataggacccacacataggagaggtacaggctgttagtgtagacatggtagttattatataccagtgataattggcctggaggaatggatgagtcaaagagggggtgaaaaatgtccagaatagacctatgagtaatgccctcattaaagggtaggttgagggagaagaacactcagagacagagagagagaatgagcaactagggaggaagaaatgaaaatgatcaagattgtttgaattccagaagttgagtgagattatcaaggaagattgattagttatggggcccaaagttgcaatgaaataaatgagatgaggcaaggagggaagccatttggattcagagattattaaactcatttatgattttgaggtagttgctttagtaagttgtttgacagtttctttgaaatatgtaataggaactcagataaagattaatgaaagaattggtggatagcatatgaggtccaccttggatcagggtgaattaatgtataatacagtcagtctgtgtgggatgaagtttctcagcaatggttaggaacaagggagtaagaacaaagaaaataaaatattgttaggggctttatttatgaatcttccacactttctttttgtagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcaggtagataaataatgatttactctttgaattatatagaatgaaacttttgctgtcctttgtaatagttttcaccacatttaatcatatttaacatacttatgaattcccttaagttgttcaccaaaatgtggtcagttcattagtgaaattatgcatatgtatatgtattaaaatgcagaattggacttaatctatttcataagaatatttagaaaaatgttcccctgggttcaggatagaattctacatttctaggaaacattaatttcatgtttcccaagagaaacatagtttaagtaataaatttggaaaagaaaatatagtttcatctgtaagtggggctataaaaatgtctttgcagctgcaaggataaaattagattaattcatgtcagggttcttcacaaacaaaactgtttcttaaaaataaagcaattgtggtatgttcaaattatacctacagaagttttgttttgactttttgatacctccttaaactggagtatctgtatttggatggagaaatgtgtctgtaaatgccatttctagaaaaaccctttatttgaaaaggtatgtccctcctgcactgtttctattaaaggaagagtctgtcattttcatatacgtgtttacacatgtggtctctatgaattaatgctacatgtcaaattgtagtaaatatttaaacattaacaggtgctgggcctactaatcacacaacactccatgccagcaactaaatagcgaagaccaaagatggcttcttgagtccaccctataccatcaggaatgttgtggagatttaagataaacacagaaaacctgggaaaacttttaagtgtccgacaaaatgctctttagattagcttttaatacaggagtactaaaaaagcctcactgagttctggaagaaaatcgatttgctcttggtgctagggaatttttctttagtagttatgttgcatcacatctttacagtgtaaagtattaaaattttgtattttcattgttttagctaaatgctgtgatgtaaaccttacacaattactaaccatagtggatgtttctatgtatctgagttgctcttataaaacaattagcttgtgcctcaactttaattctactgggtttatgttcttagtttgatgtccaaaagttgcgaatctactgtgacccagaacagaacaaccgggagacagcatgtgagattcctggatttgtaagtaggagggattgtttttttcccagatgttgctttagtactttcaaagcaataaataaaaagcagatactatctgagtattaatttaatatgtagacttaattttattttttaatgttagtggaagtgaagttacatgaagcaaaacatattttgaggttataattgaaatgagattgttatgtgtcattgtgcaagtatgaatgaaagaccacaagggaatgttttcttgttgtgttttgttttgttttgatttggagtctcactcttgtcgcccaggctggagtgcagtggcgcaatctcgggtcactgcaacctccgcgtctgggttcaagaaattctcctgcctcagcctccagagtagctgggattacagatgcccgccaccacacccagctaatgtttgtatttttagtagagacagggtttcaccatgttggccaggctggtctcgaactcctgaccgcaggtgattcgccggcctaagccctctaaagtgctgggattacaagcgtgagccaccacgccctgtcagtaatgtttttccccgtcgtctatgactatgactattccagtgctcaggtaaagcaagatgagacctgctccagaaaaatgtaggatgctttgaatgtcagtgtgtgaaatacattattatacttaatataatcatgtataatataatataacaatataataatgtacattaaacatgtggacagaacaccccaaacagcacagttctgaagagcaagaaataattatttttccttttcactgacactttttctcaaagtgtcagtgaaataatgaatagatacttttcttgttgttgatatttaagtaaaaatttattatagttctagaatataagcagcgtttctatttatttagctattttcattaatgtgttaggaggaaaaagattatgagctaaaatattatagcatcgcatggagtgtgtgtgtgtgtgtgtgtgtgtgtgtgtgtgtgtgtgtaatcaatcccctttcccctgggcaaaatattggtgtattactgctagtggaaatatggtagaatgttgcacaactttttgacaatgtaaattcccagtgatatttgagtcaaccatagtttttaaaatgtgtgtagttatgttgtcatcatcttcttttttcccatcaaatggaataacgtatggatccacatgttctaaaaccttgaagacacagaacagcacatttaaaagatctgtaatcaaacagagttttctagaaaggatttattctgggttttctagataaataactgtttaagcactatagttttagatatttataacttgaaagataaatctcttttaaaagtgttaataagctatggcatttgagaattcattgtgcatacttcatttattgatgtctctgcattgacatatgatgattaccattatccttccatatgatgaagcacagctttagatagctgattttgaattctcccttccactttatgttttaatgtctccttccttactctcagatgtgactttctgtggcctgtttgccttttgcaccttcaatccaaccttcttatttttgaactaatttttattgattggaaagatgattctccttttaaaattgtatgttatttaataaaacacagactattttaggagaagctctcctaaagtgcaagattttaatgcatgcagtttgtgacttcctcagatgtgtttcaacattttttttctggttcttaaatgatttcctaaaatttcaagacagcatataaatctcatctggaggtattttttaatcttgcatggctattatatcaagcagctctggtgttctaattttcttcttctactcaccttaaaaaaatatatcctttctgtattctcctatatgaatggagtagtaacatgtatagataggtgactttttaggataaatgcagggaaatattttggtttttgttggttttcatacttcatatatctctaatctggatggtgaaatatctgtaaattaggctgataatttataaattttatttaaaacattttaaaacacatttgttgtttttctttcagaatggagaggtaggcttggatactattgttccccttaaggtaatatttgtattgtgggaccacttagctcttttccaacaactgtaagtatgtatattagacaaatggaacccatttttatgtaacttcaatgtatttaatatttatagatttttgtgatttggaatttcctattgggttgggttagataaaatttgaaagtgaatgtaagatatttttgccattttacacaaatatataaatgcataaacatacgtgtgcatgtacttatatgtctttccatgcttgttgtctgtttccatttttgtctttatagtgccttaatggtcccagtgatgtaggttcaactccagctccctgtatttgtcctccgggaaaaccaggacttcaaggccccaaagtgggtaacacctaacttgctgtttttgttaaaacacacaaacaagagctgggtaaaccatacaattcctaatcaccattgatcctgttgagaaatttctatctgatttcttatagagtttaaaacctcagttttagtcattttttttctagaaaaacaagtgtattctagcctagattaggataccttttgaacccaaaactgtatctgtcatccacattaaactgagacagtattatttgtttggttgtttttttcccccaaatactgctgctagatcccaagaacaatacttccttacaatctggtaaaaaatgaagaaagggcatttgtgaagacatggtctgaattcttaaatgtctcagttcttaatttgtcaaaataatttttggatggaaaaaatgaagtaagaaatttcaaattgattttattattgtgagtttgatatctagttcaaaaatagagccacatacatttatttcacttaatcatgtacttttggggagaatattcttttagtcatttccatatttctatatatgcgcttgttccagttacatttacatattgatttgtatacaaatgtacatatacatttttatatgatcggagccattgtgtgcgtactactttataaccggttgttttatacataatatgttctgaatatttttctatgcaatttaatattaatgactaaatttttttttttttttgagacggagccttgctctatcgccagctggagtgcagtggcgcaatctgggctcactgcaagctccgcctcccgggttcaagcgatttccctgcctcagcctcccgagtagctaggattacaggcgatcaccactgcgcccggctaattttttgtattttagtagagacggggtttcaccgtgttggcaaggatcgtctcgatctcttgacctcgtgatccgcccgcctccacctcccaaagtgctgggattacaggcgtgagccaccgcgcccagcaaatggctaaatttttaagtaagttgtgcttcttgtggcatcacttagacacagcctaagtaagacactaagaagtgtagtggtttgtccatgatatataaatcttgtttacttaacattatattaaaatatcacctaaataaaataatgtgtaacttgaaagcaagtatgtttccctaagcaaaaagataatgtttatgtgtattgatcacctcttacttgaagcgaccataatcatttttgttaaatatgaatcgtaatgttcatttagactgaattttctgattagcgaattttctgaattttctgctggtccaagataatttaattctttctatcttttatgtatgtttttctattcattttcaggcctaaccattaaaataaagaaagatatggaatttaagaagtatacatttgatctgtcattcaaagtaaatctctgtctggctttaaatttgaatgccatacatgataatcagtgtattattgtgaattatttttagatagcatttagaagagttaattcaaatcatctttaaagtaaccgtctattattttagatgccttgacataaaggagaaatacttataaaattctcctgggagaatataacctggaagacaccttggtgtgtcctaccagtagattcttttaaaaatatatatgttcatataatttattcaccttggaatattatacataaaagtaatttgacctgcatgagatataatgtagaaattagagacccatgctgtctgacctatcaaagcctagagtgcttttctgactctcagtgaggttcaagccacctctaccatctccagggtctccaaggggctgttcacttttgggaggcacctgaagcctctgctgttttctgattgtcatttgtggtccaatagatgtcttgtagtgtcacctatttttactcatgtactttctacacgaaatttttagcacacccattgtcttatctgatgaagcctctaattttttaatatttccaagtttcatgtgtttctcattttcattttcttttcttagtcataatctagccctattgccacctactactctaagtgaaattgcagttttccaccaatcttcaagttggcgtgcctttttgatctgctttccattttcttcagaaaatctggcaggaggacaggaacacacacacactcttccatccatttaggactctttatcctggaagtggttccttacccagaacatggacctgtatgtaaaaaacagaatccctagcaacactctaagttgcacttcttttctggctttgaaagttgatagggttttaattagttcaacagaacctgaattaaaacagatgagacaagtttactttaggttccactgaggcttattggccatttttgttatatgctttctggaaaggtttgcagaagtccatcaaatcgagtgacctgtaaagaacagatctagcttttctattaaccagaaatagagttttaggagatgagtgcggggtcgagactgaaacagaggagaaatttttgtgttgataaatggggaagtgctgattctaagatagttattttttttaaagttctttagatttctggaaaatatgacaacactgttgcaaaaccaggtcaaaatgacaaggtacaccacacttagacttatcattgtcattgtaactctttatcaggcatcaaaaaattatctgtcactagactgtaatctcctggaagaatggcttattttttatccctaatgataaacatagggaatgattaatgaatccgttggaatcatttgtatatgcaagcccttcttttgttcacaataaaggttaataaaaagaaaattctcctttggcactccagtctggcacagtgcttaatagtaatactttttgttaaaggaattgtgaaattgtcaaaacaataagatccacccctccccccatttaacctatatggaacgcgcttctgttctgcgagaaagatccaggtccaccccagcttgcagataacttcctttcaaatgacccgtgcatgcaaataacagcttcttcccctgcttcagtagccagaggaacagttgtggtaacaaactcctacatttgctctaacctgaaacgttagatgtattaggtcagaagtggaaagaagacatttttgtcttttttaggttaggacaattttttaataacttctttgctctgagataccattttactatagccatatctctgttgatagcctttgttacaccctagtaattttgccaattagagattcattgggactatcaaggtaccctctgtctaaacacaaaagcctttggaaaatttcaagggccaagggcatttacatttttatgttaaaatttttcagactgagtagagtcctcctagattcagggagtggtacttgggttctgagggaggaaagaggttgattttcgagaatggaataggtcttaggtcagatgctcttgtggagaccagaggggtagcatgaaggcgtaaggttttttgaaatgaaggcttacaaacgtcgtatttggacttatatgaagtattccaaagttttgccttggatgaacaacttaaaatattagcttatttttataaacataactttttcttactttatttatatttacattacttaagagaccatattcagagatgttttagtttagtccatgacatttccactcctgtcaacaacttaaaaatcctgtggcacaaattcaaacaaacataaatagatactgcttttcagctgagtacatatttttgaaaactcaaaatgtacaattgtttcaactaaattagaataaggtggattgggaatttagtcacagttttataataataagtcatgtgtctaatttaatgtattggggaatttttttttccatattaaattttctagcattcttcagtctggttctgatcagtgtattattgtggacaggaatggtagtgtttaggagcttggaccctggagtggaactggttggatttgaatcccatctctatcactgctgtgtgacctcaggcaacttacctaactttcctggccctcagttttcctacacagaaaatgggaataataaaagtatctgcttcataggattattacgagaattcgctaactcaatatatgcaaatctgttggaccagtgcttagcacataacagtcaataaaggttgagtgtcagcttttattaacagtaataaaattggctttctctccagtcagctaaattaattaggattttactttattcttccagttttataggaacaataccaaacctacctgagtttttgcgaataacttagtgacagcaataatcaaaataaccagtaaaatctaacagcaatagcagaacctacaagaaattattttcttcttggggctgttgaccagtgtcataaagactgttgaccagtctttatgaagtcacattggatttatcttgtgggtaattttttcatttgggaacttaattttgattaactgaaaacattattattaaatatcttttttataattgtatgcagcataaaaagcacaagtcccttttccgtgccaaatttttatttcagcctgatgatgatagagattaaaccctgtcaaatccttttgatatcttaggttttgctgataattgatattctacaaatgagtgggtaaatgacagattgtatttgaagcatatcagacaaaaagtagttattgaatctctacttgatacccagcattgtaccaaaaaaaaaaaaaaaaaaaagtaaggccaggcatggtggcttacacctgtaatcccaacactttgggaggcagaggtggatggatcatgaggtcaggagttcaagaccagcctggccaacatggcgaaaccctgtctctactaaaattataaaaattagctgagcatggtggcgcatgcctgtaatcccagctgcttgggagggtgaggcaggagaatcacttgaacctgcggggtggaggttgtggtgagccaggatcatgctattgcactccagcctgggtgacggagcaagactccgtctcaaaaaaaaaaaaaaaatgtaattcagactttgctacagtctcaatccaagtgataaatgaagactaaccaagggaaaactttgagaaaacactagttatgaataagtgatttaagagctatcatagcatttcagtagaaaaagacaccaggaaaaaatggagtaagaaagttgcagtgaggataattttctcttattaactctagagtggaaaaagaggaaaatttattccagggaaaagaaaaacatggaatttcttgaaaggcagcaagtccaatcagcacatggataaggaaggatggcagggaggctggagattaatgtgcaccttctcaaaacaagagagaaattctaactccctagagacacagaaagttgtttcctaatgcccagccaccactgcaagtccttggattagaattacaaattacatttattcagcgagacattacatggttcagcattattttccccccttggatttacggctcttctttctgtcttttaaaaatgacatttcccttcttctcaagcctttcctcaagctaagcctcttggggggcagctgctaagtgaacagctcatccctgctttattggttccttattagagttcacttagttctttccattttttttcctgttgtttcaggaacaaatttccctagccaggagtctgaagtagtatttccatgaaatttggctctgtaatagtacccttaatcacagggtaggtgactgatttctatgtgaatgatttcttgataaaaaatagtaaagagatcaggctcagtagttcacaactgtaataccaccactttgggaggttgaggagggaggatcacttgagcccaggagttcaagaccagtctgggcaacatatgagaccccacctctacaaaaaatatgaaaattagctgggcatgatggcttgtacctgtaaccccagctacttgggaggctgaggtggaaggatcacttgagcctgggaggttgaagctacagtgagctgtgatcacaccactgcactccagtctgggtgacaaagcaagaccccatctcagaaaaaaaaaaaaaaaaaaaaaagaaaaaaaaaaaagaaaaaacccacgagtgaagaattaatagaaatcatgtgcatctatataggaacaccctgatacttacggcagtgacttcatatttttcagcaggatgctccatttagacttcacgaattcagagatagatacctatgatattttttagtattttttagaattaaattataaaacaccctcacctcacaaaaagtgttgctttcatgttttttttacatggatggtgaccatctgaatggtcagtactggccattgggcaacacgcaagagttccatagagtgtgactgagctcattgccatgtggtattaaacagtgttctttaaagatcttaggtttttgaggataaagttttttttcttcatttaaatattacatgtattcaagaattatgggacttggaatagggttgtttggcctgggccttgctctcatagtaatattatgttaatctgagattgcaagtatagacagtaacacagcaacacacttacaggattgaaagaaatgatagtcatgcagctttaaacttgaattctacatgagagatcacatggtctacagactatttttaaaataaatatgagttaagttgtattataggacatcgatatctatatatgtagaacctatacgatataattaagtctataggctgggtgcagtggctcacctagcagtttggaaggctgaggcagacagatcacttgaagtcaggagttcaagaccagactggcaaacatggtgaaaccccatctctactaaaaatataaaaattagttgaatatggtggcacatgcctgtagtcccagcaactcgagaggctgagacaggagaatctctttaacccagaaggtggaggttgcagtgagccgagatcgcatcactgcactgcagcctgggtgacagagcaagactccatctcaaaaaaaaaaaaaaaaaaaaagtcttatgagtcaaatattgctatcatggagaccatatttgctatgtcactttacagttcgttcagaattctaaaaatgtatcctaccataaatgtgcatattttgcatcagtggaaaatactttacttgctatagttatacttggtgtggtcacataaataaatcattgaaagttcagtataataaaatgcattatttattaagtaagcatttaaaatatggctttttttttttacttttgtttttaacatacaaaaaacctcaaataatggaattggttttgaacttttattgatcctgactgcaccaatgtggctggttgttttgtactcaaaagtttgtttgcttcctgcttagggtgaccctggactgcctgggaaccctggctaccctggacaacctggtcaagatggtaagcctgtgagtactgaaagcttagtcatctccggtatatctgggattacagtgtcaaagtaaaagttttgctgagcaaatctaaacagacaaggaaagctttattcatgactgctgccataggaaggagagactgaactcaactctgttggaacgaaaggagctagggtgtgtgagcactaggacaagttaatggaaaagtagtagaggactttagatgggaggttgatcagtataggcttaagcacattgagttattccacagtttgcaaatgttttcctctgtgatcaggccatctccctttactaattggtgctcatcaaagttaggtacacaccctccctcacagactggaagatagtggggacactatcttccttgatgattacatttcaaaggggtggctctcaggtccttgagaaagacatttctgggttataaaattgacaagtagctttttagagtatttacatttcagaggagcagagaaggaatttacaattttaagtcctctaaagcaaatgctctaaggaaaagggaggtcagggatccacagtcaggaagaaagctgcctaagtttagtcaagttgaagagaatgttaaggccagcttgggaagagagttagtgttctagtcagcttttagttatcttacttcaaaattgcatacatctttgctgcaaagaaaatattgtccagtgagttctcagtatcatgaagggctggttttagaaattctattgtcttttctctgcacatctgtggaagctttcaaattaaaaacacttttaaaggtaatgttattttcctaataatgtatacactgggatatatttatagtctgactaaaaaatacaatatcctctaaggctcaaggaaacttagagatgtaaagggaacataaatcaactttaaagcactttaggcaaatatttacagttaagtcactatcagcatgtttataagagtaaacacgaagaattagcttttggctgggcatggtggctcacgcctataatcccagcaattcacaaggcttaggtgggtggatcacttgagaccagcagtttgagaccagcctggccaacttggtgaaaccccatctctattaaaaaaaagaaatacaaaaattagctgggtgtggtggcacacacctataatcccagctacttaagaggctgaggcacaagaatcacttgaacacgagaggcggaggctgcatgagctgagatcatgccagcctgggtgacagcacaaaagtctgtctcaaaataaaatgaaaaggaattagcttttgaatgtttgaatgtcaaattataattgtcaccaaaatgaagcatttcctgagattttctttatcatgaggcattaattcttaccacgaaagagtgggaatgtttacattgtgaatcaaaattgttcgaggaatgaaagaaccatagatataatgtgaaatcatcaataccttaaccatgaggatgaaagagttgcttaagttcctgagagagatttcctaagaaattaaaaaacaagaaataaaacaaacaaacaaaaaaaaccacaactagccagattttgaagaagtagtaatgtgctgaggctttttatactagggaaatgtgctgcatgggaagaggatggataaacaggtaaacctctctagagaaagattatccaaaaagggaggttaattatccttagcaaactaacacagaaaatgagatattgcatcttctcacttatcactgggagctaaatcatgaaaacatatggacgcatagaggagaacaacacacactggagcttattggaaggtggaaggtgggaggggggagagggtcaggaataataactaatgggtactaggcttaatacctgggtgatgaaattatctgtgcaacaaatccccatgacacaagtttacctatgtaacaaacctgcacatgtacccctgaactcaaaaaagaaaaaagaaagcaaacttggggaaattttttttttcttaaaaagtagggaggctgaaggggtaaacaaaagtggtagccacctggaaatgcagagagctaaggtgatgttgtgtggttgttggggcagcattttttcagctgacacacagggattcagagtgtgagggcaatctacttagggactttgagaaagacagtgatttgatctgttttatgatttagaaggataaatataaatgctatttggagagtagattatatgggggcaagagtagaagaaaggagactatgcaggaggttgtttcatgattgtgagtggtaagagtagtttgtactagggtgatacggtgggagaatggagaagtagtcagattctgggttattcttaatggaaagctgactagaattgctagcaaatttagatataggatatgaaaggaagagaggaatcaaagaagaatcaaaggagtatagcttgagcaactgggtgaattgtggtgccatttactgtactgggcaagactgggggagacagaagttttatagacatgtcttagtccattttctgttgcataacagaatgccacagactaagtaatttataaagaaaggtttatttggctcatgattctgcaggctgggaagtccaagagcatgacactagtatttggcaaggtcttggcagaaattatcacaagatgagagtgtgagtgagaggtagtggagtgggagtgagcaggagaacaagggggtcagtcatcctttttatcaagaattcactcccttggtaactaacccactcccacaataagtgtctccatgacctaactacctcttaaagccccacatattattactgttacaatagtaattaaatctcaatgtgaattttcaagggggcaagcatccaaaccatagcaggggggaattgggactatatttttggacaggttggaggtggccagttgggacttattttcatgcagatgtatgcaaaaccatgagagtggatgagatcacttaggaagtgaatacaaataaatagagaagagaaggtggcaggggactgaccacagggctctcttacaggtgaaaaagagaaagtgggtccagcccaggaatttgggaaggacttatcggtgagatgggaggaaaaccagggaagtgtcatcctattaggtgtgttattgttgtcaagagatccagaagaatgaagcctagactagaccatggatttgctacacaggagtatttgaggaccttgatgagtaggatttcagggagggtagtacaaacaacagattgaaatgaattaagcacagagagggagataagaaaaatggtgaaagtgaatgtagattttttttttttctgagagatataaaaggaagcagagacccagagcagtagaattggggcaatgttttaaagtcagggtttttaaaaaatgggagatattgtagcatgtttttataatgatgaaaatgaggcaaaagaaaaaaatgaaagtttggaagataggggatattttcaggaggaaaatccataggcaggttggagggcgttgattctagttagaaaagtagagcttggcctggatggagagtgtgggcaattaaatctttatatgagacagaagtcaagctgatagcactgaaatagctaagtaggctattttgggggaatttaattgagggaattatcataagacagcttctatttgaatgaaattgaattgaaggaatagactccaaacctaacctctcctcttttgtatttatcttcgacccccattatatgccaacatttgccttataatttcccttataacccattcctttctcacttttacttaagatgtcatatgactttattgcatttcctcactgcaattctttaatctcactgaagatacttccctgaggtcctatgtgagtttcgccctaattacactgggtgagctgagttttataaatgtgagcctccttagcctgcagacccctttcctgggacctactttttctgtgactggcagctgaagtgctgtactgactccagagccaatgcagttcacacactgatgtcatctgctcatgcctaataatgacacagagctcccagatggcactgctaaattatttaggtcttctttttagtgataaaaaaatcctgggtaatgtttggaagtgagtgctgagcaggccttccacaggctatcagcccttggttttctttgtttaaaaaaaaaaatcttcccatgcatgaagcactggaggtgaattattgttagcctgatataatactcatggatattactctatgactctgactaagttataatagaattatttattgcctcatctcatttagtacatgtatgtgttttggtgtctgtgtgtatgattttatatatagataactatggtagtatctgatagtagtctcaaagaaaaacacaactgtggtaggaagaataatggtccctcaaagatgtccacatcctaatctttaagacctgtaaatgtgttactttacatgcaaaaggaactttgcagatatcattaatttaatgatcttgagatgggagattggcctggattatctgggcagccagatataaacacaaaagtctttataaaagggaggcaggagtgtcagagtcagagaaagagagtctgtgatggaagcagagagcacagtgaggtaatcgtgagcccaggaacaatggcagcctctagaagctggaaaagggaagctcccctagagcctccagaaagaatgcagtctggctggtaccttaatttatctaagattcctttcagacttctgaccactgaaactgtaaggtagtgaattggtgttgttttaagctgctgtgtttggggtaatttgttatagcagcagtaggaaactgatacatcagcccaaatcctgtcttcccaaaggtatgactttttcttaaatatccagcccctccccgcagtgtctccctacttcccccatatttcttttcctctgtagggaatgtgacgttgggtggtcaggcaggaagaacaagcaagcctgggagccaaaacagctgagggtcattagtatgtgttcaaggccagcacccagtgggagtgggtaggtgtgggtggggcctctggctggctattggagccatctggaccaaggaaacttggaaggaacaatttgaagggaattctgctttgtttggacttgtttctgtgcaacccccctcaataagctatttgaatctctttcacacattataaccaggccaagccaactgaaactttaaataggaaattattccactctggagaaatactaattttcataattgaaaagtgccttcaaccaaaattaaagagctatttcagatccttccatttctttctcagttctttgtcagttaaataacctctattatcacagtgtctgaatatattattgctttacaattttaacattacaaaagaggtaggggaaatatttatatatcctgccaggtaattcagaggagtacagctactgaaggcattacagagatttatacattgatttgttaaagaaggccatatgtggaaatagcactagcttatgagtttatagaagtttatatttttacagtgctcatttctggtttctgttatcattagttactctttttttgtttgtttgttttgttttgtttgagacagagtcttgctctgtcgtccaggctggagtgcagccgagcgatctcggctcactgcaagctccgcctcctgggttcatgccattctcctgcctcagcctcccgagtagctgggactacaggcacctgccaccacgcccggtcaatttttttttgtatttttagtagagatggggtttcaccatgttagccaggatggtcttgatctcctgacctcgtgatccacccgcctcggcctcccaaagagctgggattacaggcgtgagccaccgcccccggccgagttactctttatgaagtaaagtactttactaaagcaaaagcccaagctgatcattagagagatctggggttgttttactctttgctgagcataggctgctttgcttttatgggcctcagtttctctgtttggaaaatgagaagatggttccagatgaggcctaggttctctctaatctgatattctaggattccatgaagaccatcatattggctaagagagaagtagactaagctgtaaaattctagagatgattttctatgttagtgggctcaggaagtgagttggaaaaactgatagctcactgctaccaatagacaaaagagtggattggtcactgggtcacagttcgtgattcagttccccccactcttgtgtgtgtgtgtgtgtgtgtgtgtgtgtgtgtgtgtgtgtgtgtgtgtgtgatggagtctcgctctgtcgcccaggctggagcgcagtggcgcgctctcggctcactgcaagctccgcctcccaggttcacgccattctcctgcctcagcctctccagtagctgggactacaagcgcccgccaccacgccctgctaattttttgtatttttagtagagatggggtttcaccgtgttagctaggatggtctcgatttcctggcctcgtgatccgcccgcctcgacctcccaaagagtgggattacaggcgtgagccaccgcacccagccagttcccccaactctttaatgtgccactgagtgaactagaggtgcagacaggggcagccttctatggagcattaaacctcatagaaatatgaggtttaatatgaggtcatcacaggtggggaatttcaaagttacgtgactgatgaaaccacaaaaatatgaagtactggttgggggaaggttaataggaaatcaatttggatatggaggaaggagaaggaagggaagatggcatagagttctttagaccattgttatgagtttggctttcagttggagtgagcaatggagtaactggagtaggagaccgatgtgatttaacttatttttaaaagaaattactttggcttctgggttgagagtagattttaggaagatgagcgcaaacacagaaggagaagtcaggaggctcttgtaacaatccaggggtgagaggatggcagctagggtcagagtgatagtggtgaggtaaagagaactgcttgcatttgggggatattttgaagttagagctaacaggacttgctgatctattggatatgggtttgagagaaagagagaagtcaaaggagactatggattcatgggagaatggaggagatagaactgggtgaggaaaatcaggagtgtggttttggcaatgtttaaatttatatgttagtcattcaagtagaaattttaggtaggcagatggatatagaagtctgacatttaggatgagttctcttcttgtgaagtatcttttcttgtcctttgcctattttctataggagtgagggtatatttcatatgggccaataagatcttatgcattaagagaattaattctttgctatatatggtgtaaatgtttcttctgactactaatctggtttataattttgtttttaatttttagaaatgtaaaatttccccagaatgtaatgttttctttttattagttccagtgttatttttctttagcattagctactcgtgtatgttaatttatcttattatgatctttaatgcctattaagtcttgatttcactgggaatttatttttgcatttgaggtaacatgaagatccaaaaagatttggagaacttagaaaatgagctatttacagtgaaattcaactggaataaatgtatgggtcttacttgtctttgagatgttatttaagctgatgaaaaagggattaatgtatgtaatagggctgcctaaaaggctgatgcaattttttggcatagtttgtaaatgcataacatctgtattgagagagatgacagccctgcttctggagtgttagatttgctttagaactctatacttgaggcacacgaaggaactggaattcattcagaagtgtataacttggagtgggccagaactcagaagacagcctgtgagggaagattcactgaacttcaggtataatccaaacaagagatgctactttgaaatattcaagaatggtgatagagtataagaggacggggtggacaagcagcccttaggcttgcagagtacacttgttgagggtgagtaattaaaaaaacaagtaaggcctatgagataagcttatttattatgctttcctttttccagacccttaactgaacatggtgccagttgtggactcaacagtttaagagctgttgggaatttggggctgaatgccatgaagattaaagaattggaaaatgggatacagctgattaaaggccaaagaaatggctattatttagcttggagaagagaattacaagagatggcttacttacaaagtatatgaaatacattctagatagaacagtgtctacctgaactctcacctcagtttgaactccttggcaaatagatttatttatttattttatgtgtttctctctctctctctctctctctctctctctgtctcttgtctcactaataagctaaaatatgaaccatttactacaaatgaactatcctacccttgggcagtttattgcttttttagttatttaaaactatgcctttataaggctttcctagagaaagctttaaccttggtgaaaaggcatcgctgtatgaaatgtggctgcctaagaggctgatataatttttagcatagttagtagatatatgacaactgtattgaaagaaatgacagtcctgcctcttggagtgttggatttggtttaggactccacacttgagaggcatgcaggaactggaattcattcagaagagcataactgggagcatttaaaactcagaagacagcctatgagggagggtttactgaatttgcgtataatccaaacaagagatactattttcagatattcaagaatgatgctagagaaaaagaggacagggaggaaaactagctctcaggcttgcggagtatcttggcaggggttgaatggttagtaaaacaagtaggacccatgagatgagcctgaccagctaattcatttttcttcaacattctccttctgtgaaagtcgtatgtagattattccatgtttatctcacatgtcacttaaatagattacttagatatatattataggtagtatatataataatgtgtgtagacatgtatgtatatatatacacaccaatgttattggtatattaaattcttcaaagaattggtcactgacgcatctaacatctatgattttaaagataagtttgtgcatgtgaatgtaggcctgtttctactattagagttctcggttggtgataactggttgaactcagtaattattgatttgtttgcttatttattctgttcctcactcagtcatatacctatatttgctgggtgtttactgtattcctggcactcttctaggctaaggatatatagcaatgaacaaaacagaaaaaaaaaaagcaaaaaacaaccccccaaccttgtcattttgaagctcacattctactggggagaaataggtaataaatgcacacacacaacatcagatggtgttaagtactatggaaaaaatgtagcaggacagcaagagaggaaatgaggttagctattgatcgcctctctttgagtatgaaaagcacaattactagagatttatgttgggaagtaagatttactaaagatggtttaagttaccttagaaagttgtacattctccttttgaaataagcttagtataagtttaagtgtaacctaattcagggaataaggcagtttaccaaagtttaattaaattctgtgaatttaaggacctagttctatctgcagagattatttgtcaaaggtaggcaatgtttttcatttatgtgcttagctcaagggaaatataggaaactggatgatgttgctctatatttatctatccactgtttacctttcctatatgagagaggattagatttaggctaaatctcatttatagttaatgtagttttctttaatttgaagtagaaatgtttttgagtcctttgtaagacccacgagctgtgcagataacctcgtctaccattccaatatgtttttcagcttgcttctgcttattctctctcttttggctttgtggatatggtatatcttttcctgatgcatggcatattggaggaattcctcttaggcattgtgctttctttagtattcccttgtctcttagaaaaactcccaactgcttgcccttcacctcccatagcagtgtagttctttcatagcacttagctcaggtgtaattttacatatattaatggaacttattaatgaagtaatctaagcaatcagtaaaagcatataaaccacttgactaatagttgggttaagtagcaaactagtttctatattagttatacatagaatgacagagatttattaattttcttgaaatttaattgcatagagctataaagcctgccaacaacaactagaagattccacagtggacattaaaaatacacacttggttttggttacctagttacgttggctgtgtacccaagactatctgttggaattttggaaatctttgaagaaaattatttaatggaataaactttaaatcacattcttacatttttaaaaggagggtgacatccaaaattatttctttggaatttattcttatttttaagtttagagtatttcaaggaaactaatatctctaccctcctcactactttgcaaaaatgtgtatatttagattggcagaatattttatgacatgattagaattgagcacagaatagttggtgacccttgcacatttggggattttatttccttaatttccatttcaatgctatacatatttcctgaagctttgtaactatgaatcatggaggaaaattaaattgattctgtattcttttcttcaaccctacaatttggcagtgagaatatttttttccctaaaaaaaaaaaatgactcatttataaagaagttttctgtgaacatggaaaagacttaaatactgtcagaaatcttgcagatgggggtagggtggatatttggacctgctaataaatgcaaaatggcaaaattcatgttgaacagtattaaccactcaaagatcataggaaagttacagttctaaaatgagacatgaaacgtgttctgaaaaataagaactcaataaggtatataaaaagcttattttttcctgttttaaggcattttcctttctttaaggttgaccctgctatgagtcaaccaatgttttatttctttttcctcttggaaattgttctgtgttgtaatattcccctttttaacctttattttcctggtttttagtccaaaatttgtttttctgaatttcattctatttcttctggtgttttgccctaggattcccccagcttggatgttgtttggttttctttattttgttactaaccatgtttcctgtagcttctaaaacagcatttgaatttctttctgcaattagtactttaagaatgcatctaattgtaaccttaaaaatatacatatcacaacattctcaaattgtgagaagcacttattattcctatattgtaattcctccaaagatataacaaagagagccattacaaaatacactgaggccatgtttgcatgtttagcattagatctgtataatgttggaaaagagttaaatcataaagatgatgactggacctgccattcccaatgtactaatggtggctgataaggctgtggagtaacattctgcagaagtattcttgtggtcttgtacaatagtcattgagtctgaagaaaagaaagaaacgcacatttattgagttcctaacacctgccagaatcttcacctgtgactccatttgtttcttttcaaaagtgaagtggataataataacagtttatggtaagaaactaagtctttgctaggcaaagtgacttagccaaaatctcatagaaagtaaaaggaagggcaaacattcagtgcaagttcttttccaatttcaaattcatcgtctttccacttaactgtgttgcctcccagggtttggggattgatgactctgcctgaggtcacattatgagtcagaggtaagctgggaacacagttagggcatctccaagttgttttaatctgttaaaatgaaatgcgtcctctataacaaataccacatcaacttcttcgaagaggagagacagcacagcagcatttgatcttttatgaaagattaattttcctaaaaaagtagtaaggcagatatgacatttggcttaacttttgaaaaactgtaaaagaaaaataattcattaaatgtgaactttgcagatgatcaaccattttgatcaatagccaatttccatggtaactttcttttgaggaattttatgaacattcctttcctctgggcactcagaattctaaataatttaaaaatagtcttgcaaaatggatttctttgaatcagttgagtcaatctacaatgatcagatctgacccgccataaagcactttctgatagagaatgttcccactggctctatcaacttactagctatgtaactttgggcaagttactcaacttctgtgccttaatttcctcatctgaaaaaaagataatttagaacctacattaaagagtagttgtaaggaggaaagtgaattctatatttgtacattgctagcagtgacagagctgagagtgaattctaggcctatctgattccaaagtggttgagggaaggagattcagtgataactagagtagtagacatacagggctgagcaaattccatgtagattgaatttcttcttacttttgagtaatcctgagaacaggaaacatgagattactaaacgtttccattttctacagaaaggtgcacaaacataacatgattcattggagaaggagatttttttttacacgttcatgtatagagttgatgactttaaattattccaatgttctatcaacagaagtgtgccaaagaatgtgttcaatgccaaaaatacagaaatgaattaaacctggtctttgatctcaagggggctcataatccagtgacggagagagtgctagtctagcgaacagatgatgggttggaaaaatgcacgttgttttgtctggagtatggagaggttgataatcagactcattgtttcctggtgaagtgcaatggttaaggattgggcaaagacactcaagaaaaaagtttgaatctgagaagtcatggagaaatcataacaatatattctgtgaagaactgaatagagtatgaaggaaaggatgatggttggtgataaaaaattgtatagtcggccgggtgcagtggctcacgcctgtaatcctagcactttgggaggccgaggagggtggatcatgaggtcaggatattgagaccatcctggctaacatggtgaaaccccatctctactaaaaatacaaaaaattagctgggtgtggtggtggacgcctgtagtcccaactacaagggaggctgaggcaggagaatggcgtgaacccaggaggcagagcttgtagtgagccgagattgcaccactgcactccagtctgagtgacagagtgagactctgtctcaaaaaaaaaaaaaaaaaaagaaaaattgtatagtcattgtcattcattctataagtaactgagaaggcaatttacacaatagaaaatgtaaatgcatgtaaaaggagaaaaacaataagactgatctttcagagacaactcattactagaggtagcaaagaatattagaaaggatacttgaaaatgtgaacagaaaaacagggaattgtgatgtctctaaaattacagttaaaaacatattgacagatgagtggatgaatatgaagaccagtgcagacacccatgaatagccacatagaaatgaagcttttagatttatgaatgaagatgtaattggaaacattaatgagatctgtgttaacatagttgacaatgaagactggtacccaaacagtaagatctaagaaaaatggagtctgaataaagaatgtgagaaagatggaacttgatagtggttattatgtttgtaggtgccaggtggtccattaacctgacaatcagccctaagaaacctagataaatgtttagagcctacaagttaatttggagactttagctgccatgtgctaaaccaacaataaatagttcaactctgtctaaaaaaattgtgctattttatcaaagttccagtttttgaggagggatgtctaagaagcagtggggatgagagtgacttctctcatccccctcccctaagcaaacagcccagctttgggggaccatggaggatatgtcataaccaccttcttacatttaacatcagcagctttctaaaatgagtaatttaaagattgaagaataatattaattaaagattaatttattctagggactaactcagatggccattaattaggtggtttacaaatacacatttgtttaatcctccaatctcttgaagtgtttctctcttggatatgttgaatgtatttctgataaatccagtacatttcttaagaaactgtgaacattaactctcctcttaatttaagattttctaaatatttttattaatttacaaatatttagggccctatatactttttaaaggatttcataaagatcaaagggtatgaattccttattaagcatttaacactttattattttggatttgtctctaagtgaagttttaggcatgagaaacttgagataagagtgaattctgaaacgaagaacttctcttggtaaatatgatgaaatattattttttttctttttaaatttttctttagggatatcagggaattgcagggacaccaggtgttccaggatctccaggaatacaagtatgtgatccacttatatacattttataaattttatttttagtgaactaaaaccgataattaacaaaattttattttctggttaatttagggagctcgaggactaccaggttacaaaggagaaccagggcgagatggtgacaaggtaaacacacacaaaaatgcaatcaatggtgttagtccctcaaagataaaggatgttagctgtgatggtttccattcaatagtctgcgtcttggtgaattctaagatttgtgggctcagaaatttgtcagtggctattagacaataaagcttatagaaggctttatcactacataaaagaagttatcattgaccactatcaaatgaaacagactttggcattgccctatgccatgttctctccctgtggttaagctccacagggagttaccttcttagaggggagtgggttatgtgaaaggaaagtgttaccatgttaacctcagatagtccaatacccaagggaccatctccacaattggtatctatctggcacgtggcctattggctcagccacattttttagattccacatataagtgagatgatatggtatttgtctttttgtccctgacttatttcgcttaacaaaaatgtcttccaggttcattcatgttgttgaaaatgacaggatttccttcttttttatagctgaatagtattccattatgtatatataccacaatttctttatccattcatccattgacagaacttaggtttaggccatgtcctggctactgtgaatagtgctgcaataaaatgggagtgcaaatatctccccaacatactgatttcattctttagttgagttttacacactaaacataaaaagggggatttcatttgtacatcttaaaataattgaactaaatttttgtgggaataaatgttccttactttaaaataaaagaataactataattctactagtggcatcttatgctgactgctttattgttttgggtcattatgttgtcttttaaatataggtctgtgaattttacaatgtcatacattttactggataagataaataagatgtatatttatgcaaggtctctgttttcagaccagttgtggattttattcagagttgattgttttctgaagttcattgttggggttaaactctgatttgacctagtcattgtgggtctaaaatcaccatgtactaccttccaagtttccgcttcacattccatgtggcttctgagagttctttgcccagagctaaaataatttagtaagttaattgaaggtttttccttgattattcctttataacatggttacttgatttttggaaatgaagggttaaagaacatacccctgagatgactttgacttgtggcagtgcaggatacttttccaggtatcacgcagtcgcctttggaagattgttccacacaatactgttccccattaggacattttcccagaataatttccattttgtggattttctccaaagactcctacagtaggaatttccacttaagataattgaaattagatgtgctttctttctgactttaacatttgttcttcacatatcacacaatagaatatacatagattttgcagggtgttttttcctgaatttgcaaaatcaaaaggaatacttactcagcaaatagtcttcagttggtaactaattttattacatgctttaaagctattctttgaaatctaaaaaatactttaaatgctttaaaatacttcctcaatattaaaaaactaatatatttaaattgtatggagaactaatttttgttaaaacttacattaggtgatgctggttaattgatatgtatttatgaattttcaaattgagtttgaaacttttccatggcaaattcaattttacagatgtaggaagtatgagtaatttattttttaacctatccagactctgtacaaactcattacttgacttttctgggcttaagaaataaaatgtcataattatatctagggtattattggaagaattatagattttattttctttgttagtacattcaacttttaagtggtcccttcaaagcctcactttcccattgtcctcagcatccagaccggagcaccatgtgatgggtaagacttccctacctgaataaagttccttacctctgggcctccaacatcgaaaaactaagtggttttacagtgatttctgttatagagtcagtcataaccaaggaactccaatatatattttgagagaacaggggtaaaaaagctaaaaaatgttagagaatacatgttaaaacagtatgttagtggtattacttctttcagtgttcctgaagaccaaacaaaaattaccaaaacagggagagagtctacccatgtgattttctgataacaccatgcccaaacacttgtgtgtgtgtgtgtgtatgtgcacaagtgtgtgtgcacaagtgtgcatgtgtgtgagatttgggggcttaaagcagttacagattatagattataggcttagttctgaatttagactgcttacctcccaaatcacacttgttaatctctttaaacctggtttttatcatctggaaagtggaagccatagtattacttactgcctaggctttttgtgaagattaaatgaggacatgcatgtggttggcctaaattaaatgctataaattggtgatgatagtgatgatgatcatgatttgttattgggccaccattctgctgattacttaaggcaaaatttttggaaatatctttgagtgatcctttatccttcctctctctgttgaagtgctgcatctgaaacaatcagacagaaattccctaaatgtcttcccactatgtctaccctcctacccgtatatgtacctatattctgcctttcctcctcttattatgggcgaagtgtccatgtggagtccacaggcctcctcttgcagtctggatcccatctttttccattactttgtgtattaactagcccttctcttctgtgtcaatagtcattttcttttctagttaaattttcccaatagcctaaaggatgatccatttgaaaccacccaaacctccccacttcctctaccacatatcttcctttagctaccaggccatttccctgtttctcattgtagtacaagtgctccaaaaggtttgcctttatttcctgcacattttcactgccatttctctctctgacccactctagtaggacttccatcccaaccttctgctgcatatttagatcaccagtcttccatctttgaaatccagtagtcagtatttttcaattatttcttcttgtcttgctgtatgtctctacagtgtttgacactgttgactattccctccttcttgggacaatttcttctcttggcttctgggataccacatgctcctagatttctccttgctgccactagttaccttttcatgttttctcgttggctctttctcttcctcctccacacattctctaaatgttggggtgcctccaggattcagccctgtcctcttccccttcctcattaagagattttattattgtaatattaagaagtataaacatatatggatataaatgtatatataaaatatatatgcatatattttataattatagtaataattattgatatgattactactatagtaaataataagaatattaaatacagacatacacatatgcacaacctcttttctaaaaaatattttgcttcctctgaatctggagaaacttggagttgttacaatcgggttttcagaaaacaaatttctctactttttatggaagtggtgttactattaggttggtgcaaaagtaattgtgatttttgacattactttcaatggcaaaaactgcaatttcctttaaaaaaatcctttcctcagaggattttctccccaaacagcactagctttgccctccctaaatattctctgatattaggcattgttgagtgtcctttctgtacacatggtgctgacttatgtgtgctcaggttttaactaattctgtggctgcttttgcaatctggattatctcctgatctttcaaccttttttcttttaaaactataatatagtggatttaacatcttagtttattatgaagaaccattaattccatgtcttgccttatttattggatgttattcctcttctgtcctggttttctcttttttctgttggtattataaggaaacttaaaacttttattgaattttttagaatgctttatattttgttggttctaaacttgatttttatcttctctttggatgtcttctgttgtatggtcgttgagaagctactgcagagactcagtagtagaagtttagaaatctatttcttttgtaggcatgagtagttcaatggtaatcccaaaccccaaatggaatccccatcactgtgttagagagaggaattattttagtggattaaaatagtttcccataggtcattattgcctgagcttgtgtaagacttaggatttgtgtttttgttgttgtttttgcttttattttttctgagaggaaaagaagccacggatctgtacaaaactttatgtattgggtgctttcacggtttttactgtggtgtgtacccttttctattttattcctgatatgttttgcatcaattttgtccatatgcattcccctttacattaaatcctcacaaaaagtcctgtgggattagtacagtaagtcatactgtgctcattttagattaattgtgaagtaaattatcctcattttacattttggagaactgaaaaatgaagagcttaagtcatttgtgtcaagttactcaaggatctagggggttgaaataaaataccttgatcccaatctggctttctttttcctgcatttttctgctttggccagagtagtttttcactgtgtgacttgtgcttcttttagtctactgcctgcactgtgagaagaatccctgaatgcctgtcaagagccaagaagataggcaggggagggagaagatgaatgagtacccacggtcgtgctgactgggccataggagtgttcatggtctacatttctctctagggaagagggatagttcattgtagatcataggtcatcaaacctttaaattgcaaaatgtattgcagtaaaagacttttggacatgtagactcatatataaaaattatatatctgtgctactgagcaaagtattatgtgaatttgaaacacacacacaaagacattttttaaaatgaattttaaaaatagtagttctcatgttcttttactagccccaaaaataatcttgacctgactgaagactatgactctagatcggcttaaaagatggacaggctcatcaaagttatattcatcagccatgaaaggtttggaaagcagcctgtgggaagtggaattatcttactagtttggattctctttgactttaatcacttgtaaactctgataggaccaagagtgtgactcccccaaatatttgttttattgaaattttctttgagcacccaagagtgttgactgtgttttgggaaatgaaaacattctgtatattcagcaaattattattaatcacaagcaagacaataggtaggctagagtagcttatgctacagtaacaagcaaacccacatgcttgtggcttaaatcaaaggtttattgctcctcaaactacatatttatcagcagcagtgaggagcttcccattgtcttcacagggagactcagattaacagatatttcaccatctagatcatgactaattatggtggcaggtgcagagagaatcaaacattggcttttaaatcactaccattcatgtttaattaactagagcaaattgtgcaaaccacatgtattttaacagattaggtaagtatgatttcccatatgccagagagtggagaggaatctggatatgagtaaatagtagttgtaccgagaaaaaaataggaatgagttaaggatgaattgtttcctcaaagaggttggagtctgataaaggacataacacaaagtaactgtatttcaagatagtcaatgttaagtgccaaagaagaaagtcaaataaaattctctaggagtttaaaggaaagttaaaaattggaaaggcttcatgaaagaaaatataaagaaaaggttaatcatagctatacgatgtagggactgtttttatcaaatttaagaaatctcaaagattgccttggttctttatttattattattatttaggcattaccaataagactgtaagaaacatctttgaatatatttctcagtagtttttcatgagtttatcaacaggaaaagtcctcggaagtgaaattgattattggatcaaagggttaacttcatagttaaactttgatttaaattgcttattgagttcccagaaagttgattctctttcaacaagtatatgagaatatctttcctcacattcttatcagcactgttttttttttaattctaattttcacctgtatagtttagaaatgatactggtttgattttcattgctttattagtgagttgggtaaggtatcttgacatgcgatttgggggcattgtgttacttctctgtaatttgccggttttctcatatcttttattttcctactgggctgtgatccttttaaagattgatttttatatgcatttcataagttgttgtttgtatgtgtgaaaatattttttctgggttgtattatgtgtttttacttggtttttggaattttagccatagagaaaattttcattttcatgtaaaatagttttttcttctttttttctcctatctttgtatataaatagaaaggtttcacattctagcatgttgattataattactgatgattttatttttgtaattttattattttattttttacctttaatttttggtttttggagtaaagttaggtaagcatttgtattagtgtgtttccactaatacaataaagacatacctgagactgggcaatttacaaaagaaagaggtttaatggacttaaagttccatgtgactggggaggcctcacaatcatgggagggggcctcacaatcatggtggaaggcaaggaggagcaagtcatgtcttacatggatggcagcaggcaaagagaaagagcttgtgcagggaaactcccatttttaaaacgatcagatctcacgagacttattcactatcatgtgaacagcacaggaaagacccaccccatgattcaattgcctcccgttgggttcctcccacaagtgggaattatggaagttacaattcaatttgagatttgggtggggacatagccaaaccgtatcattccactcctgttccctcccaaatcttatgtcttcacatttcaaaaccaatcatgccttcccaacagtaccccaaagtcttaaatcatttcagcattaacttgaaagtccatagtccaaagtctcatttgagacaaggcaagtcctttccacttatgagccagtaaaatcaaaagcaacttaattatttcctagataaaataggggtacaggcattggataaatactcccattccgaatgggagaaattgaccaaaacgaagggggtaaaggccctatgcaagtctgaaatccagcggtgcagtcaaatcttaaagctccaaaatgctctccttttactccatgtcttacatccaggtcatgctgatgcaagaagggggttcccatggtcttgggcagctctgcttctgtagctttgcagggtacagcctccctctcgattgctttcacagtctggcattgagtgtctgtggtttttccaggtgcatggtgcaagctatcggtagatataccattctggggtttggaggactgtgaccttcttctcacagctctgctaggcagtaccccagtagggactctgggggctccaaccccacatttcccttcctcactgcccaagcagaggttttccaccaggaccctgcccctgcagcaaatttctgcctgggcatccaggcatttccatacatcctctgaagtctaggtggaggttcccaaacctcagttcttgacttctgtgcatctgcagtgtcaacaccacatggaagctgccaaggcttggggcctgcaccctctgaagcaatggctcatgctgtaccttggtcccttttagccatggctggagtggctagaacgtagggtaccaagtccctaggctgcacagagcaagggggccctggctctggcccatgaaaacattttttcctcataggcctccaggcctgtgatgggaggggctgccatgaagacctctgacatgccctgaagacatttttgccattttgttggagattaacattcagctgcttgttacttatgcaaattcctgcagccggcttaaatttctccgcagaaaatgggattttcttttctatcacattatcaggctgcaaattttccaaattttatactctacttcatttataaaattgaatgcctttaacagcacccaagttacctcttgaatgccttgctccttagaaatttcttctgccagatactctaaataatctcaaagttctacaaatctttagggcaggggaaaaatgccaccagtctctttactaaaacataacaagagttgcttttactccagttcccaacaagtttctcatctccatctgagatcacctgaacctgggtttcattgtccatgtcattgtcagcattttggtcaaagccattcaacaagtctctggggagttcaaaactttctcacatttttctgtgttcttctgagccctccaaactgttccaacctctgccggttacccagttccaaagttgcttccacatttttggttatcttttcagcagcaccctactctactggtaccaattaatggattagttcattttcacactgctgataaagacatagctgagactgggcaatttacaaaagaaagaggtttaatggactgacagtttcatgtggctggggaggcctcacaatcatggtggagggcaaggaggagcaagtcaagtcttacatgaatggcagcaggaaaacagccagcttgtggagggaaactcgcatttttaaaaccatcagatcttatgagacatattcactatcatgagagcagcacgtgaaagacccgcccctatgattcaattacctcccactgggttcctcccatgacaagtgggaattgtgggaggtacaattcaaaatgagatttgggtggggacacagccaaaccataccagcattcttattttatgaaatcatttttctaaataaagagccagttgccatagtattcatggaataccacttttttctccatttatttccattaaatttccactttcatttgggcctggtgttttggctttacattctgtttcattgacctgtctacatcttctccattgcagaattgttttaattattgtcacttcatgatctgacttaatattggcagggctaatccttcctcattattctttataatcaaaatttcctggctacttttgaatacttatttttccagataaagctcagtatctttccttcaattttttagaaattgctattcacatttcagttaggatccctttgcacatatggattagttttagaagcattgacatctctccaattgctattcaagattatggcttatttttctttttacttcaatcttgaattttttgatattagtcccaaacattatccaattttattttaacctaaaaattttttatctcttttgtttttattataaatggagccctttaaaaatatattttatattggttatattatatatataaaaagctatttattttttatatttttaaagcaccaagtgaattcatttctcttactcatttaggttattagatctattgacatattagaggtataatcttaaaaataatttttcttccttttatttttagccttatttctatatttgtctaaatttgttggtagtccagaaaaagtattaaaaatagtgcaaatacagggtaactttgttttcatgttaagtctccaacaggcagagtctcttttagttcaggttggtggttcctgtggtattatataataactctctcaacagcatatagtatatgtatacgtgtgtgtgtgtatttgcaattttatgtttttgacttttgattccagccaatagcagcatccacaatcttgtttcaatcacatctccttctctacacttaataatgggtgacctaaattaatcaggcatccactacactctttgtttacttttcatgcgtcacactgtccagcttgacaggatttattgaacctccccttaatggactcagagatttttaaggatggtgtttatagccacatctttgatttcatccctcccagaggctgagttttactggacttttattttttaaaagcattcaccattacattagagatgagaaaaacaattgtatctcccaatcccagtgtttttacacttggtctatttcttttaattactacttgcaacctggccaattattttgtgagcgcatatattttttaaaatagtaccttgtcaaatacttccaataacagtcaattcataatatatatttacattctgttttctcagttctttacctctagctataagttcatttgatacattatttgcctttgcaagttattacaagcaaggctttttatcaattatttcaccacaattttacataagacaccattttttcaaccttcagtaattgtttttcattgctcactacctgtccccaaagccaatgacatatatacattttaatattgttgttttggcagcctcctatttctaatattccaactgtactaattaacttaggctaagctgcattatagtaacaaatgacccagtggctcagaggccaacacaggagccatttatcttttatgttacatgcccatcctggataggctttggcccaactttatctcttctttgctatccattgctgttaaaccttataaataacttgattgagtataatgtgtttgagccatacttttttgtgttccatattttgtacatactgtttcaatattccccaacagttttgctgacaacttgttgctgctcgctctctccttctttctctctctctcacactgatttatgttaacatgaatactacacctttttattatacttaaaaatcttccttcggcacataagagtagctttgtccagacctcgtatttttttctgtcccaacatgagtggatgttcctagtcttcctacttcatctgagatctgtttgccatctccaataaaagaaagtttggatattatgtcttttataacctatagccagagaatggaagtcatagcttggactttgttcagccttaatagggaatctcagcttacctctttcttctatagttttattaaacattcattacccagctaaattccatcttattaatagtatatcttagtctagctctacctttaactggttatctcaatgtagtgttttctaaagagtcaactcagattgttttcttaactccagtcctctttctctctctcagaactctgcccattcctgctccaagcaaaagggaaatatatatatataatatacatgtatataatttgaaattttaatttcaaattttaaattataaatatgtaatttgaaattttatatatatatatatatatatatatatatatatatatatatatataaaaccctgtcatgaatgctctcagggaggcagaacccctgctatgccctgcttcagctgtgttcctcagtgttgagtgaggaatcttcagaacctgaagaacacattccaccacaccattgagcttaaccaaaaacaagcaaacaaaaaacacattctggatcttagatataaaatttctgaatgacacacacaaacacacacacacacactttgaatatatatattcaaaaggtagtttgggttaggttcttgtattaggagttcatatggtaggggaaagaatacccagttttcttgtgtcatttggtcttcccctaaaatttattttttcttttgtcctctgtttgggtaaattgttgaatttggggaataattcgttctagggtgttataggcttttattgggtcttttctctccctacctatctttctgtctgtctgtctctctctctctctctctctctcacacacacacacacacacacacacgcacgcacgtgacagaggaagcaacacacacacacgcacgcacgtgacagaggaagcaattattcttgagaaagacatttagtataagctaaaaaatatgattccttttagactggaaacatagttattctttgtatttgttaggtgggtggcaaagatctataacaaatagaccaaatgcagtagtttaaatgagaaagaagtttatttttctcatataattggttgtctacaaagtcattcaggcacttgtgtttttccctcttgttgctctagtctctctgagtgttgctgtcacttataaagtcaaggttatatcaccagttactgtattatctgcattctaggatactgggaagctgaatcctaaaattagaagagatctgatttatataacagaggccccccttttgccagtacacacacacacttatatgtacacatgcacacatatgcacagatactccacaggttccggaaatgataatatcaatgtttctaaagtggaggtgaaagcagagctaaaaatgcaaacatgactgaatgtccatttaagaagagttaaatcccactatcccttcctcaactctgtgtagccaagtgaatctgtcctccaccgtagcagaaacacgaaagtttattttctggagaagagaaagctgagggtctctagcctggggagaggagggagagttgtactaaaattaaaacaataggagtaggctgagcatggtggctcatgcctgtaatcctagcactttgggaggccgaggcaggtagatcacctgaggtcaggagtttgagaccaccatggccaacagggtgaaaccctgtctctactaaaaatacaaaaattagccaggcatggtggtgggtacctgtaatcccggctactcaggaggctgaggcaggagaatcacctgagcctggggggcagaggttgcagtgagccgcgatcacaccacttcactccagcctgggcgaaagagcgaaactccatctcaaaaaacaaaacagaacaaaaacaatgggaattggtgatagtttactcatgtggcgacctccttctcctctttctctacgtggcctccagaatgcggtcagccagtcctataaactagagacatagaagatccttgtatgggaagtctactgacatctagaacagcatccaatgaaatggcacagccagaccacattacagtgaagttcagagtcattgaactctacccacggagagattctcctatcaccttccatatgagctgacaataaagaatcaccaaatatcacaggaacgttaaagatcaacaaacagaaagtcttggaagaaactgatacaagacagggagaggaagacttgaaaaaaccctgtcatgaatgctttcagggaggcagaacccctgctacaccctgcttcagctgtgttcctcagtgttgagtgaggagtcttcagaacctgaagaacacattccatcacaccattgagcttaaccaaaaacaagcaaacaaaaaacacattctggatcttagattctgacagtccctgaacaatctaccccaatcccatttccagggtttgccgtcccctttcctgcctttgtcttcctaaagaccttccagcacaattgtgtgtccacccctatgcttacaggtggctgagaggagcctgtttatgtgacgtatggatggggatggagcttggaagtgtagtctgggatgtccacgtttatgggcatgagttctctatagatgaaaaggcctatagagtacctagcataatggatgattatagaccacaccagtgtataatagcataatacttcaagacactggaaacaagaggaagatctgcaagcttctttgggaaaaaactgcaccagtcctaccatccctaccctcccactccaggctccaaaaaacacacaagaaacaaaaggctacatacaaatgttcaggaatcagacttcacacgtcttattagtgacattgaactcaagaactgagtgaagcagagccttcaaacgtctgatttaaaaattctaaattatcatcaattatataaatgaatagaataaggacattttcagagatttaaggtatcagaaagtaatctcccgtgtattccttctcaggaagccattggatattatattcccctaaacaagataatgaactcagaaataaagaacatcaaattcatactgaaatgagacaggtctaggagatatttattaaagaaaaattttcaatgcaaatgaatacaatcagaagtgattttgacagttggaaagattttggagttcaatataacaatcagtttataggaaactaaacgattaaaatggccatatttgactccaggaaagataaacatttgggcaagaaaaggcaagtaatgagaatatatttatagcttatctgcaagtcttaacaaaataaaccctgactactgatttaaccaaagctgtaattgaggattaaggggatttttgtctgttagaagtggagatggggaggaggtgttggatgctatgagagattaatcctctgcattcatggtgggaagtcagtagataatgaagaaaatggaaaatgtagctataaccaatggtttggtgatttgaactcaaagagatgtggagctttggaataaaaagagttgcctttggagggttctataagccttgaataaatatatcactctttaaatcatatgaatcaataacttttataaaaattatatcagtcacagatgatataatctttaatatgtctaccagacaagctaggagtataattgattgcttgtgtgtaatcttaatttgtctagataaaagtgaatctgacccaaattttgccatgaaagtcattggttctttatttactatgtctccacaattaagattttgaagctaaagcagtatcatccaacatatcccactgaactaagtactaaacttatatctactaaataacaagttgttatgacttttcttcgtcttttctcttttggagaaaacttatggccttcatgttcatagacacatatgaacagataccttctatgagtaattagtaagataagcaatttttaaaaattccacagaatcctagtctgtgtttagactttatgcttagggcctttcattactgagctggattggacctcagaggttaactgtttcctgagtgtgttgggattagatcatttcaattaattcatgtgtcttgcccctgtaaaagcctaagactttttcagaataggtggtggctaactaagggtggagtcaggattgctagtgagattttcttagctccaaaatacttatcttctctgattataaatgaaaccctgaaaagtagggataatttttcatagagataattgaatgctgatatgaaattaactgtttgcagatagatttgaagtggattttgacaagggtgaggttgaagaatagatgatgatattgtttaggctggaatggtttttctttgtaattaatttcagttttattttcagggtgatcgtggacttcctggttttcctgggcttcatggcatgccaggatcaaaggttgaagaaatctgtttcttttaaatatagcaaagccattttttaattcaaatataaagtacttttatattacaaatatgttataaataaatgttcatatataattagagataaagtaaacaatgggctaagattaatattagtttatataaaactttacaaaattccctttaaagtttccagttataaatatatgattttatagtatttaaaaattgatgttatactgtatacaagttttcttaaatataggccttaaactataagccttgttatagcactaaatgttattttttaaatttttctttataaagcctggaaatgagggccttttaaagcaaactttaaattattttatttctattttgttttgcttttggcatattaaactcttttgcttataatctgtattttttctttataagaaaaatattcatatttcttaaatattcactatttatattttgtcttttagggtgaaatgggtgccaaaggagacaaaggatcacctggattttatggcaaaaagggaagtatagatcacacaacaaagtattcatattgaacttttaatgtaatggaaacagaaaactagaattgcagttctaacccagcattagaacagttagctctgttcacccttcttaggggattaattcagaacaatgaaaaaagaaaaaaaagaaaaaaagagctggtgactgcagactgctatgtatggtatcctataagattatgttgtattgttgatcattctgagcttttaaaagatttacaggccgggcgcggtggctcacgcctgtaatcccagcactttgggaggccgaggggggtggatgatgatgtcaggagttcgagaccagcctggccaacatggtaaaaccctgtctctactaaaaatacaaaaagtagctgggcgtggtggtgtgagcctgtagtcccagctgctcaggaggctaaggcaggagaatcacttgaacctgggaggcggaggttgcagagagccaagatcacgccactgcactccagcctgcgtgacagagcaagactccgtctcaaaaaaaaaaaaaaaaaaaaaaaaaaagatttacagatttacagtgagagattccttaggaagcagtagctgcttaaaaaccgtgtccactgaaggccgggcgcggtggctcatgcctgtaatcccagcactttgggaggctaaggtgggcagatcacgaagtcaggagatcgagaccatcctggctaacacggtgaaaccccgtctctagtaaaaatacaaaaacaaaattagccaggagtggtagtgggcgcctgtagtcccagctactcgggagcctgaggcaggagaatggcgtgaacccgggaggcggagcttgcagtgagcggagattgcaccactgcactccagcctgggcaacagagtgagactccgtctcaaaaacaaacaaacaaacaaacaaacaaaaaacatgtccactgaaatttgatgttatgggcctttctagttcctcacactgagggaagaatatttaaaatacccattgctttttaattttgccaagatgttatttctatgtttagatgcttgtaatgataattctgcatctatcaacatttttaatgtcttgatattgcatccactgggttggtaaaatagtgctttgcagagtcaacatgagttgtagttccatgagtttttactacataatgatgttaacttagtagcttttctatttaagttttggttggaacttgaaaacattattgtaaagattgtgttttaagtgtttgttttcgatacagggtgcaaaaggtgaaaaggggaatgctggcttccctggcctccctggacctgctgtgagtttgatagaaaaaagctcttagtattttgctttaaataaaatctatcttatagtatctgtctttaaagagaaaaaattagtgcaaaaatatattaaagcatatgtatttattttttagggagaaccaggaagacatggaaaggatggattaatgggtagtcccggtttcaaggtatttataaaaaaaaaaaaaaggacaaaacaaaaagatttttgtatcttgagaggaaacataagaaaaatgtaccaatattaaaattttttaacatgtggcattgggataaaattcatgagctaaaaggttttttacgtgtaatttaaaaatgctactgaatttcttttgactttattgtggactcttaggtgtcagaagtgaatcataggatattacaaggttgaacttcttcaataaacccttcagattggtttatttggcaggttagaaacagaggttcttttctgtgtctcccaaagattgaggtttcagtgggctgggaaactgtcttcttaaccccggcttctttatcagttgtgtggtatgggcatgagagcattagagtaagtggggaactgcaaagtgtcaataattcattgtctatgaaaaaactcaagggcacatgcccttggggtggtccattagcaccatcatattcttaaagttaggagttagctgatttggatacctaaggagaagatttgtataagccatcagagctgaagaggccatttggtcaatcattggacatagggatgttatcttgttttctaacggtcagttctttgaatcccaaagttgctcagaaattcagttcaaattttcttggtctgtaggtgttttccaaaggaaaaattattcatttatttacttcaagtgctatgaaagtttttcaaatatccatgattcttcgaagagtatactttgaggcaacacttcctaagacagtagtaacctgactataaaatatgggagcccattttaaagtcattggttccttcttgttaattatgcttcagtggtttcatattttctcacttatttaattgaacagattttattgatatttattagaaactagacatatagaggagaataaagccatcatggcttctactcttacacagtttataatctagactatgtgagagaacacagactttatctttgcctgcaacctaagcattcattttaattaatattttgtcctctgttagcataaatccatataccccaagaaatgggactattctttttgggaggcaggagagcttagagaatagaatggagttggatttccagcttgcaatgactttctctaactagctgtatgttctctggcaaatattttgacagtttctatttcgaaaatagagtaaatgttacctatctagaatggtatgaaagggacttgagtaagacaaatcacccagcacagttcctggcaaaaaataagtgttaaataaggaattagttcttttattcatttcctgatttgaacacagctttaagattcctttttagtcttaatctgggtagtatgtgcattcatgtacctgcaaatgtaaacatcagttcactgttttctagcagctatattgctatataattgaaataccataaaattcacccatttaatgtgtagaattcaatagtttttgtgtatttacagagttatgaaacctcattagagtcaatttttagaacattttcattatcccataaagaaacaccatgccctattaaaaatacaaaaaaattagctgggtgtggtggtggacgcctgtagtcccagctactcgggaggctgaggcaggagaatggcatgatcccaggaggcggagcttgcagtgagccgagatggcgccactgcacgccagcctgggcaacacagccagactccatctcaaagaaaaaaaaaaaaaagaaaccgcatgcccatgtagtggtctctccccatttctcaacaagctactacccgtacattaaacccttggcaactattactctgttttctgtctctgcagatttgtgcagatttgtgtattctggacatttcatgtaaatggaaagatgtaatatatggccttttgttctttcaattaccatgacatttttgtgggtcattcatgctttggcttgtatcggtagtacttcattcctttttaatgctaatagtattttattgtaggaatatatcacttggttcaacattttgaggtcagttcactcttgatatttgccttccttataggttcatactacccttcatatttgaccttggttatgtctcctattttctcattagcatgggtctcctaaaaacaatgaagtttttctgtcttgtctgtttgtaaatttttaatggaaacattcatgaattgaaaaaaaaagctatttactttttttgtttaaattactttatttttaacaacagttttaggtttatagcaaaattgaatggaaagtgcagcatattcccacacatcccctgccacttcccaaccctgtacacaggctctcccatgatcaacatctccaccagagtagtacatttgttacaattgacacatcactattacccaaggttcatagtttatgttagagttaattcttggtattgtacacttgacaaatatatacatatgtatatatatacatatacatatatatatatacacatatacatatgaatatacatatatatgtatatgtatatatatatacacatatgaatatacatatatatgtatatgtatatatatatacatatgacaaaataaccttgtagtatcacagagaatagtttcactcccttaaaaatcctgtgggctctaccttttgatcctttcttctcttcaactactcacaaccattgatctttttactctctccagggtttttcctttttcagcatatcatatagttggaatgatacattatgtagccttttcagattggcttcttgctcttaagaatatgcatttaaagttcccccatgtcttttcatagtttgatggctaccctccccagcctctgtaaccatccttctaccctctatgccatgagttcagttattttgattattagttcctacaaatacatgagaacatgtgatgtttgtctttctgttcctggcttatttcacttagcataatgatctctagtttgatccatgttgttgcaaatgactggatctcattgatttttatggctgaatagtactccattgtgtgtatgtgccacattttcttcattcatctgttgatggatacttaggtgacttccaaatcttagccattgtaagtgctgccagaaacacagaagtgcagatatccctttaatatgctgatttcctttcttcttttgggtacatacccagcagtgggattgctggatcatatggtagctccatttttagttttttttttttttttttaaattgagacagagttttgctcttgttgcccaggctggagtgcaatggcatgatctcagctcactgcaacctctgcctcctgggttcaagcaattctcctgcctcagcttcccaagtagcagggattacaggcaactgccatgatgcccggctaatttttgtatttttagtagagacatttcggcatgttggcaaggctgttctcgaattcctgacctcaggcgatccaccctccttggcctcccaaaagttctgggattacaggcatgagccactgcgcctaacccattttcaggttttttgaggaatcttcaaactgtccttcacagtggttgtactaatttacattcccaccaacagtgtacaagtgttcccttttctccacatcctcaccagcatttgttattgtttgccttttggataaaagccattttaactggagtaagatgatatctcattttagttttgatttgcatttctttgagtatcaatgatgaacatcttttcatatgcctgtttgccatttgtatgtcttcttttgagtaatgtctattcaaatattttgcccatcttttgataagattattggattttttttctacagagtcctttgaaatttttgtattttctggttactaatctcttgtcagatgggtagttcgcaaatattttcttgaatttcatggactatctcttcactttgttgattgtatacttttctgtgcagaagcttttcaacatgatttgtccatgtttacttgggttacctatggttgtaaggtattgctcaagaaatcttttctgagatcaatgtcctggagatttcccccaatgtttttctgtagtagtttcatagtttgaggtcttagatttaagtctttagtcaattttgatttgatttttgtgtatgccaggagataggggtctagtttcattgttctgcataggaacatccagtgttcctagcaccatttcttgaagaaactgtcttttccctagtgtatgttctcggaatctttgtcaaaaatgagttcactgtaggtatgtagatttgtttctgggttctctgttctgtttcattggtctttgtatctgtttgtatgccagtaccatgttgttttggttaatataggtctgtactataatttgatgtcgggtaatgtaattcctccacttttattccttatgcttaggatagctttggccattctgggtctttggtgattccatataaattataggattggtttttgtatgtttctgaagaatgtcattggtattttgataggaagttcattgaatctgtaaattcctttggtattatggacatttaaacaatattgattcttcaaacccatgaacatgaaatatttttttattttttggtgtcctcttcaatttctttcattagtgttttataactttcattgtagagatctttcaattcttagatatttaattttatttgtgactattgtaaatgggattactttttaaatttctttttcagattgttcaccattggcatatagagatgctactgatttttgtatgttgactttgtatcctgcaactttaccaaatttatcagtttaatagtttgttggtggagtctttaggtttttctaaataaaagattatatcatcagcaaacaaggataattttacttctccctttccaatttggatgccctttataactttctcttgtctgatttctctagctaggacttccagtactatgttgaataagagtggtgacagtggacaccctgtcatgtttcagatcttacaggaaaggcttttatttttttgtccccattcagtatgatgctagctgtgggtttgtcatagatggcctttattatgttgaggtatgttccttctatatctacttttttgagggtttttatcatgaagagatatttaattttatcaaatgctttgtcagcatcaattgaaatgatcatatggttatctgtcattctgtttatatgatgtatcattttgattgatttgcatacatttaaccattcttttatcccagcgatgaatcccacttggttgttgtgatgaatgatctttctaatatattgttgaatttggtttgttagtattttgttgaagatttttgcatcaatattcatcagagatattggcctgtagttttgttttgtggtatgtttttgtctggtttggtgtcagggtaatactggcctcatagaaagagtttggaagtattccttcttcctctatttttcagaatagtttgagtaggattggtattagttctttaaatgttgggtcaaatccagcagtgaagccatcaggtcccaggcttttctttactggaagactttttatgacagtttgcatcttgttacttgttattggtcctttcaggttttggatttcttcctggtttaatctcagtaggttgtatgtatctaggagtttgtccatttcatgtatattttccaatttattggcatatagttgctcatagtagccactaatgatcctttgaatttctgcagtatcatttataatatctcctttctcatttctgactgtattttatttgggtatccttttttattttctcggttacactggctaaaaatttgtcaattttgtttgtcttttcaaaaaaaacaactttttgtttcattgatctttgtgcttttgaatttcaatttcattgatttctgctctgatctttattatttcttttcttctactaattttgggtttggtttgccttgcttttctaattctttaagatgaattgttagattgcttatttgaagtttttttctcttttttgatgtagatacttagagctataaacttccatcttactactgtttttgctgtatcccatagattttggtatgctgtgtttccatgattacttgcttcaagaattttttcaattttcttcttaatttcttcattgactcactgggcattcaggagcatattgtttaatttccatgtgtttgtatagtttccaaaatacctcttgttattgatttttagctttattatattatcgtcagagaagatgcttgatattattccatttttggaatgtttgaagacttgttttgtgacctaacctatggtctgtcttcgagaataatccacatgctaagaaaagaatttatattctgcagctcttggataaaatgttcagtaaatatctatttgattcgtttggtctgtagtgcagattaagtctaatgtttctttgttgattttctatctggaaaatctgtccaatgctgaaaatggaatgatgaagtctccagctattattgtattggggtctatcactctctttagctctaataatatttccttgctatatctggatgcttgggtgttaggtgcatttaaaattgttatatcctctgctgaattaacccctttatcattgtatagagacccttttctcttagtttttgacttgaaagccattgtgtctgacataaatatagctagtcctgttcttttttggtttctgttggcatggagtatctttttccatccctttatttttagtctatgtgtgtctttataggtgaagtgtgtttactgtaggcaatagatcaatgggtattgttttttcatccagtcagccagtctatgtgttttgattggagagttcagtttgtttacattaaatgttattatttataagtaaggacctactcctgttatgttgttatttgttttctggttgtattttggtctttccttccttctttctttcattcctattgtcctctagtgaagatgattttctctggtgatataacttagtttcttgctttttattttttgtgtattcattgtatgtatttatgagccttacagatattattttataacccattattttaaactgataacaacttaatgctatttgcataaacaaacaaacaagcaaaaagaaaactaataaaaacttgccttaactttgtgcccctggtttttaactttttattgtttcaatttatattttattgtactgattatgttttttaaagttgttatagttattatttttgattggttcattatttagtctttctatttaggataagaggaatttacacaccacagtaacagtgtataatattccgtgtttttctgtgtgcttattattaccagtaagttttttaccttcaggtgattatttatagctcattaatgttcttttctttctgtttaaagtactgcctttagcatttcttgtatggtaggtctggtattgatgaaatcactcatctattgtttgtctgggaaagcctgtctttctccttcatgttgaaggatatttttgtggatatactatactagggtaaagttttttttttttttttttttttttttttacctttggcacttaaaaaatgtcatgcatcatgctactctctcctggcctgtaagccttccactgaaaagtctgctaccagacatattggagctccattgtatgttatttatttatttttgtcgtttgctgcttctaggatcctttctttatccttgaccttgtagagtttgattattaaatgtcttcaggtagtctttgggttaaatctgcttggtgttctatagccttcaagtacttggatattgatatctttctctaggtttgggaagttctctgttaaccctttgaataaagtttctacctcctatctctttctctacctcatctttaaggccaataactcttagatttgccctttgagactattttctagatcctgtaggcatactctatcatttattattatttgtctcctctgactgtttatttccaaagtctatcttcaagctcatcaattacttcttctgcttgattcattctgctattaaaggactctgatacattgttcagtatgctaattgcatttttcagctccagaatttctgctttgtttctttgtaattatttcaatttctttgtgaaatttatctaatataattctgaattccttctctgcatatcttgaattttttacagttttctcaacacacctattttgaattctttgtcttaaaggttacatatttctatttctctagaattgattcctggtgtcttacttagttgatttggtgaggtcatgttttcctgaatggtgttgatgctagtagatgttcttcagtgtctgggcattgaagagttaggtctttattgtagtgttcactgtctgggcttatttgtagtcatccttcttgggaagcttttccagttatctgaaaggacttgggtgttgtgatctaagctgtttctgctttagggtacaccccaagcccagtaacattgtggttcttgcagacttgtagaggtaccaacttgattgtcttgaacaaagtctgggagaattctctggattaccaggcagagattctttttctcttcccttactttctcccaaacatacagaatctttgtctctgttcttttttttttttttctttattattatactttaagttttagggtacatgtgcacattgtgcaggttagttacatatgtatacgtgtgccatgctggtgcgctgcacccactaactcgtcatctagcattaggtatatctcccaatgctatccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccatgacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgtttgccattctaactggtgtgagatggtatctcattgtggttttgatttgcatttctctgatggccagtgatgatgagcattttttcatgtgttttttggttgcataaatgtcttcttttgagaagtgtctgttcatgtccttcgcccactttttgatggggttgtttgtttttatcttgtaaatttgtttgagttctaaatgcccacaagagaaagcaggaaagatccaaaattgacaccctaacatcacaattaaaagaactagaaaagcaagagcaaacacattgtctctgttctgatacacctaaagctggggatggagtgatacaagcacccctgtaaccaccaccactatgctctgggtcagatctgaagccagcacagcactgggtctcacccagtgtctgctctgaccactctctggctgctgcctatgttcgttcaaggccctatgaccctacaatcagcaggtggcaaagccagccaggcctatgtctttcccttcaggatggtgaggtccaccaacccccaaatgggtccagaagttccatcttggagttagggactagagtcaaaagccttagatgtctacctggtatactgttgtgttgcagcagagctggcacttaaaccacaagacgcagtccttctcacttttttctctcctttcaaaggcagaggagcctcacctcatatccaccaccacccctagccatgaggagtactgccagatgaccactgacgtttctttgagccccaaggtctcataagtcagcttatggtgaatgctgcctggcctgggactcactctttagggcagtgggatcccctgtggcccaaggcaggtccagaaatgctgtctaagagtcgagtcctggaattggagacctcaagactctgcttggtgctctacttccccgtggcagtgttggtacctaaggtgtaatacagagtttcctttaattttccctttgcttgtctcaagcagaaggagttttaccccatagccaccacagcttaaggctgagtctcacatgaagccaacaagtctcagaggttcaccaaggcccttggtgtagtacgtaggtatcgctgctagttattcagggcccaagggctcttcagttaacaggtgatgaatgctggcaggactgcatcctttccttcaaggcagtgggtttacttctggcccagggtgtgtctagaaatgtcagaaatgtctagaaatgagctaaggcctggaaagggggcctcttgactctggccagtaccctatcctgctgtggctgagctggtattcaagatacaagacaaagtcctcttcactctttcctctcctctcctcaaggattatagaaggaaggggtctcttttggatccatgagctttgcagtctggggttaggagaaggatgctgtcaacactctcttggctgccccaatgtgggtctcagtatgttgtgtgcctccccagtctactgtctgtgggcctagttcagcactaggattcttttatgagttgcagacattatggcctaggctccctttcaagtttacttggagactgaagcgctttggcccttggtggtgaggtttacaggcactcaagttcagaccactgggatgggtaattctcctttggctggggctggtttaaatgcttcctctgggcctagcgccgtgactcatgcctgtaatcccagcactttgggagggcaaggcgggcagatcacctgaggtcaggagtttgagaccagcctgaccaacatggagaaaccccatctctactaaaaatacaaaattagcggggcatggtggtgcatgcctctaatcccagctacttgggaggctgaggcaggagaatcggttgaacctgggaggcggaggttgcagtgagccggaatcacgccattgcactccagcctggctaacaagagcgaaactccgtctcaaaaaaaaaaaaaagaaaaaagaaaagaaaaaaaaacttcttctgtgggcaggcatcagttgagtttggtctggttttcctttctgctttaacaggagagcactggtttcagtggttcacaattgttgtgttctcccttcattagcacccagaaatgctttccactccatgctgcctctgctggggaagggggaggggtggcatcggtaattcaggattgttttttctctctcttcagtgcctctttcagcaatatggagttaaaaccaggtactgtgagtgctcacctgatttttggttctttgaaagtgttttttctttgtagataattgttaacttggtgttcttgctgggagggggtgacaatcggtggagctttctactccatcttgcttgcctccctcctgatttattttgaattaatttatatgtatggtatgagataaaaatcaggtctcatttttttcccatagggagattcagttattctagcaccatttattgaagactttcatttccctttgaattacattagaacttttgccaaatatgaattgatcaatatgtgggaaactatttttagattctcaattccattccactaatttatacccatattctttcctcaacaacgcagtcttaattattatagctttaaaataaaccttgaaattgtgtggtgtaaatcctctaattttttttttttagaaatcataatgatattatagatttacataaattccatattatttttagtatcagttttaaaatttttaccaagagagcctgtgggatgtgttaaagttttttctttttcttttttttttgagacagagtctcacccttgacacccaggctgaagtgcaatggcacgatcttggcttactgcaacctctgccttccaggttcaagccattctcctgccttagcctcctgagtagctgggattacaggcacctgccaccatgcatggctgatttttttttttttttgtatttttagtagagatgggatttcaccatgttggccaggctggtctcaaactactgacctcaggtgattcacccacctcagattcccaaagtgctgggattacaggcatgagccaccatgcctggccaaagtttttagtgtggaataattgtagattgcagaaaagttgcaaatatagtagagaattcctcataccctttatccaacttctgttgaagttaacattttatattactatggtatatttgtcaaaactaagaaaccaatattggcacattactgtcaactggactccatactttatttgggtttcattagtttttctactaatgtaatttttctgtgccaggatccagtccaggataccacattacatttatttgtcatgccttcctatttcccactgatctgtgatagcttatgagtcatttcttgtctgtcatgactttgatggttttgaagagtattgaccaggtattttgtagaatatcactcagtttgagtttgtttcatgctttcctcatgattagattcagattatagttttttttttttttggaaaaggataacagagggttcaagtgtcctttttatcaaatcagaatgtacatgctacccagatgaaaattcattggtgatattaatgatgatcacctgttttatagtatttacaagctttcttactactttttcatcccatattctgttctttggaagcaagtcaccaaattcaagccctactcaaggtggggtgtagacttaagctccaaatcttagagggaagagcatcttcatgtctctaaatttatttggggagagttgccatcttaacaatattgaatttttcaatccatgaacatggtatattgtttcacttatgtgagttttctttattttatctcagcaaagtttcatagttttcagatcttgtaagtcttctgttaagttcatatctaagtattttattgtatttcttcatactcataaatagactttgaaaaatttttcagtttgttgctagcatatggaaatattgttagttttggtatattgattgtatatcctacagtcttattaaattcacttattagttcctgcaactttttttgttgatttctcaggtttttctacatagatgattatattgactacaaataaagacagttttcttcttctatactaatttatatgaaatttatttattttaatagttttattcactaaacaagccctcaatacaataacaaatagaagggataaaagcacatatttttgccttgcttctgaccttaggtagaaaccatcagtcttttaacattgaatgttagttgttggttttacataaaagccctgcatcaggatgagaaaattcccttttattcccagtctattgagagttttcttttaaaatatcatgattagatgttgaattttgcaaaaaaaaaaaaaaaaagctttttctgccttcactgacttgattatataattttcctctcatattttcttaatatacaacattgatttttgtatgttacactaattttgcattattgggataaaccacaattggttatcttataatattctttttatacattactggattcaatttgcaaatgttttatttcatattatttgtgtctatgttcatggatgattttgatcagcagttttctttttcgtgatatttttgtccagctttaatatcaaaacaatactggcttttcttttctaaaagcatttgtgtagtgttagtgtcatttcttctttatatgtttggtagaattcaccagtgaaaccctctgggcctgagctttgcaggtgtgttgtgtgtctaaggaacattttaattaataatacacctatttagattttatctttcttcttgagcaaccttcagcaatttgtacctttcagtgaatttgtccatatcatttaacttgcaaatttcttggcatattttgtttacaatattgccttattcttgtccttttaatgtctgtaggtttttagtaatgtcctttatttcattcctgatattattttgtaatgataatttcttattgatactttacaattgaaatcaagcactgcagaatatttcctactcttcccctctgtcatttgagcctggttctttttgttcttggataactttctcttatttttttccatgggaatttgtctgtttaagcattctttctctcatagggtcaataataataagcttcactctcctagggaactattatttcatctatatttttcaagtgacttgtataaaattgtgcaagttcctctcatgatttttaaaaagttttctctgttttaatgattattctcccttggtcatcatttcttactttgaatacatatgctttcactctctacttttcttttttttacttttatatgtttctggtttccctcctgtgttggattttttcaaagatccaacattgtaatttgatttttgacttcattaaatttttgttttttacttttatcctattttatttctttattcttttttcctacattttttctagcttttgcaattgagaattgaattcatttacattcgttttttgttattttttatctaagtagttaaactgaatatttttctcatctttgtttgagttgtatccccttgattctgatatgcaatgttttcattaactttttttaaaataaattttgtaattctagtttttctctgtttcctaaaagttgtttaaagagttaaaagtctttttagggtgaaaatccttttatttagattttgttgctaatttctgatattattgtgctgtatcagagaatgtttgtataatttcttctttataagttttagtgaattttttctttgacttattgtatgtttaattttcaggaatgttccctgtgcatatgagaaggtaaatctctattttcagagtgtaaaactcaatatacattcataagaactaccttattgaatatcttatttagatcttctataacttaattctttgtttgtttggcctgtcttgaacagagagtggtatattagtgtcctattattcgtgcatttttgtctattttttctttcaccttctgtttcatgaatgtagtttctacgttattcattgtatagatatttttaactcctacatcttcattttgaattgtggctttagcattataaaatatattttttgtttcctttaataatttttcacttgaattttaccttctccagtatcaggattacacgttttctttttatttttatttgcttgctgcaccttcgcccatccttctattgtctagctttagctttttgagtcactttgttttagttgtgtctcttgtatcaagtgtagagttggtctttgcttcttaaagcaatctgaatttttttattttaatagattaagtctattttcacccattgtctgataggtttggtcttatctctgtcaaaatactcacgttgtaattttgttattatgtaaattatgctatactgactatatttctttctcaatgtgtttttgttgacttttcctattctgcttttaatttctttgggatttaggaaaatttatatttttattttagtggtctttatactacgtttactattccttgtaaatatccgtttcagaattctgttattctccctttacataccttgagcatcaactctttgttgtgttaaatttaaattataccctattatctatgtggaaattaatgaattctattttctccttttctttaatcttttcttcttgtttatttctaccttatcagattatataatatttataaaatactttttacactttatctttgtttcagatctgcaattaaatatactcagtgtttgtcaccagcacctttaccaatattccacggtcacatttgggtttaataaaggttttcctcctttggaagggcttgtgaatacagtattctgaattcttgatattttagtatgtttttctacacttttattatttgaatgacagcttggctacctataaaacccttgtctcaccacttttcactgttttttttctgaatttcttagaaatattgcttacactgccaacatgtgtgttgctgatgccaatctaattgtctttcctttgtgactctttttcctatgaagatgagagtttaaaacaaaaacaattttgcatttaaagtctaatagcatatgtttcagaatttaaaatcccagttactccaaaaagctttagaaaggaagattcagggatttttttttttctggaatgttcttttgaattatagttttaaatataaattctgttacttttttttggtttgtatctcaaggactccaattacagatatattgaaatttatttgtcttctatcgtttctgagcctttaatgtgtttcaaaagtctatttttattggctatgcttgttttctcctcattgacgtttataattttaagtgaaatctattctcccttggtttctagtaatttaatcatcgttctcatctgagatgattttgtctttttgattcctgaataaattcttatttcatatcttccttttatacatttttattctgaattttttaactaataaaaatacttggccgggcgcggtggctcacgcctgtaatcccagcactttcggaggccgaggtgggtggatcatgaggttaggagatcgagaccctcctggctaacacggtgaaaccccgtctctactaaaaatacaaaaaaattagccgggcgtggtggcgggcgcctgtagtcccagctactgaggaggctgaggcaggagaatggcgtgaacccgggaggcggagcttgcagtgagccgagatggcgccactgcactccagcctgggcgacagagcgaaactctgtctcaaaaaaaaaaacttgtataatgtttgttaatccaggttacagtattttgtttcagttttctttatgtttatttttgtgtgaggaaaatatgaaaagtttttattatttttttctttttgttctctgttttggatattatctgccaattcttttcaaatttgaactatcctgtatatattttgacctgtaataataaacagggttgtacatgtttggatagcttgctggtcttcttagttgtagattctctcttcttttatgtataatgaagttagaagtttctttagttaatgagtgctgggtaggacttggtgtgttttctgctggggatgtggaggagtgagaaacataatgtgttgattttagattcttgtggcacattcacgggaagaagttgagtaagcagttatacacagataagaagctccatcttatttagagaaggggaaagaatgggatatagaacagagttgtaaggaattatcttagattgaatgaaggactcctgtttactgtaataaaataaaaggaatggatgggtgcaaatgcaggtaagtgtgttggtttggtggcagaatgtttgtatcctgttttttcttagaatgttggcagaaggagaaaaaagcttttgttgattggagaatattttatatagcagaaactttctatatacatgaaaaatgtggcagagaagagataaaggaaatatagaagttgcattgaagtccagttgaagctggaagttataatctgtatgattattatagtatttttcctccgtagccatactttgaacgtaagcataggctgaggctattttcagtttggtttactcaacactggaatttgcataaaccagtatggtggatgcagagtgaggtaaaggacaagaattttagttagaaagtggttgaaataattaaatgtggtatttaagctggatatgcaaagaaccaaagacagaaaaggagagattataacaaaaggcgtaactcattggatatttccaagagcttggctctttttacagcactgtacatgtattttctcattaatctcataaatcattatcagttgtaagtggaaaaaatttatcctttcacagatgaggaaacaaagaactagagtaaataacttgtccaaggtgacatggccataacaacaaccaatgaaaattctgctcaccaactggttggaaatcatgttatacccaaatattctctcctagttatagaaaataatgatgaaactattgaccctactgtttttaatgatatcttaactagaataaagaaggattggctttatgtttaaaaatactcattttgccaaaattataatgacaaactatagcagttcaagtattgaaataacatatattatttgaaaataatatagccaaaaatacatcgtgaataaaggattgttaaaacctcaactttttggtggcagtggatctccctttctgtgccaagagttgcataaggcattttcacaaaggctcttattttattttcctaaaaaacaaatctatgaagtttggagtattaatggcattttatgcataacatcaggttcaaagagaggacgggatttagttaaacatgcacagctagttccatggcagagtgagggttccaggtctagttcgtatgctcactgatgtgcatgataccttccaaatgtcctgtctgtttacttggtcagctaggagaagcttcctcagtcttacatctttaatacatccgcaggcatgctagtgatttgtttacaaatgaagaataaactatgccataagatcaaagtcaaaataaagtgtttccttaacaaagcaaggatcttcctcaaaattaaactatattttcatgatcagtaaaccataccttccacctgattttgaggattgctataagcaaactaaattactttccatccttttatttttttggggtaaataccaaagaccacagcatgaaaggaaatacacatggaatgcaagtttcacatgcctggttttagttaaatttccttttttttaaagaactgtcttgttgtggaataaatcatttttgacgttagctgtagaaattagattgagaaataatgttaagcatgacattttctcaattatgttatatcaagaagggagttaataacagaatagaaaaacaataaatcggatatgagaccatgttttatactttttcaaatgccaaacaaactgacctgcaccaggttatccaggtcataaaagtaatcaagtgatcaggttaagttctggtaacaatattaaatttcacaggctggttgtatcttgcatttgattatttcaaggaaaatgccaagtagaaattatcctttcatttcttgatgaaacattattaaaatccattattaaaaaatgaagagagtgttcttaggtaaagatgactggccattatcttgtaataactaactgcataattgtccaacagtaaatgctagcgctttatccacaaatgtttttcccatttcctttatccctttgaaatagaacattgaagaataaagagtctgttcctccttccttgatatactccaatgattgtaaagaagggtacttgtagttttatattatgtttggcactagtctaagtattgtaggtgattaaaaaaactcctataaattatgttttctacctttaaaagaatgtgcaagtcaagcaaataacacatataaacaagacacctgctgaacaacttagcataataaaattcagtgctaagtgaaaagctatataatgttatactagttcatagaagagagggattcataagtgcagaaagagtctgtaagtctgttttgagatctgggctagagtagtgtttctcaaagtgttgtccaagactagcagtctcagcaccttctgtaaacttattagaaatgcagattccaggggttgccccagacctaccatatcaggaactctgggttggggtccacaatctgcagtttaacaaaccttccgggtgattcagatgaagttaaattttgagaatcactgctatagataataaagaatgtgatattttattcagttaatatgttaagtgtctaatataaagtaagaagaacataataagttaaatcctcaaataattgtggaacttcattattgatgaaccttgctgatggctacttacgtttttaaaactcctgataattaaaataaaatgatattaggtcaatggacagatagaaaaaagtagagattttataaatcaaagtagtcatgattttataaatcaaagtagtcatctaatcatgtattttgccattacttttaatggcaaaaactgcaattacttttgcaccaacctaataatttcaaattaattgtttctactatttggcaagtgccttaccctctttattttaaatacagaaaatttaaccacagattgttttataagtcacatatgacagtacctggaagtaggagaagttaaatgatctaatgacttatagcagggctggttctcaaatggctgcattagaatcacctggaagaattattaacacagattgctggcccccacccagagattctggcttaatatgctgcagtatggcctgaaattttatattctgaagaagttcccatgttaaatgaagaagttgatcttgcctggtctgaggaccatatttgagaactactaataggagagattccttctgactattgatatgagtgttaagttcagataaaatattgcattatttcttcatagtattaggatctaacatatcccttgtcttgaatttttcaggctttttaaactagctttcaaactaagtggatccaacattttttcctccaatatttttatatgcttttctgtagagctattggattagcagtaacttctctccctctaatttggttaattttcaggaaagcattaatctttgctccttctattctcaactagtgtttataaataaaactggtatagatgaaatatttggctttagttggcatttcacagttctaataaaatgcaggaattcatacaagtgggagaactgttgtttatgtaatgtgatatggttgaatttttttctaagtactgattatgtttgccaaattttagaggtgcttctgtgctttattttctataattttgggaaattcattagaatatgaaattatggatgacagtgttataatatgcttcagtgcattgcattcttagactctttctcccttaaacttatttcaactcaggtatttgagacatttacgggaaaaaatgcttttattttacctcctatcttgctttcatctaggataaaatgttctttctggtatgaaacaagtgtggcaaattgcttgcagagaactttgcttgttgtgatgcagcattttgctggacagaaacaaatgcatggctcataatgactgttagatttcaaaaagtctggggtgtgtacatgtgtgtatatgtgtcaacaggctcttccttgctatcctttattttgctcagatagtttaatagttgtactaatctgcagatattatacattttaggattatattcagctaatatttattgttttagtagaagaagtgtcagatacatttgtattcactagcaattgattcatttaggaaaaaaatttagcttccaaaacgtagatgtaaaataagatgcttaacctgagcatagtaatgtaaaggtatatatcactaaaagcaattataatttaacagctacctaaaatatgcattatagatgtttattttaaatacgtatatactaaagtgccagataatttcaactaataacctataaataactccattcctaatgaaagttttgtttttactttaaaatgtaactctttgaaggcaaggtcaaattaggtccaacatagtgatcaattttaaaataaaaatgaaaaagtatatatgaataggactgatatagaatattggtcacatttaccttggaagtaagatggtctattctcataagaatgactatacagtaccacagttatttaataacttaattatctgccattatgtacacatttttgttgtttatatagtcactttatgaatttctgaaaaagttatttgatgtcaggaaaagttaatatcagtagtccagaagtaattttaatttttctgtttgtatttaatgttctttaatatgtaatgttatatattgttattttggtaagcagacctcaaaactgaattctctatttctttttgtcaaatcattaaaagggagaagcaggatcccctggtgctccggggcaggatggaacacggggagagcctgtgagtaccttctcatttcagttctaaaagatgaagttcttttcctgttacgaaatcctttttggttatttaaattcttctctcagatgccctattatttgttcagtgacttccagattttagatgttgtagaagctgcttgtgaaacaccataaaatattgaaatgttgaatcctcttttagaaaccaggaagaattttgcaaacagtgtgagtcacaaaccacaagcactcatgcccaaagaaatgcatggttaacacaaacatcatggtctgttgctgagccttcagtcgatgtcactttaccactcatctattgtttcatagtatactctttgggatcttgtgttcaataaaaatcaggggtagagaaacatgactaagaaagtactgaatctgaatcctagatatctacatttttagcacatgtcccaggtgattctgaacttcaggtgagttttaaaaatatagtttgcccccacattttattcctacaactcgtggccaacatttaaataccagcagatcttattttattcatcaaaggtacctaccctcaagaaatttgaaatttgccttgtgcggagctaggttaagaactgaagtaatagctgaggtgtatttgtatcacatttatcacaaagtgttcagttgagatttcagaatttaaatattgtacataagagggagagaggtatcaccaaagcttcttaaatagggtagagggattaaactactctgaaagttacttaataaaattttcgttgaatttcatcttgtgtatgattatgtactgggccaagttctatataatgctattaccttccagaagcttataatttaatttggaagactgaaaaaaatgatgcaaataattaccaactctttatattatgtgccaaatatgaatctcatatggagtcagaaagccagggtttggagatgactactgctacatttcagcagtatgagcttggagaagtcacttcacatccctgaatatttttctctaagtgtgaatagtgtagatgcttatagtgcttacttcatagggttgttgtgaagcttacgtaggaaatttttaaaaattgtaaaaacattgcacaaatgcatggggctattctaagtgctgaaagagtataggaaggtaatcctgttattgaggtgcttgaaaaaattttaccaagggtttgtgccagatttgttcatgaaaggatgactgggaatcaaaggaagacaggaaagagagaactcatctgaatgaagacacatatgtgagatggttaaaggtgtgcccaggaaataatgaaatgatcttaatgaggtcctgaatctgcagagaagggtctctgttgcgtgttagaaagtaaaggtagaaacttggctagggccataaaatggagaaccttgactgcaagtttgaaaagtaaaccttattcatttgtcattgaagttttgtgagaaaaaaagagaacatagtaaaaagaactgttttagaggcagtgtatgagctcctggtgtgtgtggaatgattggaaaggagaagaaactggaaacagggtgctagttagcaggctcttttgacagaccaggcatgaagtagaaggcctcgactagggtattaataagcatggagtgggttcaatagggtagcatgagctcaacatatgtgagccataattgctgttatttaagaaaaattatgagacttggtaactggatataagactgggtgtgattatttgtttatgttattgtttcagaatataaagtaggtgtgtgtgtgtatgtgggtgtgcgtgtatgagggaaagagcataagaaacacaaagagaggtgagagaaggaaaggttaatgggaagaaaagaaggaaaaagaggaagagggaaataagagataatagacatgagagcttggatataatttaggatgtgaaggctgggtgcagtggctcacgcttgtaatcccagcactttgggaggccgaggcggctggatcacgaggccaggagatcgagaccatcctggctaacacggtgaaaccccgtctctactaaaaatacaaaaaattagccaggcgtggtggcgggcgcctgtagtcccagctactcggagaggggctgaggccggagaatggtgtgaaaccgggaggcggagcttgcagtgagccgagatggcgccactgcactccagcctgggcgacagagctaaactccctctaaaaaaaaaaaaaaaaaaaaaaaaaaaatttagtttgtgactgtgttctaaatgtttgtgagttagttatttggaatctgtaattcattctcccgtagaaacaatgttagaaagggcagactgaccggcaagtctgtgtagaccataattcaatgtgaggagcacgtatttacgttgaacatgatactattgaaatatcttcataaaacctaaaaagataaaagaaatattaaacataggccgggtgcagtggctcacgcctgtaatcccagcactttgggaggccgaggcgggcggatcatgagggcaggagattgagaccatcctggctaacacggtgaaaccccgtctctactaaaaatacaaaaaattagcagggcgtggtggcacgtgcctgtagtcccagctactcgggaggctgaggcaggagaatcgcttgaacctgggaggtgggggttgcggtgagccaagatcgcgctactgcactccagcctgggcgacagagcaagaccccgtctcaaaatatatatatatttatatatatttatatatatatttatatatttatatatatttatatatatatttatatatatttatatatttatatatatttatatatatatttatatatatttatatatatttatatatatatttatatatttatatatatttatatatatttatatatttatatatatttatatatttatatatatatttatatatttatatatatatttatatatatctatatatttatatatgtatatttatatatatctatatatttatatatatatatatatttatatatatttatatatttatatatttatatatatttatatatatatttatatatttatatatatttatatatattcatatatatatttatatatttacatatgtgtttatatatttatatatatttatatatttacatatgtatttatatatttatatatatttatatatttatatatgtatttatatatttatatatatttatatatttatatatgtatttatatatttatatatatttatatatttatatatttatttatatatctatttatatatatttatatctatttatatatctatttatatatatatttatatatatttatatatatttatatatttatatatatttatatttatatatatttatatatttatatatatttatatatatttatatatttacatatatatttatatatatttatatatttatatatttacatatatatttatatatatttatatatttatatatatttttatatttatatatatttttatatatttatatatttatatatatttatatatttatatatttatatatatttatatatttatagatatttttatatatttatatatatttatatatttatatatatttatatgtatttatatatatttatatagatttatatatatatttttatatatttatatatatttatatatatataaaaaatataaaatgaggagtgcttagaagatgctttcctttcccatggctgcttgtttctcagttttatcgccaagcagacactgatttgggtttgtttttgccctgcctgctcccactttattcaagacttattcctgtctagagttgttgcactagaataatttaccattccagggagtgtggccctttagattttaaccatttccttcttttcttttttttctttcctcccaatattccttccacccctgtaatgtttagcttcagtggtgagggaaacacagtgactgcctcatggaggcttacagcctagttggggagatagatggtaaaaggataagcaagcaaaaactaaattaccaagttcaaaaagatagacaaacaaggtgctgaggcaaagaataatgtgaatggggtagtagacgttattgagatgaattttttctcctaaatctagtgggtaaaaaactgggagttactgagtgagactctcccactccagcccaatggattggggaacacaggagaggttcctttacttcttttcttccattcccctctctttcttgatgaatagcaaagaggaagccaagtttcctatgccaggaaatgcatcctgttaggaaagcaattcataggttaagtgtctcaaatttgctgatgtctggaaacaattcttctggtctgtattttcttccaaataagaacagatagcgtaacaagctattttttttttaacaattaatgaaaacttggtttttattatgctgtgcaaatggattcttatcatttgtggaaaagctttgaaaatagaaaaaaaatccataaagtttatatattttgtgacacaaagaaataaacattcttccattgtgtggaaataatggttttaagtagttgtaataaatgacttggctctactataaagggcatattcactttattctataatgtggcagccaagaaaattaatggagtttcacatggaaggacagaagctcttggaaaaatgctttaaagctaattaaacacagcttatgtcagtttaatggtgattcatccctgtaagcagattgatacatatgaacactaactcccagaattaaaattaatggctagcactataatttattaggaaatgattatattgcttcaaaatacaagtacattcacatgtcagtactttgaatttgaaagctagtatttgtcaatcctaaaagtaatttactttctaagtagtaaattatacctaattaacttcaattcaggaaactgtaaactcaggtctaacaccagatagatttattataacttgtttcaaccatgaattgctatgtttaaagattatattctttcaattattcagcagtatttactgagtgtctactttgtgccagacattgtactaattgaggagaatatgaagattaattaatcatggcctggccatcaaggagtcaaatgagccaatagatggcaacacagtatgaatggtatgaacataggtatggggggagcctgaaaggctgtggaagatgtgtataaccttacatgaggctgtaggcattgtcgaaaggtatgcattgtttaaaaaaaaaaaatgcaggccagacatggtggcccatgcctgtaatcccagcattttgggaggccaaggcaggtggattacttgaggtcaggagtttgagaccagcctggcaaacatggtgaaatcccatctctactaaaaataaaaaaatcagccaggcgtggtggtgggcgcctgtaatcccacctactcgggaggctgtggcaggagaattgcttgaacctggaaggtggagactgcagtgagccaagatcatgccactgcactccagcctgggtgacagagtgagactctgtctcaaaagaaacaaaaacaaaaaaaccaatattatgagatataattcacatacagttcacctatttaaaatgcatagggatggcttcttaaaaacacaactctcttggccaaattctggatgataaatatgagtgtgctagttgtttggcctggcaaggcaggagtgtgtagcatgcatgttccaaaatatagaggcagaagaaagcatactctgagaagaactgacagtagttgaggctgccatgcggtacatgaaagggaagtgacagaaacagtaggtgagcttttagggatagatagaggccaaaccaggaagggctttaggtgtctgtgctgtttgcacttaattctgagagtaatgggagccctacttccctacttaaaacttttgactggaagcagttagtgagctctgtcacctctagtaacaactaaagtgagagtggtcagagttgggagggggagagtgggacggatttgaaatgaactaaacaggtactagcagggcttgaggatccattagatgcgggtaagataagagatgactcttcaaaagtcttactgcatggatggatacagaggaacaccacacagtaaacagggaatagaacacaaagaaccagttttggctagtgcaagtgatcctaaagtatgtttaaatggaacatatctaaataataacaaaggcatttaaagagaaggtctatattttgggataattagaaaataataggcttgtaaaaatagaaattaataaaatttcaataaaaagttgtgggtcagatccaaggaaattttagatgaatttctgtaaatactagtggtagtaggttaaaaaatgcctccccctcagaaatatcagatcttaacttctgaaacctgtaaatatggttttatttggataaaaaggtctttgtagaaatgattaagttaaagatcttctgatggggagattatctgggattttctggtgggcatgaaccagtcagttgaaagttcagagcaacactgaagtttcctagagaaagaagaaattctctccatggattacagcgtcagctcctgtgtgagagtttccaacttacacctcctaattgcctgtctcatggattggtatttgcctagccagtccccactcttgcataaaccaatactttgcaacaaatctctgccatgtatatgtgtgtatacatacattcatatatctcagctggttctgtttctctgctggaaccctgactgatgcagattttgtttccgggagtaagtacctaagtacctaaaatgtagagtggcttgggaactgggtaatgtatagaggctgtaagaattttgagacacatggtagaagtagtctatattgccttgaacagactactggtagacatatgaatgttaaagattgatagtgagggctcagtgaagaagtggaagtcatgtggagaaagcctttctcatcttagaaaatatgtatagcatcatcaacacactgttgctagatgaatggacattaaagacactgttgataaaggaggaaagaggaacatgctgtaggaaactggaagaatagtgacaccttgtcataaagtggcagaaaatttagctaaatgatgtcctgcagttgtgtggaaagtaagacttctaagtgatgaacttgtatatttagctgacgagattgccaagcaaagtgctgaagatagagcatgattttttttttcttactgcttatagtaaagtgtgaggagaaaaagatatttgaggaaagaactgttaagcaaaaaggagccagcacttggtgatttgggaaatatcctgcttatatagattacaaaagatgttaaaattagcagattcactgttacgcaagcatgctggaaaaaaggttaaggttgtggctagacaaagtttgctagtgcaaaagagattaggtacaggactcatgaatccattcaaccagcccagtggaagccacatataaagatatgagactatccaggaaaaacctggggaggagcctcttgtctaattgtgtaaatcctcattatatatacaggaaacttacaaggttttgataatgttatatcagcagaaactctgccagtttggaatgaaaggtacagagacaagacaaagtgagggaaggctgttggacgctcaaaatttttataggtaggaagcaggctgataaaactactcaacttcaattatgtactatctttcaagtaaaaaagaatagtggttccaaggctggcagggcctcaagcccagaggggtattcctaggtcatgaaatctgatggaattttttctgctggattcaacattgcagagggtcagcgaccttttcttctttttgaatgggtatgttgataacttatcctttgcctgtcttaacatcgtaatcgggaaatagataacttgctctgtagtctataggttcacagatggaaagggatattgtcctaggatggatcatacccatacctgatttagataacaagatttaggacttcagagcgatttattaatttagataagaatttgaaattcactgtaaattgttgagacttttgtggacattggattggggtggatgtatactgtatgtgggatgaatgtgaatctttgaaggccagagggtagactgtgtcaggctgaaaattacccttccccgagacatcagctcttaatccccagaatctgtaaatattaccttatttgaaaaaaaggtcttttgtagatatgaatgagtatcttgtcatagggagattatcttggcttatcccagtggaccctaaatgtcacactagtgtccttgtaagagagaggcagaggaaaatttcacatagggaagaggagggagtaatgagaccatggtggctaagattggagtgatgtatccacaagccaaagaatgctggcactgaccaaaaattgagaaaggcaagtaatggaatcttcccttgagcttctgggggacacacagccctgaaaagactttgacttcagacttgtgcattccagaactgtgagggaataaaattctgttgtgtaaaccaagtttgtggtaatttgttacagtagctattggaaactagtacactaggcttttcatttagtctaattcttaatcattttatgtaatgaacctatataaaaatgtatgtgagtatgtattggtgtatattgcaaactgttggtagcatatgtgttgatcaaaaatatttgggcttcagcaagtcaataaacaagtctgtttcaatgacaatttgaaagcaagactcttcagtcaatattttctatactatcaattttgttaaattatcatgtatttttaaaaacttaatttgtctatttctcattttcctacatttttcattgttgtatttagtaacttttagcccatatttcttctctgtgttatcatattgtaaatttgaagcaattaaatggatgatacttaatgtgctatatataatagttaaacaatatataaatatgtatgcgtaaaaaaggatctgcatggatacaaatcgtatggtttaattatgtttcaattacttcgcttatttttccccagttgggtttttgttgtctgttatgttgcatttttcttgcctttattttatgttctcccatgagcataaacataataaacataaacatatgttctcccatgagcataaacaaaaataattattgtttttgtactataacaacaattgaggcctagattttgagtgctttttagtgtttttttttcttttaaaagatgccaactttgctagactacattttggtttttattctaagaataaaggacaagattgcttcaaagaatccttaatattttggaaatttcttttcctaacttaatattttggaattttcttttcctaaaatcactctgattttatcttgggcagctaggtggatggtgaggacagagcaacatgagggcaacagtagaataaatttaccagtagttgaaaaaaccgtaacagaaaatactcattttcaactgaattcaatgttagaccaagttatcatgttgacgagttagtcttctttggtcaattcttgccaaccaaattatctgcagaatagtttccactgctgctttgtcatagctatttttgtcctggtgctcaatcctgatggcatgttgtatttggtgttaacattttcatcaggcaatctaaatcatttgctttctagttctctgctcaccagctagccccattgtgtacagggagccttatggctcacagtgaaaatttgtaggcagggactgggttctactgtgagctgagatccctggagctccatgaaaaggagaaaaagaatgccgtgtttcctggatctatggaggtgagtgcatatttcttaatgaaggatggccttagcagttttattttggaaatgtttgctgtctcatttttccaggaataaagacatggggatcactgtagtgtagttgaaacactggctcatagaggcttttattgtttcctttcctcatgcctttcaaattcttgcttaaccacatgttatgcttgtctttatgatgtaatgtttactgctgagccagtccaagttaccatgtacttaagagacaagtagatcttttgtttaatcaccttttctgcagcgtgattatttggcatatcagttttatgcatatatgcagaagacatgcataaaattattggggaacattaatgatgaattgctgtgataatttcccatgtggaattaccaatctactttgtgatgctagtaaagtggaggtatctttatttgcctgcttgactatattttttatttagattgaaaagaaagaggagaaaaacccactagttctattattgtttttacttgatttgcaattgtatggtaagatgtttcagtcttttgtacagatttgtaatactttttctcacccctttttcaggctccaggagtggtacataccaagtatgtgccgagtaaaccaactttaacttgaaactcatatatctgctattacaaatttcacacagcagttcttagtgtgaaggcaacccacatgtaacaatttggatagtacaatttgaaaattcaattgtatttattattgtaataatgtaattatgtatataattattataaaacaatattactacataaaactattataataatttattgtcatagtaattatgttttaaaatctaattgagaataactcttataatgcattttgaaataggctttatctaaaataatgtaaatgctcagtttatctgtaggattgactaaatttgtaagcaatatctgtaactttttggtcttctacaatatgacagttggcaatgtagtgactgtgaaaatattgtgtcattaattttgacctcacacacaaatgttggctcattatctgtacaaattagttaataaagtcccaccaggtttaatcacagatctgttttattctttcctatcataaatgacataaatatcattgacatagcaaaactggactaccatcaaacaataacataaagtaacattgttgattttaaatttagaagctctgtgtctacggcactgatcatttttttgtgttgttctaagaaatctttttttcttcgatggagtcttgctctgttgccaggctggagtgcagtggcacgatcttgactcactgcaacctctgcctcctgggttcaagcaattctcctgcctcagcctcctgagtagctgagactacaggcgcgtgccaccatgcccagctaatttttgtattttagtagagacagggtttcaccattttggccaggatggtcttgatctcttgacatcatgatccgccctcctcagcctcccaaagtgctgggattacaggcgtgagccactgcgcccagccagaagtcctttaaattattgttattgtaagaaccactgataagcattaacgtattttatttgattttttctcttttctatccatttctttataatttgaaagaggctttattgagccctgaaatttcaagaggaataaatgcaattgcaaatatgagatgatgtatgattaattcttagaatggataacatatcctctaagtaaatagaatctcattattgtttatgtaggctcagtagtctcactggtatggggactgattatattcatctctgatttgaagagaatggatgagaggaaacttaccatgtatacaggatatcaagtctaacttttatgggttgatgtcatgtaaacagactttgactttaacaatatggatttgaattttttgggtccacttatatgtggatttttttcaatacatatagtgaaaaatttttttggaacgttttgacagttttaaaaacttgtagatgaaccatgttgcatagaaatatttttttaaaataaaaagttatgccatgagtgcaaaaaatatatatagatgttagtctgtattatttactataataaaaatttaaaattgatcacaacttacatacacaaacatttacagaacatacatagtgccatttgcagttgagataaatgtatacaaatgtaaagatgcaatattaaatcataactgcctaaaattaactgtagtgcatattgtattactgtaataatttcatagccacctcctgttgctattttggtgagctcaactgttgcaggtatcagcttaaaatgccatgtgatgctaatcatctccatgggagcagtttgtctttccaataaattgtgtattacagtaaaaagtgatctcagccgagtgtggtggttcaagcctgtaaccccagcattttgggagttaaggggggcggaccacttgaccaagcccaggagtttgagactagcctgggtagcatcgcaaaaccccatctctacaaaacatacaaaaaattagccagatgtggtgatgtgtgcctagtgccagctactcaggaggctgaggtggggggatcacctgagcctgggaggtcgaggccccattcagcagagatcactccactgtactccagcctgggtggtagagtgagtgagacactatctcaaagaaaaagatctcttgtggttttttgcgtatttttcattgtttagtgcaatactgtaaactctgaataacatcatgaaacacataggaagtgccactagtgattttggaagtgctcccaaaaagcagaaaaaaagttgtgacattataagaaaaggttttattgcttgatatgtaccatagattgaggtctgctgctgcaattgcccaccattttgagataatacagtgtaaggaccattgtaaaaaaaagaaaaggaaatttgtgaaactgttgctgcagctatgctggcaggtgcaaaaactttgtactttttgcaaaattcctttttgtctcatattgaaaattcagcttttatgtgaatgcaggattgctataagaaaggcatactaatagacacaaatatgatttttaaagagcaaaattatttttttttgagatggagtctcactctgttgcccaggctggagtgcagtggcgcaatctcagctcactgcaacctccacctcccggggtcaagcaattctcctgcttcagcctcctcagtagctgagattataggcatgtgccaccatgcccagctaatttttgtatttttagtagagacggggtttcaccatgttggccaggctggtcttgaagtcctgacctcaggtgatccacccacctcggcctcccaaagtgctaggattacaggtgtgagccactgtgcccggcctaaaaagcaaaattattatatgataaattaaagcaaaacaaagatgaagaatttatcaattctccagctttttcaaacaaaagctggagaatttaatgtcagcaaaggatggtttgataattttaaaaacaggtttggcttaaaaattgtcaaacacaggagaagcagcttctgccaacaaagcagcagcacaagcatttccagatgccactaagaatctcattgaggagaaatggatatcttcctgaacaaatttttaatgcagatagaattgtcctactctggaagaaagaaatgccacaaaggacatttattagtaaggaagagaaacaagccccaggatttaagtcaggaaaggataggctaactgtactgttttgtacaaatgcagttgggtttataatcaggacttcccttatctttagagctgttaactcccaagccttgaagggaaactataaacaccagctggcagtcttttggttgtataacaagaaagcctggatgacagaatgctttttctggattggttccatcaatgctttgtccctgaaatcaggaagtacattgctagtaagggactgcattttaaagttcttttgatattagacaatgtctccagccacccagaaccccatgagttcaatactgaagacatctgaatggtctacttgccccctaagacaatgtatctaattcagcctctagattgtataataaggaggacctttaaagcttattacacatggtattgtatggaaaggttgtcaatgctatagaagagaaccccagcagagagaatgtcatgaaagtctggaagaattacaccactgacgatgctgtcattgttacagaaaaagccatgaagcctgaaacataaaattctactggagaaaactgtgtctaaatgttgtacatgatcttatgacacaaccaatcagggaaatcacaaaagagattgtggatatggcaaaacaaaacaaaacaaaacaaaacaaaacaaaacaaaacaaaacaaaaggtgaagggacaagggtcccaagatatggatcgtggagagattcaagaggtaacagacaccaaatcagaggaattaacagaagacaacttgatggtgatgagtggctccaaaccagtgccagactatgggaagaagacagagaagaagcaatgccagaaaacaaattgacattagacaagctggcagaatggttcggattatttaagactgcttttgacttcttttacggcatggacacttctatgatatgggtactgacactgaagcaaatagtggaagaaggattgctgccttataggaacctttctagataaatgaaaagcaaaaaatcgggcagaaattacagtgtgctttcacaaaattacacccagtgcgcctgcctttcctgcttccccttttaccccttccacatctgtctctgtcaccccttgagacagcaagaccaacccctcctcttcttcttcctcagcctacttaacatgaagatgatgagggtgaagacctttatgatgatccacttccacttaatgaatagtagatatattttctcttccatattatcttaataacatttgcttttctctagtttctttattgtaataatatagtatacaatacatataacatccaaaacacgtattaattgactgtttatgttattggtaatgctttcagccaaaactaggctattaatagttacattttgggggagtcaaaatttaaccgtggattttcaactgtgcaatggtttggcaccactaacccctgtgtagttcaagggtcaactgtatataaaaatcgtgtggtgggttaaaactcctaaaatccattaaagataagcacatttaatcatgacaggcagagtgttaagaattttgttcaaaggttatagcttggtggaaaaataatgtatatgtaatggtttttaagcagaggcataaaatggattattttaaaatttaattagtagataatcgtaaatttaaaacccctgatgacaatccaagcttaatacctataatacagatagttttcaggagagtctcacttatatataaataatttagatatttttatatataatataaaatatatgagactatatgtaaatgagaatcttgaaaattatctgtattatgaatataaatatatttatatataaataaatgatactctcttggaaatgatctgtatatctcttgaaaaaaatatataaagaacactatttctcaagctctgatccacagagtacctcaaaattactagaaatgcctattaaaattcagttttctaggggccattctgctcctgataaatcaaaatttggggtcaaagcccaagaaactagatttttaatggcaactgcatgtgagtctgatgtaaagtttaataactactgatatagagactttgaaacaagtagatcaaaaagaggaatatgaacacagtaggaagacaaaagttacctactggaggagaacaatcagttttagtgatattggtacaagaaaagaattctgacattttaatatttttcagaccatacatgctttaatatgtatttgtctggttaaataagctttgatgttgtcataaatgataatatgaaattatatttccaaatgggttcggtttcctttgcttatttataatattttgtgttttgtttattgacaaaaataacaagaacaaatctattttgtaaaacaaaaatacatctatatgcaattgaagaggactaaacttgcttatatgagagaggtaaatccttacaaagatagaaattagataacttaaatttattagttttattataccttcaattttaatgaaatttttaggttattattttttccagatttaaaaaattttatgtaatagacaaaagtaacaatctgtaattatagatctaatatattaccattttttgttttagaaaagttctatgactgtgggaaaatgggggaaatggtgcctgggaaagctgattttgccaaatgtcgaattcctagctctcctgtgaaagaaagtgctccttaaacacagcattatctttccctgagcaatatgaatgcctttgtccaacacagtgtacttagcaatatgtgaaaattatctgcaagaataactcccaaggcatgaaaacttagcaaatgtgttacacagggagatcatagcagggaggtgtattaagatctccccagtattgatttctgagtctgcagtataattctttccagttgttctagttctcttaccaaatgatagccgcaacctttaatatctttacttttttattttgaaagaccaacgtttaacagtaatttcttgaatgatttaaatgtgaggaaaataactcttagacattttttgagaactttttaagacaagaaatttgtgtgggccaacttttcatttgtttattattatgtattgtatatttgactacattttattagttttatctaatccttttgttcattatttatcacttcttacatatatttatttacttagtttatcttaagtactcaaaaagtatagaagttgtgttgtaaatttgagtctgctttcacttacccaaattccattcccattcccagcagtaacaattgttactcatttaatgagattatgtctggactttttctttacaaatacataagaacatacacaatttttttaaacaacaaattggatccactgaaacttttatttaactttgtaatatgaacatttaccatataaggttataagacaatataaaatctatctcatttcatttatagcatagctataaagcaatctaatctctcttattaatgttttttatatatatatattttttctgcatacttaggcaatattttccccaagggatatatccctataagtgtgactactggtttaaaatataaattatggtttattcctgaatttaagtagaaatgtctagtgtttcaccaaatctgatgtttaaaatgggtttctgattgattcagactttggtttcaaatattagttctattcctagattattgggagttttcacaaatattgcatgataaatttttaataatgaatcttttgagatgattttgtgtgtttttcttctaaattgttaatatgggaatgttattagtatagtatattatacggatatatttctttatattggacatttcttgcatgctgagacaaaccctacttagccatgctctacttttgttctgacacatggctatatttatcttactagccttatagtaagtccatttgcatttattttaacaaattacatcagcttgtagatttcttttttaggtattattattgacttagtattagtagcttcataatttgaatttagatgatcatccttttaatgccttggaggaatttaaattacatagaaactatctggtcctcagatattagataatatttctgtggtaggcaaaatatgacaactccctcctctccccaaagatagccataatttaatccctggaacctggtactttccacagcaaagagattttgtagatgtgattaaggttaatgtccttgagatggaaattttattccagattatctaaggaggcccaatctgatcatgagtaattgaaagtggaaaaatacagagcaggaatggggcaaaaagatgtgactgaagaaggacctgacccatatgaagatagagaaaatgaaggatagattccttggggctgtaaaccaaggaatgtagttgcccctggaagctggaaatggacctcaagtttacagccagtaagaaaatggctaccttggtcctacagctgcaagaaacagaattctgccaataacctgaatgcacaggaagcagattctttccgagagactccagaaaggggtgcagcattgctgattcttggaatttagccctgtgagacccatgctggacttctgacccacagaactgtaagataataaatgtgtgttgttttaattgcactaaatatgtggtcattggttatgaatcaatagaaaacatatttaattttttttactttaatcaatgcttgtcaattgtttcattatttttataagaaaatgggatttatattatataaacataaaattcacaatgggctgtgttatgcaataactagtatagagatttagatggaatagcatacacatttcaaaaatatgaggttataaataagatatagaagatattagattagatacaattttaaatacctagttatttttatcgtataaattaagtttaaaaattcacttattagtgtgttttctttatcaaactaatttcattttttatttggtggggatggttaatggtgctttaaaatattttggtatgattacctctattatatataaaattcaaaaaaaatagtagaattttccggtttctctggaaaagatttaacttctattttaacttctattcaacaccaagttaaagtttctaaagttaaaaagggtctttgaaaaattcacttttagttttcttcttaatgagaaattgaccataatttgttttgagttatgtagtaacaaaaaatgtaccccaaaaatgtggtaggtacttttcaggctttcagaggatcagagcccattttagaacaactctggtattattttggaaatttctctttcaaaatggaattgattttaagttttacatatgtctatacatacatgcttgtttgtttgtttgtttgttttaacacatccatgtatttcatatgcatttcacttactgatataaaggggtaggtggttttcctggacctttgggctctggtggctacatgactttcccaccatgtgacaggggtcccagatctcttaatcctttcccttcctctccagatagtcttcgtccttgtctgagttttcgggtttgttattttaatttgctaagaatttgagattttgtcttgtcctggaaaaggatgcttttgcaacgtaacattgttcagactattttatttgtttataaaaatgtagaaatgcctttaggtgtggaaaagaaatgccagttactgcagtagccttgaaaatggcctccaaatggcttttccttcctatgatatctttgttctctttttttgtagcctataaggtgaaacttgtgacactttctgctttattataaacatgagtagcctatatttattggctaaagtattttctacttaaattgtttatctttgggtaatttgggtcctgtcccaagtgggcccttgtctacaggccagggtgaataagttcatccaacgttcttagattttttttccttaaagattaattacagcataatatgggaatagaaaactgttcatttccttatcaagggtttattgcaagtacttgtatattggtttcttttaggtctggcaactgcgagtgtaagttacttctccctatagttaccttaccacagaataatctgttgtaaatcattcataatggcctgccagttactgtggaaaaaaaataattgaaaaacattgcagggttcaactacaaatatatttaatactcttggtcatctttttatgaacaaatagtgatgaattatttaaaatatttaaaaagcaaaagtcatgatagtattactctgtaatcaagatcagccaaacatgaaaaggaaaggtattgaatggggggcaatgccgacttgttggcgtccccgagtgggggactttagattgctagcatcatcctacatataatggacatttttggaaatgcaagtagggaaaggcaaggtagaaagccaataagaaaaaaaaaaagaaaaaagaaaaagccttacaatggagaaagaggacaaaacgtagagacatggaaaaaagttgacttcaagtatttcacaactttcaaaggtcagggaggagctgtgaagagacagttataaaaatttgttcattgtcatgccagcactgagctaaatatttgtgaaagctaattgatagaatgtaccaactctatgagataggttttattattttcccgacaaagaaaactgggattcagagattttacagtttaaataactggcctggagtggatctgctattaggacatgggctggctgactccagcatctattttttagctgcttcctatggcttctactatgctctttactgataatcagattggaatctttttagttaatgagaatgatactttcaacatgtgaattttttcttcattgaatctttaagaatgaataaatcacttcttgatataatgaagaaaacatgtaatatacttctgatattttgataactggatattaaatatctctaccattgtgtagaaaggtagataatttgacataaaaataccattaatagtttagatcttttttagtgaattgaaaatattgcattacttaaaagcaaatttgatctaagatggtccaatttcatagataagtaaatacattcattacatatggggagtatactgtgatattttgtcttttctaagtaatattgtcatagacacattcccttcattacaaagtattctctaggaaatagaagtcaaaccctttattctaaagtatgtatttctattcttaacaacttgtttgttgtacagcagtggtttaaatggttacagagaagcttctagaacaattttttgtgtcaacattctttaaccacaacattatgcaggattttctggttgactttctgctcttcctcaaacccaaactgaaatcacagaagtagaggaaatatgtccacttactcttacttctttctgtctttacttggacattgtcacagttgcctgaacccaaaaccacagcgaaacagaaaatagtctccttggaaacacatttgctctataaaataattgtcactaaatactttgcgatcaacaaactgttaactttcaaatgcttttggataatattactgctaacttaaaattagcaaagtttagtcaatttcaatacacatattgggagcccaggaaaatattaacttggagaattttattaactaatatagctctgaatgatttcagtttccctggttaacctctccctcaataagctggtattctgtgcatgcttgtggtattatattagttttgccaagaattccttagataaatcaggcctatgttttgtttttgatatcctgtagtttttatatatttttacttggtatttgtaaaagaagtaataattcttagcataattggacatagaagatccattaggacttcatggacatacatatctatgaaatgtatgtaaatttttggccagtttgagaggatgaacaaaaagaaaaggaatttttttatagtctggaatctcccccaaataatcttaatagcagatatattgaaataatgtaagatttgtggctatgttctactacagaccaagctcagtattagagtgtctcagataaaagagtgtcagatcaaatccaaggagtaaactgtggggaaatgggctctcaagggctttgaggaggtggaagccaaggtgctgttcgtggaaacctgggtataactgttttctccagggaaaggatgtgaacttgctaacactgggattgtcttcaggatatctgtaactaattctgctaacatcacagactgtgtaagggcacagggacttgaatagtgataaaaactttaaataattaaagactagtaagaaattcagcttctcaggtctgacactgtcatcggtaatcacatgtgcccgttagggactctgggagccaaggttattacattgacagaactgtaccagttttccagcatagaacaatgtatagccaccttccttctgagaagaatttacacacgtattttagttaaattcagaacttgatctcaacttttagtgaattttcacacgtgtgtgggtatttgaatgggaggaggtcacagggtggtttcacaccaaattacggttcattcaaatggaggcccttattttgaataatgtttatcttaattcattgcattgagaatatacattttctgcctaagaaggtacaattcattttatattcataactcagtgattttacttttactttatgttttagagtgcttattaggtgtactgtgattgtgttttatattgttacttcaaggtatttttattgttttcatattattctctacttacgtttataaaggcctgtctttgcaactagattgtgagtcccttgttgatagtcattgctcacataccacttttgttctctgcaaatggtatagtgaagtggcaaactgaattgagctgaatagaatcaaactgaattccaatgtatgatttgagttcagattttaaaactagaactatgtgtttatgtcttgccctataattgcgattagcacattgatcaataaaggttgtatttataaactcagggtgtgaaaataaagataatggcagattctccctgcaatagaagaagacacttgatctcattgtcaatggcagctctagcacctgctgtgatttactgaagagtactgctttcctttggaaggcctgctagtgcagagggtttgcaaagtcatacagatgtgacccaattttcttgtctttcagtgtcaatacatttgtataaatataaatgttgttaactgtttcagctcaaatgtcaccaaaataggtgctaagaaaatggaataaaaagcaaaaattgattagtacaatcactgttttgcatgataaatgatcatgttgggtaaatgcatcaaaaggcagacaatagaactcttctgcaagcaataaatgtgctaaatttattcttaacttgatagaattaacattaattttttctgaatgttgctacagacatgtgcatatgagttcagccacgtgaaagagtgacctgtacttctttatgtctcttcacaaactgtggtcttcatattcttcatgattgcatcagtaagggagttattaagagaaaagattgccattttttatatgaatatttaggttcttgggtatttcaaggctcaggtgggaggcaatcatttaattaaattaatttttaactaaggtggtgacactgagggcttgtggaactgttgcgctaaatcagaacttatatcatttaacagattttcttgcatgattcattagaatacaagaatgtgttcaaatgaaacatcattttaattttatcactcatgtgttggggtgcaagaactgagatgaatttcctcatagtttctttttcaaaaagcctttatttaaagctctaaatatcagtaatattcatataatgctatatctcctaagttgtcttttccatattggattattacaaatagcaatattataatatgtatacatttgaaaatatgttatttaccagttaaaattccaattgtgactgtttcttctttaatgataaagtcttcaattttttataagttaaaaatctattttatttgtttttagggaatcccaggatttcctggaaaccgaggattaatgggccaaaaggtaagtattcatgagagttagctttgggcctggatctgctcatttaatgcattgttgtctacaataaaatacagttttacatttgtggtaacagttaatttttcaaatattatataattttagaagacgttgttttggctttacaaatttgtatatattgttttgtggttgttttatatagataatattaatttagatttacattatatgcttcctcctttactttgttacttttcaactttgttctctaacataattatggcataatttacttctttatagttaatttacttaactatatttttgaatgtctttttagtacagatagcttggtaataaactttcagtttttatttaattacaaacttctttattttgctcttgttttgaaggacagttttgtagactatacaactcaaggttgacaattattttctcttagtaaattgaagattttcttctatggtttttttggctttcattgttaactttgaaaaatctgctgtcattctaattatcattcttttgtaagtgatctgtttctttcttttggaaccttttaaggtattttatttgtttttagtgttcttcaaattcactacaatatgtctagatatggatatctctttattcatcttgctgggaattcagtttgcttctttgctctgtggaattatttccagtagttctggaaagaatcaccattatctccatatgacctctgctccattctctgtttctggaattctggttagacattttattttatttcttctaattttatgctctacatctctttttagcattacctaccatatttccatatttttggttgtcttacattctggttaaatgttttagatataccttatagtttacttattctttattgtgtctaatctgttagaatgatcaattgattttttttaaaaatgataaacactcataattttcactttcagagtttataattttttaaaccacaactttttgttcttgaagtctcttgttatattttcagtactaatagtctttcatgattctgtttttttaatttaaaaaaatctcatatctaattctaaattctgtttctaacaattctaatatctgcagttaattatttattacttattattctcattcctgtatcttgctgtctcttgtttctatattgtttatcatgagctcattgcttcatcttaatttagagggtgtcctgtcagcctaactaggaaatgaagacctgccttttgctggtagccatggataccatttcagccccatttgaaagtgctgagtcatcataggtattgaagattcctgcttcctttccatggctggccagcattcagtttcccaagagctgaagatccaccctcagatacttccacttttcttggcttctacagttctgtctctggcatggtttctgtatagttcaaattctcataattatagccccaactcaaagtatatttcattaaaatgagagatctttgaatacctctcctacttcttggaagaccagcactctctcacagaggatgttccttctaggatttttgttctggacttagaggacctagtcagccgcatccctggaagttgaagtctaatgctgttatttttttagtctatttttctttattaatttatgttcactatcatatttcttaaactctatgataaatagaaaaatttttcacctgatttttatttctgttgtttaccaactccatctaagctactaggtcttcctttgaaagaatggcaaatgttactacaaatgtcataataaaaatattgagagtaaatcctcagactctatgccaaggtctttaaggccttgctccttccttactgtagtggaagagaaagcagaaaaaggtgaactgattgatattcaattgtcattccattgtgctttggcagaagctttcttgaaataaattgataatttacaatttataatgtttttaatgtttgatttttttagggagaaattgggcctccaggacagcaaggaaaaaaaggagccccagggatgcctgtatgttgatgtcattatcatcatacatcaaagtgtttgcagtgttgctactacctactaggagttcatattcgagagttcataaaaatgtaggggatacagcaataaaatatttgaggtccatgaattccattctgttgtatgaaacatattatgtctatgtgcatttttctaaaagagtaaagatttcttcagtttctcaaaaagttggccacccaaaaaaacatcagggaccctaactgtagataaattagaaaacatgtattctagctattaatttaaaaatactaagtaccattaagtctaaatctcagtgatttttttattttaaattaaatttacaaacatattacactaatgggaaagaatatgtatagaagacatagtatgggaagctcctaaaacagagtaaattatttcagaattttcaagagtgaagatggcatatgaaactgattcaaaattatgaaaattcatgtgtgcaagaatccccccccaaattttaactttattgctagaagtgatgttgattttaatatatgaatcaaattgtctgttataggttcatattgagattatattttctaatgatataattttttaatcccttttcctttgtaaagtgtgttaaatatgtataatagtatttaaagtagaatctaaattaaatcaagtcctaattgaaagagtagttatcattttttattttgaatgttatgattaaagatacggccattttgtaccctgaagaaagattatccagagagtttattagaatgtaactcttttaaaatattgttcaagataatagaattctaagtaatgttaatcaggataacatctatgaagacacctaattttagccatcctaacaaaagaaaaagtgtagaaaaaaaattttcctttatatttttcttttactagctctccattttctctatttgtagtttttgtaagcaatagaatcataagcgctctgctagccttcatgctatcttgcatagtttgattttttacttttattatcctctatggatgtatggtggagtaattttctaaatattgtattatattttcagatctgtattataatttagtgaattaattatgagaatgtgtaacttggaaattgatttaatattttttaataatcttctctaagttactcttgaaattcctttttaaaattgtagggtttaatgggaagcaatggctcaccaggccagcctggaacaccgggatctaaggtaaatatgataaaataaacaagactgggaactttgtataatcacagtggccatttataactttgatgaaaattttactactaccttgattgtattttaaatgtggtttttattctatgaaaaaaaatcacttgtaagaattaaatctggaaaggctcagcctaagaaacaggctaaagtaaagctcatcctgttatgttggaaagggtccagaatctcctgctgctcagcccccttctccctttttggtgtcttggtgtctagtattgaggaatactagagctctatagagctcagtgccaaaaccaccagtctagagcattcatagttatgaataagaatatctcttacaatatcagttttctagtcttctttttggtatttttatttagtggaatgtatatagagtgccttgtaaattatactagttctgtgagtaagagcatattatctttacttttagattttaaataagtaaggcaagcttaacaaatatatttaggatatgaggttagttattctcaaggtagaactgaaactctttgaatgtcattatttgaccatttcctagctatatataatcctgtggtacgataactattttgttttcttggttaaccagaggatcagacaaaacactcagaaaactgttcccaactattttgcaaatagattctaggacagccttctaaaaggaagtgatggaattgctattttagaagcagtcaacctttgactaagcattgcctcaggggaatagaccctggcatatgagtagatgacctactctattttacttttaatttctaaagtatttagaaaagagagagaaaaaaaagacatgggagcccaataatgagaaaaggtagctgctcttccatcagtggtagacccttgtggatccttggtgtattgtgggctccagcagctataggtacacacagagttgtgtgtgactgacttgctggaatgactgaacttgctaagcaggtctccacagtttctcaaggtcattttgtaagaaaataccccttattaagtggtgcacaatgggctctctcaatgtcttttggattctctaattcttaagaatgcagcctaaaatttcatcagctttttttttttttattagatacaccacactgttgactcacactgtgttgaaggtcaattgtatctgttggactttccgtaaaaggttttagaacaatgtgtgctgtctaccacttaagcagattctgctgatttggctgggtaggccagtgaggatttccagtatcacagtttgtttatttttacatgaattactctaaagttggttttctgcatcttgtgcttgtacaattattttgttaaaaatagatctaagaagttaaaattacacatattaaaaatacacataatcttttcaataaaatattttaatttttttcttgctgtatattaggtgttggaaactttttctgaaaagggacagaaagtaaatatttcaggcttagagagccatacaagtctctgttgtaactactcaattttatcattatagtgcaaaattggccacaggcaatacctaatcaaatgggtatggggtgtggctatgttctggttaaactttaagaacttgcattgggctggatttaacccatggatcatagtgtactgacctctatattcgtttctttctgctagttttgtcagcttatgtttgtggcttgtgctgtcaatatcactgatagaagttctagggtgagacaaaaacgtattcagtagggcagagataaggctgaaactgaggcagatctttagaaaacctctaatttatattataatacttaaaaatagctgcagaaacatttataagcctatttaactatactatgttttggttttaaaaaaatctgccctttactcggtatgtatccaaaggaatataaatcattctgttacaaagatacaagcacacgtatgttcattgcagcactattcacaatagaaaagacatggaatgaactcaaatgcccatcagtgatagactgcaaaaagaaccatggaatattatgcagccataaaaaacaacgaggtcatgtcctttgccagggatatggatacagctggaagtcattatcctcagcaatctaatgcaggaacagaaaaccaaacatcacacgttctcacttataagtgggagctgaacaatcagaacacatggacacagggagaggaacaacacacactggggcctgttagtaggggagggaggttgggagtggaagagcatcataaaaaatagctaatgcatgctgggcttaatacctaggtgatgggttgataggtgcagcaaaccaccgtggcacatgtttacctatgtaacaaacctgcacatcctgcacatataacccagaacttaaaaagataataattatctaaataatattaaaatatattagctttatcgagtcagataactttcaacaaatctcatgtctgtgaatttcagtttaataacttataaaattagaaattttaaggaatcattctgtggttcaataacactgttatgtgctaaatgctttaattaaatctaatgtgatcttcacatgtttcttaccatgagcagcctacaaaacttttttaaaagctgaaaatggcattggtttgcctcactgattagtaaacccaagttggttgtgggtaattattgtgttccccttctaggtgtcacaccaacctgcttaattatgggcttttgccagacattgggttgtgatatcaggtatcaaagtatttgaaaaccagaactacatttgacaatctctccttattagccagaagacttgttttctctttctctatccacttttccttttctgtattacattctttgccctgtcaactcagccttgtactccaagtttccatctgttagaaagaactgcactggaatcctgaaaaagcacaaactaaacattttctgattcacacttcttcaaaaaaagccattgtgcatttgaagctacttttctttccttcagttgcatactgaagatgagtcctactgagaaagtgagacaggataatgatgaggatctcagcccggaggatgctgttaaagtacatgtctcccacctgtgcaatgtggtggctggacttattagtgctggccactaaagatttgactctcctcccttatacttgaagctaccagctttaacacaggtttttagagaggcttatgaatatgtggaaccccttccttgcctaaaagattttttcatttttcttaatacataggtctaatgtacagagtctatcaaacaatcggaaagttaaaaatgtaaaagttattttacatatattcccttaagtgtctatatcagatatattatgacagaattgtttttaaaaaactccaatgtttttgatgtgttgacagggaagcaaaggtgaacctggaattcaagggatgcctggggcttctgggctcaaggtaattttgatgcatttgaaaatattttcaaagaaattataatgtaaattcccctcattatttaagaaaattaacattttatatctctgaagagatacatgaagttaaggattacctttatcatgaaattaaggtacctgaaatgaaattgtcaatacagtttcatttctgttttttagatactttgtcattggataataaagatataaactttggcttaattttttgaaaaattgtaaaattgtaggcaaacatgaacttactttctggtccagagaatagatttcccttaaacagctgaaaacaggagcatgtagttctcatgaatgatactgttctttgtttgcttatgggagtttcatctttgatatagaactcacaatagcctttaccagtttcctccaaaccacatgggttgatgtttatttcaatgggatttttaatacacttccaaccttcaaaaatctagagaatgatttgatggctaggaagtaagtacagtaagcaaagagaataaagcctccttttcttttaaaaaagagagtgatctttagttgatgttacagagttttggactaacggtaaaacacaaaacgaaacagaaccatgaagcatgttcaggattatgttgcatctcttacaaatatatcctaaatatgtcaatgcattattaacacgtgcttgcaaataatttatttaagactttaaaacaaaaaactttatttcagaaaggacaattcctataggatgatggagagtggagaactggaattaagataactcatgtaatacaccctgtactgaaaaatagctcaagaatttatttctaacaaaataatattccacatatgtaaataaatacatataaataattaaatttaactaccaggatgttcattccaatattttttataaaaacaaaaattgtgaaaactgtaatgtttaacaataagaattttattaaataaaatacagttgataaatatggatactcttccataattaaaacttatgttatgaaaaatatgatagcataagaactttataatattaatatatttagagattaaaagataaaattatgcatgtatatgagcacattttattaactatatatgtgtgtttatgaattagagttagagaaaaaatacataacaaaataaaaatattgggttataagatttttaataatttttattatttctattattttgtaacaagaaaataagctttttttaaagtagcaatttgagaaaaagcagtttcaaggagaataagtgttagtaaataggtaaacaaaaaagagatacttgtgtttattatttttacaactttattatttcgtttattattgaaattataaagtatcataaaaataacaaatatttacagaattttaaaatatgaaatgctgtgagaatttttcaactggaaaagatagagaaaaatacaagaaattttactgggattctagtaaacattttattctttactatttctgtagtagtaactgtcaatacatttttttaaccattcattttaaaattgagatatgtagagataaaaacagtggtgcttttcataagcagtagatctgtgatctttctggaatttctgtgttacatagggagaaccaggagcaacgggttccccaggagaaccaggatacatgggtttacccgggattcaaggaaaaaaggtatgcattggttaggagatacagttcgcttttaaccagttacttgcaaacaagtttttcttttgtgaaattcttaaagtaggacttgttattaatatatttttaatgataaagtaccctatatattcgatgtatgtataatatgttcagccccatgctaatagctgtggcatcttttatatacccacatgggtattgtctcctagatgaagaccttagaaaagacatgcagatcagaaaatatgaatgtacaattaagtaatatcctgtaaattcaggtttttttcacaaaccaggggagctaagaattttttgaggaaaattgtccaatgtcaggcattcctatcaaaatgcaaatacccctcttgccaaaaccggatcaaattctggaaggataaaacttgtgtccaaaatgtttgaccatgaagttcctatctatgaaacaattatgttacatagaagtttatttaaaattaatttaaggagtttaaaaatgcaagtcaaatatactaatttaaaatattttggcaaggaaagacagtaaaactaggttctctctctctcattttggtcaagtaagggaaacttgacttgtatgtatataaataatatatgcttttatttgtttggaggttttgagcaacaattgatgcctgtgtgcctgagaagtccatgctactgcaaatacaaatgtttcaggttaaaagtaaatctatcggtttttattctggaaaagacacaaactcttatgtctccatcttcatgtcccttgctatttatttttcaacatcttattttctatccctcatgtgttgtctacatggtgcctagatcatacacagtatgatccttgggctttttgttctgatgatcagtaggcagcactagctgagacagaagtgtccccacataacagccatcaagtgttagactcttagtaaatgttaagtaaatctactacgaatatatgtttgggatgaagagaattttcttgttcagaacttgttgccatttaaaagaaaatctgtatttttttgttgaaatgcaaaactgtactctatgtttagatagtacggtgaagtattaatagaaaggaaatttggaaaccgtgtccaagtttagctttgggcaggtgcttaactggctgtttcattatctataaaaacaagggcattgtataagttggtttctaatttcccttctagctgataatctataaaacttatttttatggaatataatttttcttccaaaagctcacttttgaaatatatgttttctaaaatagcacttaaatgttatgctttactttatcattgtttcctataaacttgtggctactaatagcttaatggaagattttcagtttgatttcataaaacaacatttgtcaaaataagtcctctcttgttagtttgtctaacctaaaactgtgaaccatgtagaagttttctcctttctgggaaattaaagattgtggtgaaatttctttcaaatgtaggagcatacaaaagtgttcttttacaatatcattttgacataatgtggttctgctcccttcccaagtattgtgttaggagtcaacttctgtgtatacaggcacttgtggagtttgcacgagatgttgtttttcttcagcagagaaaaatatatgtttatttgaaactgtacagaatatgctagattatgatacagatcaaactgcctttttgtagggggacaaaggaaatcaaggtgaaaaaggtattcaggtatgttgtttgcttttttttagtaggctgagcaataaaatcagagcttttaaaaagttcttattttacttttaaattcctttctgtttcaacattaatataaagttgttaaatcctattttctccttttgctattgagcttttcagacaagaccaaatttgactttaaaattcctcaccactttgctgttgcagaaaacttagaaacaaaatgattcaacaaaataaagacataaattttattatatacttctaatatgtatttatatacatatatacatatatatatataccacatacacacacacacacacacatatatatatatatacacacacacagtgtgtttccaaaaatgacttgaaattgttttatggcaaaagtttgataaaaaacctttaaccctaaatataaaacatattcaaatcaatatgtgaaaggaaaattaaaccagaaaattataacaggctagggaaatctagggtgatttagaaagatatttagttttgggtgtcttagcagcaaaggcaaagaggagacctattttactacttcaggagacaaggatagtttcacctcaattaaagtgtctatggaatgggttttttcattcactgaagactgacttttgaataagatgccactagctgagtcaatgaaatagttatctgggataaattatatctgatgttctttcaaccttttaagttttagaaatataaaacttttccaaccataaattaccaatcaagtgttcagacagtattttaatgatgtttttaagtttgtaagtctcagtgatagtgtctgagctttgctatgcagaataagctgaaaatataaagaaaaatactctggacatttccacaaatgtagaattctgaatgctgtagaatttctggaatcgtaacagaaaatttcaaattgaaatagtcataggcaaaacttgctatatccacaattataacagttcctattaatgaacttattcttcataacatacataagatgttttagagtggtatgacaaaattcagttgttttttagacaatttttatcgaaaatcttcaagtactatgatataggattcctttaagttaagattgaagttgggagtgaggtaaatgttaagtaaatgtctgtgagctctagacccatatattctaatttccttcttggtactgcatttagatgactcatgggaacctcaggttcagtatgtccaaaactgaacttgtcatctttccccataaaccgcttcgtactcacagatttcctgtcatgataatcgatgctaaatatctcttgaacttgacaccttctacctctcctgactgtactagttatttcttgtcaggggtcctgggctactgcaatatcttcctaactggtctccttgagtccagtctacttccttcttccacacttttacttgcataaaatagctaagctatatatctgcttaggagtcctttaatcgtgccccacacatgttaagataaagcctgtgccatcaaatgccttctgggctgactgaatcttttttagtgttatctcttgccactccacccattcttatccaatcctgctctgctgctatagccaaaagaaactacctgcctttcacctgtgtcttctctccctgatacaccctcctatcctttctccaattggctacctcttactcacccctcaaggctgcacaaaggatgagtcacattccctaccctttctgtcagatgccccttcctaagttccaataatatccaacccagatgtttaattatacattgtagacttatcagcagtattttcatcattctagatttaattgcttatctctcttaccacacagtgagtgacttgaaggccacaatgatatctttgtttcagtgtccctaagtgccagcaaataggtgctgctcaaaaaatgttagcaattcacttaattaaattgatgaattcattactaggcaagggtgatgtaaaattgtagtcactagatctttcatcgattaccttatctaggtgtatgtcttcctagaaactgctaattattttgcgcaataaatataaggatgaagtagtgcttcagagtctagcataatgtcccatgaatggtagatacccaaaaatacttattgaatagataaatgtgtttatacctttattaatttttctgttatttatgctgctttaaagctcttcatttaaatggctttttttttactaaaatgtgacagtatattttaatttttaaaaataaaattttaaagagatcttcttgtcctcacatgtccatagtcaacaatgaacataattgccactgaaattaataaaatgtccatatacattgactttttaaactattttcccactattaatatggacttagaagaacatcctcattgtctagaattatttacatgtttcacccaaatcagtaatttgttccttatctctgtccactttaactataagattaggatgacttttcttcttctttttcgctgagtaactgattttcccatctctcacataatttatatatttgtatcgctgcttttgttacgtttcttctggaactcaaggtaatacatagtttgtattgcatatgtgattgcatcgtaagtgtgcaaactaatcaataatgtttttttttattttaaagggtcaaaagggagaaaatggaagacagggaattccagggcaacaggtattttttggttttcttctgataaaaaatgaaataacaagtcacataactggacaatgctgagagaggattacttgcaaataaaaatgggtggggagaaggacaatatagtatgcattctaagcatataaggttgaacatgtaggtagtgtggtgataatgagtttctttcattatttgttttgtgttttcactttcccatactgataacactggtggctctgaattttgttttttaatgcgtccaagcaaatgactgcaggtagaaaattccacccatttcttgggggtagttattggccagagacagccagtcacacaatggcagcttgttcatccctgctggtttgtcttgcttttcttcttgaaaatcagttggggccacatgtggtggagaaatgtacttgtttccctttagtttgttcagagagacaatttactgctctggagatatattaaaatgctatcctgagagacagtgttgtagaacagacacacagtaagatggctttgcttctttcttgactaaactgttctcattaggtgatgtttcagtgagattgccatgtgactgtaagttcagtcagagccaaagtggacggacaaaggcataaaggagattggtacttagatagcatgtttgctgctgtgttgcttgtagctgcagaatgctggacatggttccaacttgatcatgtctgaaagggcaagctggatatgtgagtcctcccatggggtggacctctttctctgagggtgagtgggagaaagattctgcaattacaccaactctggagagagtgggataaaactgggtagtgatgtctccaaggacaggggtctctgtgttccttacttggaggagtctgagagaccattgggaagagtgtaagcatagggccccaaggttatctgcaacgtgggatggaaggggagtgccagatgttaagaagaattgagaatttagaagctaacaataaaagtaaaagtaaaagtaaccaagaggaggaatgattggaattgcctgagtacaattatgttcaataaaatgtctttcagttttcatgatcctccacttgactcagacccacttgatgacacaaacaactccatcctattccccaacctggcaacacagatcaactctctgagtttccttaagtcaatcacaaaacatctataaactgctattcccataggaccttcttcccttcatttaacctctacagcccagaccttttatcaaaaaatgttacttacaataactctcagaaaagaaggatatttcctttagaatttgaactcacaacttagctagctcactggcttatggatcacactttctctaagtttccactaactttttcacttctcaaggaaaagagtgtgtgtgctctcctaaggcaggatttgggttccctagaaagcttctgccctagattggttggaagctacatttctcaccaccaggagcttagcctacatggagtacccagggccagagcagctgttgcttttcagcagctgaatagtcatcccaaactcttcatgtaaacacagtcttagttacctgtcactctaccaagcacaacacatgtgtattttttggccctcgttttgtgaatggagtcaaagtgaatatttctctcagagaatcatcttaatgtgttctcagatgacagctctttttagttttagctctaattcaattcccatattgagaacttaactgttttgtctctcttatgttggtcctagttgttggattatatcttgtaaggatcactcccgcatttcttcagaaacaaaattcaagtatgaccatacaaagtttgttttacttactaaaagattcatatataaaaactaaatatttggtgttttatgatgatttttatttaattcttttctttgtctaatttggatagccatgtttgaggagcctgaaaattaatcaacagatataccccaactcagacttcattgtgtgcaacattatacattaaatttcatattaaattgcagaacactgattttttattttaaagttgaataatgaaaacctacctgttattaaagttttatcttttttcctgagtgaatattaggagatttttgagcccaggtgtacaatgaatttcaaaaatggaaaatgttaatacctttcctgagagtttttttcctctataatacaccactgaaataaatatggaaaagaggagtgggagagactttaatggagccatccagatgtagctagtaattatagttgaatgagcttcatgcatgggctccccagtgtttatatcactgtgaaaaaataccatcttttagatgacattgcttctctggtctcttaattactggcagtgaatggtttaagcacaggacagctgggagttttctgtcttactagtcacttttaatggtatctttgctttaacccatcctttgtcaatagcaaccaatcaaaatttaattttaagaacataaacttgggaaaatacactagtcatcttaatcactgaatacaagaaaaaatatacctaatatttaatctgatttgagtttttattattattaaaatagtactatattttaaattcagtagaatcccattcttacccacatgattcaacctgcagcatttgaaaatattcatatctaagaaggaaacagttaagcaaattaaaatttttatattattcagtcaacatatttcctagtcattagccttctctaaaaggcaaaaagggtctgtaattctgtcactaatgctatcaatattttccaaattgaaattttaaatttaattaagtatgtggtaaaaggtggatgccacattacagtactgtagcttgcacatttattatattttttctattaattttcaaagggaattcaaggccatcatggtgcaaaaggagaggtatgtttcttcatatattatgctctcttgctctctttcttcggtcctttttgcttgggtttcaatactatataaatctagcttttgagtaaaaaccagaaaacgaaatgtttttcatcttcttcagtagaagttcccaattaattgttttcagaatatgtacatttatactgaatttgatatgaaatgtgaattgtcaatattattggtttttcttccagacttggagctgaattttttctccatatttttgaataaagaatattgtacatttctgtatctgtcggacccactaaaatgcaagctccttgtgaataggactgtgttatgcccattgttttatctctggcagtatgcgtattacctatacaatatactcaatcagttgtggatacttgtaggtctggctggttggatggatggataaatgacagtttaatatgacatgaaatttcccttctggtcaatgacaatatttccggctattccttacataccttacatatttacatatgtatacatgcatattcacatccttaacgagcttcatgatgcaattatacctcctgaaatatttaaatagaacttgtaaagatttcttttgcttttagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccgtatgtattctgcttctttcacagttattacattttcattgatttttgctcatgttctttatgtgcatgttataacccctaacactttgatgcagggaagagagttttcagaacaatttattcgacaagtttgcacagatgtaataagaggtaggtatcaaatatagcattttaataacttttctcaaattacaaaagtaatacaaattcttaggacatattgtagaggatataagtgaggtgaagaagaaaacagataacatttataagcctcatctacttttcttcaatgagtatttttataaagatttatcatatatactcttttataatctttttaataaagacatttattattttgccattatttgaattttcttttgtagcatattttttgataatttagttcataaatatgaatatagtccaccaatttcttttgggggcactttcactttttcccctattttaagcaattgctctaataaaattaccgcacagagcaatgaatatttccatagtcaaattcctagaagtgaaattattggccaagaaatatgcacatattcaatgttcgtagttttttctctgtaaactgaaaaaaattaaaaatataattaacaccaactcaccatttaaacataagggatggggtttctttgtttttgaaagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggtatgcagttagtttcaacaagaaaatgaattttaaaaagtctttttttaaaaattcataccctatatccatttaatagtcgagttaacttttttcatgataaaaaaatctgtaaatgctcgtctttaaataatttgccaactgaattaaagagaaattattttcttaatgcaatattctcaaaaagagaagtcaaatttatgaacacataaacttacaaattagaaaatgttgccaatgtactgagaaattttgcttgagtctagaaaagtttttaaatagaaaatcacagatgccatttcctttattttgactttggtaactttctgcactgttaccttattcatttttttttctattataggaaaaaataagttttgtgataaaacttcctaatagcccagaatttctccttgcctttgaatgtttatgtgaaatgttgattgataattctttcctttttgtttaatagtatataagcaatttagatgtttcataaagtaattttaaaaaactatgattaacacaaagggctaataattccaaaccattttcttttctaaatatttgattcccattaagtcttggatctaaaccactgatcattttagaaattattgcttcaaaacttgttttccattagtaagaaaaaatagatggcaagctggtttttaaaagacatttttctttcatgtgtatattaacagctttgaatgaaacaatctagaaggcagtgattttaagtaaacttactcagatgtttgacaccctgcaggcctaccaggaagaaatggggaaaaagggagccaagggtttgggtatcctggagaacaaggtcctcctggtcccccaggtgagaattgctacctgctcataagtgttactgctcattttgctttaagaaaagtcatcatagatctatgtgaaataaattgaaactgagacatctgttttcttttttgagtgattcacatttaacacactgaagtctaacttctggaatattttttcatatattatcctcaatttatgaatccttcaatattatctcttgcttatcatttagatagtttaatatctattccttagaagagttctagaatcattttagtcacccctgcttatctggtgtataacactgtttagtctttatgactctcagggaagcagagaaatgctgaagcggttaagtaatctctgctagctgtgcagtttaactctgccatgtctcagtttcctcattggtaaaatggtgatgataatgttatctccatcatgacgttattgggagattaaatactttctatatgtagtgctttcagaacagtgcaagacaatcacagttatgttttcaataaatgtatgctatgattagatgttattaataggctttggagttgatcaaatgacttaatactatttatgtaaaatactttgaacaacacttacaattgcagttaagtggtaaatagatgtttattagtagtagtagcagggagtagaggagtaagaagtggcccaaaccactgtgctccttcccaaaatctgaatattttttgttattttgaatcaactttaaaaggccagtatggtaagctagcttttgtttccttgagcatgctaattgaactaatcaggctatgtttgacaaattagggctttaatacctatgagtattgatgatattgatgactataatactaaagtaataagaataatgcatttagatatggaaactaaaaatatgtataatagaaacagttttttgttgcaaatacggcacaaaaatgactcagctttggcttacgtaggtatcacctgttaatttataataatattggtaaaagataggctgaaaggaagaaataagattggacaatacacaaaatggaatattataatgttagctaaatgttttaatcagtagcatggttactatgttaatatgcttagcctagttttcaaaaattactgataactttaacttttggatggttcttttcaaagcagaagacatgtagaattatcaagaaaatgcctctactatataattagtgcaaatatataaaatattcaaggttttttttttcagtttaagtttcttgcagaattggctatttcattataaaaaactaaagtcctctgtttacgtcttgccaatgtcccatcttaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctg

SEQ ID NO: 36968 - DNA, 15827 bp, Homo sapiens
gcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattgtgagtgcggggcggccagggtcctacgtccgtgcctggacacacgacttcaccccgcacgttcctcgtgcgggtcgcaggctccccaggactgcgcctccgagttgcggagcgagcgtccccgacttctgcagctccccaaactcttgggatctgccgccagcttggtcccaccccctcgtctcttacccgtgaatgttaagtttcttctggggtgcaccctcgtttcgtttcttgggttgtggtgcgcccaaagggttagtgccaatgcgaattctgacatttttcatgactttgaggatgcgactggggcgcggggagggaggtgtccgactcgtgtctaagtagttaaagtgattcttcacagacttctacacttattttcaccacattttacataagagaatattgagcaaaatttctcctctcgttttgtctgtccttaaaagatagtctctttatggtgttggaatttggcgcttttaagctttttttaatggattgggtacgtttcttttttattgtaaatactgagtcaattcaagttgggttatttttaagttttcgttttctctttttgcctcctcttttgctttctctttttttcactcctcatctcatttttcctttgggtgtctttgtagtgtagagaataccttgggttgtgactcctaggtctttgtaaatggtattacattaaaagataatgtattaatgtatacactctcaagagcgccaggtcatcatttattgctcgaacgaaatcatgtattttgtgtggtgatttcaatttaataatatctgttctgccgcggtgggaaataaagtatctgtctttgctttagatgctaagtcgttgttgatggtggtattatacatattagcagtatttactgataatagtaaaagcataattattaacagtgtactggacaccactaagcacctttacacgaataccatatttaattccctacaaattctctatgacaggtgtttttcacgttttacaaatgagtaacaagatacctaaatactttagttaacctatgcagatattgctgtgctggctttctttgggtcttcagagtaggcatacaataattgttgttagaacaccttcttctttaaaaaggttcagctggaagtggcgtacgctacccaggagattgaggtatgaggatgacttgagcccaggggttcaagagatcctgggcaactagcaaaataaataagtaaataaataaaaatgaaaagacaacagggttcaggtgagtgttttcttgtgtcacgaatacagcaagggttgtcaagttaaggaggccagtgaaagtgacatccccaagggagaacccagaaggctaaatcagtaagtcctgtgttattttttaaaaaaacaaaactggccggcgcggtggctcacgcctgtaatcccagcactttgggaggccgaggccggtggatcacgaggtgaggagatcgagaccatcctggctaacacggtgaaacgccgtttgtactaaaaatacaaaaaattacctgggcgtggtggcacgcgcctgtagtcccagctactcgggaggctgaggcagaagaatcgcttgaatctgggagtcagaggttgcagtgagccgaggtcgcaccactgcactccagcctgggcgacagagtgagactcaatctcaaaaaaaaagtagaacatttatatggagggtaagataaagggaaattttcatagtatgcatgtagtctgcaattctgaaatgaattttcattcaggcaccattgaaagcttcaggggagaggaactgtgacactttttcagtcatcatcatgagtaacttgttttagatcgtgcctgtaaaatagtgttataagcaatatattaagcaatagtgatcgtgtgtgtatatgcaaaatacagtcaagtattactcaaggatattttttaactcattatggtccaactatataaatacagcaatcagaagtagtattaaggagaacaagactaacaaaacattgagtatgaggtaaatccacattggagcatctatctgaaattatgctatagagtagtagtttttctttttccttaagtagagattctaaagtaagtttttagaaagcaactgacagcctgggcaacatggcaaaaaccagtctctacaaaaaaatacgaaaaattagctgggcgtgtgggcaggcatctgtagtcccagctacttgggctgaggtgggaggatgtcttgagcccgggaggttgaggttgcagtgagcccagatggcgccactgccctccagcctgggtaacaaagcgagaccctgtttcaaaaaataaaaaagcaactgagcaacaaaacgaacctgaaaaagaaggactctagtagttttagtaatagtctgctcctaattacaagtgaattatctacagtaaatccatttctgctcagaagttttgtcatggagatattttcattgtaatacgatttattgttaggagcttggcttttatactaccagtttgtcttgttctacaatgtctattttaggagtttggttttcataaaacaagtgaagaaaatgtgaagtacagaaagtatagttttgtgtttaactgctttaggctttattcttcctggttctgttaaaaaaaaaaaaaaaaaaagaacaaccctgtggtgtattataagataaaatacaataaagtggaaaaataagatcctcaggagataataccagaggagtaatttaaatgctaatatgcttgcatttgtaaatccaaggtcttggaaacaggatgacctaactggccaagagttttgtttggcctgcttagtatttgtgtgtgggttattttttgaggtaacattctcatataaaaatgcagctctccatcttcttttaaatatgaatagccagccttagtgtgccagcatccttagtggcaatcctacttaataatggttgccactttaagatggaatatgtgctttcttattcaccacagcccaggacacttctgtttttccaacaccttgcatttgtgactctgcattataaattattaaaattggtaagctctaactttggtcttgagctttctggtggccacaccgttaatagagaaatgcaaaagttttctaaagagctgttttgcatgtgaaaaaatcctgtgtcttattctcagaattttatttgattagcatcatcagttcatcattcttgatttccggattgttagatctacccttaaaagtttttcatctgcataaaattaaccaccttatcatcttcagtgttttcatatgaaatattcttcataaattatacatttaaattttttatcccaagataaatggtcatactaaagtgcttaactttttttaaaaaaaaatctgtatttcttagttatgccccgtggtgccctgcttgtcaaaatcttcaaccggaatgggaaagttttgctgaatggggagaagatcttgaggttaatattgcgaaagtagatgtcacagagcagccaggtactgtaagtctttggttagttttgtttctttgctgtttgggttgatatatttatccttttttctacattgcatagtcttaattctacctttctttaggttttgaaaacctaacagtctgcagctagttaacctgacttgtccacctccctgctgggggctcagtgtgcaatggttgcaaaatggagattccctggttgtgtatacacctcatttcttgaatgtgttgctttaagggttcttgaagacattaccctctttttattcttgcccacataactgcctctgatttgttgttctttgcatcccaggccccagactagtatgtaagatgcctttgagaagtcctaggacactgtggttcaggtgaacattggccaagccacatttgcatccataccaggcttcagaataaggagcatgtggttgagtgtttttctggagtcaaggtcacgttccctgacaaaagaagacctgaatctctgaaattgagttttaaatttagtacctatgatttgaggatgtgggcttctaaatataaagccctcgtggttgtgaggtcaagtgcactcctgacttggtccctggacaagtggcaggtcctgcccttaaggaggttccttccacagaccaatctcatcttaccgttctcggtagtcacactacccttggattcttggctgtcccatcccaaatggtaataataggtaatatttatcgagcgcttgcctattatagcactcttccaaatatcttgtgtttattatttaatccttatacaaccccgtgaaatatgtaatgtccccatttcacagataagaaaactgaggcacaggtcaattctctgtaatatcagtgcttgacacatggctaacaataaatgttagctgctattatttttgcctgtctcatgaaagattcatagtattttccatttttagcagcaccataaactgcctttgtttgttgaatgtcaagtacaattccattggattttagatctaagaccctattaccttgtgctctcccatgagcacaaggtgctcttattactagtagtcttaattttgacagtgatataaatgttgaagtgtttttatttaaaaatgtattcagtactctagttctacatactttttaactgagataatgtgcagtattgtgttttttaaagttgctttaagtacataattcatttttaaattatgtattacgaagctcaactattaggtataatttcatattctttcctattagtatgtatttaaataattcaaagtcacgttttaagtagtcagtgattggcctatgtaaaacctgctgtgtgttctttatttgtaggactgagtggacggtttatcataactgctcttcctactatttatcagtaagtatttgaagattctaaattatggagaaggatgcattatagtgtaatcagaagtagtaggcctctggcttggatcatgctggaagagctgaggtaatctcattatattcagcaggtattttagagggcttgttttgcttagtgttatcctaggtgcctttaggtagttgagtgatgtgtgaaacagtctctgttctcaaagatttacagttgttttggaaagtgatgttcttgtgaaatggtgtgatcctgttcagcgtgttaagtcattatgcatccaaagtagtggtgagtcctgtaggtaattggataaaggagaaatcacagttacctggattggttcccagagaatatggggtttaaatgaaaccttggaagtagaattttaagagtggagcgtaagcattttattgtgaggacaatctcataaacagtcattaacaggaacatgttatgtccaaaaagtagctaagaaagtgctgttgtacagccttgggtagagtaataggtgacagttgggtaataaaacagaatgagcaagattatgtagtcttcagtgtcaggtctattagtttgactttatcttctaaattgagggtatgaaatctcaagtctgtgtaccccaacatcatgtagctggtaggttaaataccaggaggtactgaaaataagttgacaattctttgtatttatagcttgcttttctttgcccttttttcttttttttatggttttaaaattcacccctactccctttacatctatataaatttctgttcgctgtctccataagtgcttctgtcctgcccttctcattcagtccttttccccacgtgccccttcagtctctccctttgcttttcacttcttagtgccctgtgaccttatttggaatttcctgccctttttcttttagtcaaaattgtttaccatatcctttctcctgtttcctgcctgtcgaaatcttacctatgcttcaaataatagctcaaatgacacttcacaaaaactttgtgttttggggtggggggcttcctcgtggtttttacctctgagtggataaagggtcccttaaccctacttaacaggtccctagtagggagctgatgagtttttgcacttaaagatgttggagccaagagaacatttgtgactctgacagaactttctacattgggaatgggaaggaggaggtggatctaaggaaggctgcaaagctcactaaatagtcactgaaatgagaggaagggaagcaccataccagatgcctccagtgatttaaagcagggtgtctgaggtgatgctattatagccaaaagtactagaaaaatgccttaaaattttaagttatagcttaacagctaataattactatgtgccaagcactattctaataatttttatataattcttttaatatgtgtattacacataaggcttaaaagtactttcctgagatttatctacttactgtatttcatagtttcattacttggaagaataacagtaattacattttaaggcttatgatttaaaaaaatgtaacctcattgttaaattgggggctaaaatgtcatgagtaggtaaatagtataatttgctattaatacttgtacattgctaatgcttttgaatgttagaattgactgtaaagtgaagtgaaaaaatagcaaaataaatattaaattatttctcagtgctggataatatttaattctgattctctttagttgtaaagatggtgaatttaggcgctatcagggtccaaggactaagaaggacttcataaactttataagtgataaagagtggaagagtattgagcccgtttcatcatggtttggtccaggttctgttctgtaagtatgagggctttttctcttacccatttcataattaattggaacagataattatattttatgtaaagcattcatactcagtttgtttcttgagctgttaaggtatatccacatttattacatgtttgattttttttttttttttttttttgagatggagtcttgctctgtcgcccaggctggagtgcagtggcgcaatctcggctcactgcaagctctgcctcctgggttcacgccattctcctgcctcagcctcccgagtagctgggactacaggtgcccaccgccacacgtggctaatttttttgtatttttagtagagacggggtttcactgtgttagccaggatggtcttgatctcctgacctcgtgatttgcccacctcggcctcccagagtgctgggattacaggtgtgagccactatgcacggcctacatgtttgatctttttagtttgaccttctaagtcaaacatattttcatgcttcttgagttagagaaggcattttatagaagtaagttgtacaccttttcaggaatattttagcttgctagatttggtcatatgtatcatcaaaaactaaatgcccctaagagtcttcacagtgtaatgggtaaagctatcactcgagtgtaataatttgaatgagtaggctcaaacttgtactcatgctacctccagacttcaatttgtcttttaatgttctgtctccatagagaccgtcaataattgccgataccaactaaattaattacataaacttcaactcttgatgtcaagcgactgaattatgtttggttggttattccacctgtctgataacttcttatatgaatagtgtgtataaacggtgaccgtaatagtgtgcctaagcactgagctttatagatatctagagggtagatgaatttcctcgtagcaactggctatggagtgataaggattggaagtagcaagcatgctttctgctttgctgttggagtacaaggcctcactggtcatgtgagagacctctgggaacagtgagttttgctgaggtcaccatggactgatcctgtgtggccatctgtctcttcctgtcctctcaccacacttacctttggaggatagggagttgggacagtaatcacataagagaaaaatgctctagattctggggatgggagaaagattagccctgttaacactcacccattgaactaccatgcccaactcaattttggatcctactgtttctgaaataaattactgcagactacagtgaggctatacagtgctttatgtttcagttccttgtttctcttctcacttggcttttaaacaacagaagcaacatgattaaaatacctttctgtgtcgaactaaaagtataactgatttttgttctctgaaatctcatctcataaatgaatcttgtccttccagtagaagaaagtagttgcttgtaagtctattttcaagcagctacaattgggaactcacagacctttcttatttctgaaacatgcctttttaaaactggccatttaattatgtaaaatactaatttttgcttatatgatgacttagcatttatttcctatgtaataattttgtatatcattaaaagatgtcaaactaatgctcttgtaaattttaattaatttcaataaaaaagagggatagttcttaaatggaaagaattggcttgacaattgtttccagtccttactttagcctccctttggtcttgctttgaaggcttttaagggtgagtaagagttgccttttccaactggtttcatggaacttgtaaccctttactcagtgtattggagaaatcatcagatgaaatacaaaatattaacatcaaaacagtgggagaaaaggaaaaaaatactgtcaagtatttttatttatgaggctgtcacatggtagtgtcaatttagaaacagttttcatgaagaaggcttattacaggcatgaaatcagtgatgtgtcactagtcttgattaacagcaataaaatctgtcatattggggaaattatagagtagaaaatagtatgtatagacaaatctgtgtatgttactcagttttttaatcatctcttttatttttaggatgagtagtatgtcagcactctttcagctatctatgtggatcagggtatggactaaaatatttttatcttaaacatttttaccactatcactttaacaaaaatgaacagatttttagtttttttttttcttttgattttagacttgccataactactttattgaagaccttggattgccagtgtggggatcatatactgtttttgctttagcaactctgttttccggactgttattaggactcgtaagtatttcatttttggagtgctaggaagaaagatatttaaaaatgtgattatttaaaatagttacattagctgtggcatatattctacattcagatttcttacaatgtttatttttacagtgtatgatatttgtggcagattgcctttgtccttcaaaaaggcgcagaccacagccgtacccatacccttcaagtaagtatattttaaaatgtttattttttattcacgatagtcctattcatttctgtaatcacaatcacacatttcacaggttgctcttccagcttagaattctaactgtggattgttggtctttatcagctatggcataaaggaaggtagaggagatgtatatttcatataagaatgtagcccagtggattttggaacattgttattttcttgactcttatattatggggaattttaacattgcatatagcatgtagctatttaataatatttatttggtgtcgttttataagtggagtatattctactcttgaagtctttcattagtataccggccgccacatttgaagattattctttgaatgccagccaactgtaagttttttctggtaggatattgggaaaagcaatccctatagttgatttaggatgccactgacactgaactgtactacagaacaatttaaataattacaagcatttaccaatcttgtaattgtactgttaatggaagcatttatatttgcagttcttaaagaacttttacttatctgttacctcgtttgctcttcagcacctctgtagtagagtgcataggtgttactgctcccattttgtacttgaggagactaaggttcacagtcacacagaagtgacaaagctgattttaactaaatcagacttgtggcctgatattccttcatttattatgtcttttgtttgtttgtttgtttgtttgtttttgagacggagtctcgctctgttgcccaggctggagtgcagtggcgcgatcttggctcactgcaacctctgccttccgggttcatgctattctcctgccttgccctgccgagtagctgggactacaggtgcccaccaccacgcccggctaattttttgtgtttttagtagagacggggtttcactgtgttagccaggatggtctcgatctcctgacctcgtgatccgccagcctcggcctcccaaagtgctgggattacaggcgtgagccactgcgcccagccatgatgtctttcttaacttagcttattgagatcaaaatttccgaaatgaagtctatggagattgaatttatagtgtaccttgtcctttcatactggtaggtcatcttttcatttcttagatagttgcattgatactaaaaaggacatgcataggggatggaatcattttatccaaaaagggccactgatgtctaggaaaaaaacgtaagcacagattacttaaaagacaaatgtattgttaggtttaaggtttttgaagtgaaatgaatataaaatgtttactcaccaacttttaaattgtgaataaaatgtaagatataatttagtagatacaaaagatagatatataaaagtagctataccgatggtccctgacctacaatcattcaacttaaaattgactttacgatggtgcaaaatgaatatgcgttcagtagaaaccgtactttaaattttgaattttgacctattctgggctactggtatggagtacttttgtgatgctgggcagattaggttaggttaggtgtattaatgtatttcaacttatgtaaggataggttagttgtattaaatgcctttttgacttatgatattttcagcttatgatgatttatcagggtataaccccatcataagtcaaggagcatctgtattatgttttgtttttttatattctgtcttcaccctcacataaatcatatggccgtcagaaaatccgttgtgtgataagtgtgcaactagcattggatcccataaatgtaccaaagtacctactaagtcatgtgatgtgcaggctgttactgccactgttgccaggtcgtcctcctgtctcccaagagtttactttgggagtctgcatagattgatttctctgaggatgtaggtgttggagtctgagtcatcttaccacttagagcaaacttgagagtgtctgagacttgcccgaagaacttgttcaaacagattgctgattccccaccctgggttttggactcagaagttctgtattggggccaagaatttccatttcttaaaattcccaggtgaagttgatgttgctggtctgaggaccactatttgagaacccctgtcttagagaaagtggttaccaatgggaaaatctataggccccggggcctgaaataacttgtcttttggtgttgaccatacaaactttttaaaagaatactgactctgatagaatcctttctgtgcaatatcgtggaatacgtaactggtgtacacaaagaggtaagtgttctcaaacaagatgggtaagtcagtgaataggcacaattttagaaactttaaaagagttgaacctaaggaaatgacagagataatactctacctcttttaggaagttacaagggaattcatttcttggaaatgaaatttttaaaatgacttggctaattaatgtcaagctacttaagtttttctgtcctctattatgatccacagtaaaagtcactaaagaaatctttccctttaaatatctgttaatttggagggattgaaaggtataaagtaaagggttttttgaatgcctttccaaatcattcaaaaagaaggcaagcatggtctatgagccagagagatctgattgggcatcccaactctaccacttagtagcaaagcagtatgacagacattttttaccctctgagcgtgtaacctcctttgtgaaatgaaagtaattaaatttgcccctttggatcattatgacacttaggagataggtatgtaatgctcacattatcctagtaacatataagcagtaagcactatgtatatgattgtgtaatttatttttctttagtaatacaactgatattaatccagactttaaagtgatattgccatgccccttccgtaatggaacacatgatttgaattgtttttcagtatgtgtgcttgtcttgattttgagttgctagggttgctaaggaaacccaactcaatctactgttaagcaaaattggaatttattggtttatgtagggatgaagtctgaggtcagggttgactggatccttaaggctcaaatgatgttgttaagatgctgtttctgagttactcagttctccacaccttgacttgttcaattctcagttgagtgtttagaattttttattttttatttttctagtttttttctgctcacaaggacatctggatcagtttggccctttccagtcactagcataaggtggttagagaaaaccatagtcacaatctaagaataagaaggaaattcattttttttctacacccacctattttttggagaaattctggtgcactctgcttgtgtaaaggtctcattttttggaaaccagggtttctcagccttgacactattgacgtttttggccagatgattcttagttgtgatggactgccttttatacactgttgaatatttaatagcattctacttgccaatagcactgcccttctgaggtgtgaaaaaacaaatatctctagacattgttaagtgttccttgaggagggcgagaacttacccttggtagggaaccactgctgtaaactagtattcaccaggaccgcctggggtgtggcatagaaaaggggctgttagcccaaaataaagatggatgccaggcagactaaacaacagatggttcattactggtaatttttccccatggtttattctgccttattaacccaatccttccttgcgggtgtcccctccctggccccaccattcttgattgcctaggattgggggcagtctgagatcattgaacagagtaaagctctttgacccagttctgtctcctgtatctcaccatggtgtgctctaagcttaagttaactagcagctggccatataaaacatcgaaagggtgtgtatttattcattgagatgtacacttaagatttgtacattttattcttgtaactatgttgtaataaaatcatacatatgggggatgagtaaggggaagcacatttataagaccagaagaagatatggacagaaatacaaccttcaactgtaaatgtgtgatttctgttcccctgggaactgaaacaaggatactgtttaagttttagtatacttgttgaccagaagtttaatagcaaattaatatgagatagtttttttaaaaggcagtcaaatttagcagtgggggttgtgtatcaccattagtgacagtaatagtaagttctgataacctactaccattggaccaaccagttttttttaatgctgtatattttctcacaacttccatattcacaacattaatgctgattcattaatttcagttcagtttataaataggtgggtaattagaatgactttgataactaaaatggctcaaacaatttttatttttataatattcatggttttttttatcttatcttgaataactttccttttggacatccaaacatgataaatttatgccaaagcagttttggggcatatgagacattgtatcttgattttactctaaagcaaatctaatacatcaacaaaaatacatttttggtctttgtctttaagaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaa

SEQ ID NO: 36969 - DNA, 43167 bp, Homo sapiens
aaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccggtaaccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaaggtgagcaacggggatcccgagcaggcggccctaggcggtttggagctcccggaccctcgcccaaccgccgtcgggggcactggattcgggcgggctctccgccctggcctctccgaacctgatccctgatcattaaaatgggaatgagtgtaataccaccttcctgcaacaaggctgtcattggctgtcactgggatagtgagtcggccgagtgcggtggctcatgcctgtaattccagcactttgggaggccgaggcgggcggatcacgaggtcaggagttcgagaccagccttgtcaacatggagaaatccccgtctctaccaaaaacacacacacaaaattagccaggcgtggtagtgggtgactgtaatcccacctacttgggaggctgaggcaggagaatcgctagaacccaggaaccagaggttgcaatgagccaagaccacgccattacactccaccctggacaacaagaaagaaatcacgtctcagaaaaaaaaaaaaaaaaaaaaaaactgggatggtgggccgggtgcagtggctcacgcctgtaatcccagcagtttgggaggccaaggcgggagcatcatttgaggccaggaattcaagaccagcctgggcaatatagcaaggaccccatctcttaaaaaaaaaaaacaaaaaacaaaacaaaaaaaaaactgcctgtacataataggaatgttcatcgatatcctggggcacaaaaatacaattccttgccctcgtgcagtttacattccagtagggcgggggtccccaaccccctgtgcacagactagtacctgcctgtccatggggtccccaacccactgtccacagctggcctgttaggaaccgggccacaaagcagcaggaggtgagcggtggccgatagaacgttaccccctgagctccacctaggcattagattctcataggaatgtgccaaacctattgtgagccctattgtgaactttgcatacgagggtcctaggtggcatgctgcttatgagactctaatgataaatgtaatgcacttgaatcaccccgaaaccatccccccagcccttctcccagtcagtggaaagattatctaacacgaaaccggtccctggtgccaacggttggggaccgctgcaataggggaataaaaaggctgattatccctatcatccttaccatttactgagaactaaatatacttcattcatcccttcagtcgttcattgggcttttttgtttgtttttgtgtttgagacagggtctctgctctgctggactcaggctggactacagtggtgtgacaaggatcctcctgtctctgcctcttacaggcatgagccactgcacccagctattcattggtttttattgtctgccatgtgctggggcactgacctaggtgcttggggtacatcagtgaatcaagttcactgccctagtaggtcttatattctagtgggcagagacaaatgataaaaataagttataatatgtgagagagggattagggatgtgatttttttttttttttttttttttgaggtggagtctccctctgttgcccaggctggatttggctcactgcaacttttgcctcccaggttgaagtgatcctcccacctcagttccaccaattagatgggactacagatgtgtgccactgtgccagctaatttttcttttttttgtagagacggggttttgccatgttgcccaggctggtcttgaactcctggacttaagcgatctgtccaccttggcctctgcaagttctgggattacaggcatgagccactgcttttttttgtttttttttcgtttgtttttttttaaagagagacagggtctccaactcctgggatcaggagattcacctgcctcagcctcccatagtgctggggattacatgtgtgagccactgcacccagctgaaaattttttttattaaagtgggattccagtttttttgcctatcaaatttgcaaaaaaatgtttaatgtttatgtggttagtgtaaggagattgacaatcacatattttgttatgttgaaacaatctcaaacttttagaaaagttgtaagaatagtatcaaaacctcccctcaaccaacatttgaaagtagttgctgacacaatggtctttttctacccaccctcaagatattttattatatattctctataaacctacataatcacaatgcaaccatcaaaattggaaattaccatggatatatcatgaccatctactcctcagatgccatccaaattttctgtagttgtttgaataacgctttttagcaataagatccagtctagaattgtgttaaatttaattgtcatgtctccatcaaacagttccttagtcttcccttgatattcatgactttactgcatttgaataatcctgggccaattattttgttgaatgtcccttaaattagatttgtctgtttcttcattgattagattcaggttatatacatctttagcaggaatatcacaggagtgatactctgctcccttgcagattgtacacaatttgatttgtcccattattggtgatattaaccttgataactagattaagatagtttctactaaagttctctaaagttatctttttctctgtgtaattttcattcttatttttttgagacaggatcttgctatattgcccaggctagtctggaattcctgggctaaagcaatcctcccacctcagcctcagtgtagctgaggttacaggcccaagccactgctcccagctgtctgtaatgtgcttcctcaaacactttgggcttatgcatttacttttttatcagtatgatgaactcagtggtacctattttgttcagtgtgttactatcttttactggattgtgatgctttaaatatccaagattttgtcattaagctagcttctgtggccttttgacatgacaacatcattctttgagcatgtcattactttctggcacaagaagatattccaggctcatatgtgctttccctgccccaagcctggaatcagtcatttctcttagggtacctggttctttttagtgtagaatgatatttagatttgggtgctatggtgatgttaatacagatgcttcttcacttaaaataagattacgtcccaataaatccatcgtaaattgaaaattttgtaagttgaaagtgtatacacacacacatacttacatttaaatatttttctgtattttacttatgtgaattcacatcagtatctccactttaatccaaatccagtaatacagggttcattctattcattctagttttctcctttttttttttcttttgagacaaaagtcttgccctgtcacccaggctggagtgcagtggcatgatctctgctcattgcaacctctccctcccagcgattctcctacctcagcctcctgagtagctgggattacaggcacccaccaccacgcctggctaatttttgtacatttagtggagatggcgtttgaccatgttggctggtctcaaattcatgacctcaagtgatctgcccacctcggcttcgcaaagtgttgggattacaggcgtgaaccaccgcgcccagtccattttcatatttgtaacttccttcactaacaatgagaaacccgacacccaacatcttcagtatatttgatcaatccttattgctgccgctgacccaccctcacaccctcttgactctgcttaggctctgtcaccctgcactggctccatcaccttgtaccaggtcatcttcctttgtgagcaccctcatcctatgacaggtggctgccaccatccctctcaggtttataccctcatcctgttcaggctttaaaccctgcaacaggccactactgtccctcagcattgatgccctccttaccctaaatagtttctgacatctgatgtcaggactcactgccctcccttccttcctgtatgggtgacgtccttgtgctgctgaggctttgacaccccacaccagagcaccctcctgcatgaatgtcctcagcttctgctcctagtcctggactgtctcctctacaggacaccttcctcacccaactcaggctcttgacatcccatgcctggcaaccagggttactcaccgccatatagactccatcttgctcagtctcaccttattaatctcatgtttttatttggtaaaaacaaactggcatattctttcaggagttcatttgaaccaggaattgatcctaagaaagtagatagatgtacaaaggtgtctgtacaaggatgttcatcataatgttgtttgtaatttaaaaaaccagtgttatcaatagggaatgtttttcagatatattataaattttcaggtaaatttagaaaatggactattattcaagtattaaaattgattttttttaactgatatggaaagatacagcttaagttcgggagtagggagttggtttcaaaaaagaatgattgataaaatccactgcgggctgtatagtatagagataagcctgcattccagtcttggttctatcatttatctgtctctccaatttatctgtaaaatggggatgatagtagtacacacttacaaagttgtgagaattaaatgatttaatgcatgtaaaatgatcagaactgtgtttcgctaatgtaagagtttaacattagcttaaggccatgggaatacattagcaataatatctaatgtttattaagtacttatgtcaggtactagcctcagtacattgtacttgaactatttcattggtcctcccaattatttaatgagataaaattataattactctctagatgaggaaactgagtcttagaaaggctatggcactggtccaagatgatgatgatggtccaaggctatggcactggtccaagcctggtgtttgaactcaggtagtatgactagggcttgagcttctaaccgctatgctctgctgcctcgcagaccaaaacgaaagtggtgattacctctaagttgtacttttattttaattatctctgaggtgacttttattttcgtttctctgtatcatttattttacaattctctgttaatgagtcttttgtaacaaacacgaattactttattaaacaaatataggctgggcgtggtgactataggccgggcgtggtggctcatgcttgtaatcccagcactttgggaggctgaggagagcagatcgcttgagctcaggagctcgagaccagcctgggcaacatggtaaaaactcatctctaccaaaaatacaaaaaaaattagccaggtgtggtggcatacatctgtggtcccagctactcaggacactgaggcaggaggatcgcttgagcctgggaggcagaggttgtagtgagcaaagatagcgccactgtactccatcctgggtgacagagtgagactctgtctcagaaaagaaaaaaacaagtataagttcaaagcctttttaaaggggttgggagctttgctgaactcttgttgcccaggggataaattctgattcattagcttaggccgcattgatctatgatctggctcctgcttccctctcctcatacctccactactatgcaacatgcaatcctggctccttgccaaaccatactacatgttgaatgcgatgttccctccaacatggcattgttttcaaggctcagcctcagtattttcatctcagtagccttccccaaactctctaacccctaaggcagttagactccttgttctcatagctttgtaatagcacttacccacactgtgttggaattagctattgctttctctccctagtagaatggactctttgagagcatgaattatgctttatttatcctattcctagcatgtaaccaagtatctataattcagttttgtgtcaatgataattactttattaataatgtcatacctaccacatattgttattttaggccatcattttcaattaattagcacttccttatgttagaatatacctgtatgttaaagtaatcagaagctagaataatttaacttgctttgttggtattcttgataaccaataatggcttgctacgccctgattaatctttgcagaaagcccgcttatctaccattttatttactgacaactgtgaagtaacccatgaccagctgtgtgaattgctgaagtatgcagttctgggcaaatccaatgttccaaaacccaggtatgagatgaatttaaatggtgggtattgaccagcggtttcttttttttttttttttttttacctctcccaagctccatcattcaaaccagaggtttcaaactggcttatcgacagtatttttttgctatgcagcatgtcctgaattttttatgatggctgccaagtgttaattctggaaattcctatataaaaatctacattttcttcttccaaaaactcaaagatggcagctatccctatattcccacatggcaataatttgtcaaagctgagtggtggtctccccctttatatgggacatgtatactacaatgtcctacctggcctgcttcccatatttacagtatctgtctggctactatagatattttagtttgtttcccgtgttgcagactcagctgaaataacaatgatctgtgaagaattccagttaatcttttttctttcttttacaaataaaaggcaaagagagccccggcatagtggctcacagttataatcccagcactttgggaggccaaggtgtgaggatcacttgagtcccagagtctgagaccagcctgggcaacatagcgagactcaggccctacaaaaaaaaaagagaatcttactgttctgatattgttggtgccattattaagtgtcttatgaaaaatattttgtatgtatgcaaataatacacacgtctttctgggggaggttgttatgaattggctagctacttcgagaactgtcttctccatcaacaattacagccatcagtctgtcagtttatctaaaactgtttttttttttttttggtaggttttatgtctctattgcaactacccaacttggccattgtagcccaaagcagccatacataacacatagacaaataagcatgactgtagttcaatagtcttatttacaaaaatgggtggagcaggatttgacatttttttggtgggggatggagcctcgctctgtcacctaggctggagtgcagtggcacgatctccgctcaatgcaacctccacctcccaggttcaagtgatcctcttgcctcagcctccagagtagctaggattgtaggctcatacaaccaggcccagctaatttttttgtattttttttagtagagatggggtttcgccatgttgcccaggttggtcttgaactcctgacctcaagtcatccacctgcctcggcctcccaaagtgctgggattacaggcgtgagtcaccgtgcccagcgaaaactgaatttcttaaagccagccatttgattccctggtttaggaaggaccgcagagtaggttggtatcttagggatgactttgtaaagtgagcttagttctgattccaaacaaaccttaataggactgtgaatttaaatgcattgcattttgcttggtattttactggatttgaatacaacaagtatttatctctagggatctttatttgaattctgtgcaataatggctgtcttccagttccaggcagacggtgaatggtgataaattctattaactctcactcactgcttttcctgcgccttctcccctatttcccctctatatgactgtaactgacttaaggccatctgtcttaactgtgttggtttgatttcttggcagctggtgccagctttttcatcaaaaccacctaaacaacgtagtggtttttgttctgcagggaatgagtcagctacacttttacaggttctatttggagtttggatgtcttcgaaaagcattcagacatgtaagttaagaatactttgtactaggggctgagtctgttttcccattctgagactaatacatgtgtcagggaccatgctccttggcaacctaactgaacaaacagtaggggatatagaaagcaaaaagaccttagaggcctcatgtagatttgtctctgattttctttggaaatctaggcaaactcttattcccaggttataatctgtagctcctaggttgatattgttctattttatttgggctatggtgttttcagaaattgtaaaatataatacaagctgagttttctacctctctttaaaaaaatcgcaagattgggcacccttaaaacagtatatggaactgaatagcagttgtcatctttaaaaagaggcacctgctgtccattttcccgtagcctcttccatttcctagtgacccatttcatccatttattcctgaaggcatttgagttggtgagccctaatttaacctccctgggtcaccattttttttgctttcatttattgagcacttcctgtgtatcaggctctctattaaccacggaccacctgctacacgtatcatctttaattatcacaatagtcttataaaatagatactttttaatttccattttgtacatgagaaactgagtaacttgcccgagttccagctagtaagtggtagggctgaaatttaagcccaggtgaacctgaagctgaagctctcaacctttttgccgtgtgataccatctattctgatggcaatggcatgctttccaatgaaataatagatttggaagaactttgaaaatacaaagggacttttcttgtctaagttgtatatttctgtaaagtttgtctattttacaatatataatcatagggatcagttagtgttgtgtggcttcatttacttagtcacttttctatattaaggaaacagttcttattttaaaatgctaacaattactgtctagaactttcaaagcactgaggtgacaataaaagtccaggcctttcacagtattttagctgttttcaaccatttttgtaaaacctgttaatatattttcagaaattccgcttgcctccaccatcatctgattttctagctgatgttgttgggctacaaactgaacaaagagctggagatctgcccaagacaatggaaggtatagctatgatgctggtttgatgctttgctcactctaaaagatacggatatgattgtaagtaggtttagcacaacaaaactcaattctaactagcttaagcacaaaaacaattttttttttttttgaaacgggggtctcactcttgtcacccaggtgtgagtgcagtggcgtgatcacacggctcactgcagccttgacctcccagactcaagcagtccttccacctcagcctcctgagtagctggggaactaccagcacaggccacatccccagctaattttgtttgtttgtttgtttgtttgttttgagaaacggggctccactgtgctgcccaggctggtctcaaactcctgagctcaagtgatcttcccaccttggcttcccaaagtgtggggattataggcatgagccaccatacctgggccacaaaaacagtttttttaaggaaaaatgggcaggtactcagggaagttagatagcaggaaccacagccagggttcatgtctcagaaacaatctggttagatagctaaggatacctgggtatcactgatgttggactcttatgaattactgtgaataatttctaaactgtcactgggtctttgtacccaccagtgtacaggtgggaaggaagatcttgcctttgactaatataagggatacctgctgatactactcacagtgaagaataggcaggaggtttagatactagccagctgaaagattcatgatagcagtgtgtttttcaaactgtgggttgtgtcctattggtaagttataagtaatctttttggttttgcaggaaggtgagtgatagagtagtataggacttatcagagttagttgcatatagtaaggttaggtattgttcaatgatactctattttgtgttcagaaataattaattgaataattgcactgagggaacatgaaaaagtagtgaggagtaacttgatttcttatctcctctagaaatgtgcttgcattatcctctgtcctaatccccacttctaattttctatctttctgttgttctcttcttctcatggatgcccatttttgatctgcaattgtatttgatttgatttgcactgtattttaaacatctgtgattaaatcacagagtaatcattatgagattctaggttcaagtaaaagcatcacgttgcaaaagaaaagatgtaatcaggaaaaagaaatctgacatgtttgaagagtacagcttgttggacatgctgagaagaataggaggaggtggtgatgagagacaaagctggaaaggcagattaaagccatatcctgcaggctttgtttttattttatgttttatttttatattctgtaccagccacggagagacaacctacaggctttgaatgtcatgccaaaagaatttggattttattctgtaggccttgaggagccagagaggttagggcaacttctccatcctcctaagtatttcacttcattttccagtgctaaatatcagagtccccaaggcatagtccctcgcactctgatcttcgttaatcagtctttccttcggagcattcatctgttcttgccaagtttacctattagttttctttgaatgactcctgtatctttatctctaggtctgatgccccagattgcaggcctgcattctcaactgcctgctgaatattccaattgctatttggatattctactgtcctcagtcataacatagctaaatgcgtttttctcatcctcaaataatggtctcttcatattccctcttgttggtgtcatttttctctaagacaccagtgttgaattttacagttttcttttggctccctatccccaaactgtctgcatgcctaattccctttgctcctataaatctctattcagatgtcaatttaacagagaccttctcagctcatcctatacaaaatatatgacagtaaccctttccctgccccaatatttcctatacttttctcctccttttcttcaaagcccttatcttacctgatatattacgtatttatttgtttattatccatatttccaactataagttaaatgtcatgaggaattttgttggttttgtgcattggggaattcctagtggccaaaacagtgccggctacataataaagttataaatatttaaatattttgctggctgaataattttttcaccatgttctaccagtttttcatgtatgttttatatatccctttttctccatagcttccactatcttaattcagatgctgtaacaacttctttttgaaacagagtctcgctctgtcgctgaggctggagtgcagtgggatgatcccagttcactgcaacctctgccacctgggttcaagcgatttttgtgcctctcagcctcctgagtagctgggactacaggcgtgcaccaccataccagctaatttttgtatttttagtaacgacagagtttcaccatgtttggccaggctggtattgaacgcttggcctcaagtgatccacctgcctcagcctcttaaaatgctgaaagtacaggcgtgagccactgcacttggccttttttcatcaacatttattttaagttcctgggtacatgtgcaggatgtgtaggtttgttacataggtaaatgtgtgctgtagtggtttactacacagatcagccaatcacctaggtattaagctcagcctccattaactattcttcctgatgctttacctccaccaacccctctgacaaccccaaatgtgtgttgtcatgtgtccatgtgttttcatcattcagctccctcttataagtgagaacatggtgttgtttggttttctgtttctgcatttgctgagaataatggcttccagttccatccatgtccctgcaaaggacatggtcttgttcctttttgtggctgcatagtattccatggtgtatatgtaccacatttttttttatctgatctatcatttatgggcatttgggttgataccatgtcttttccacctgcgcatatctttataatagaatgatttatattcctttagaatatacccagtaacatgattgctggctcaaatggtatttctgcccctagcagatgctcataattttttggccagaattattgtaaagccctttctagcctctttctacttcgctttctttctttcttcatttctttcctttcctttcctttcttttcctttcctttccttcctttcttttctttctttctttcctcctttttttttttttttttttaaatttaggctgggcgcagtggctcacacctataatcccagcactttgggaggctgaggcaggtggatcacctgaggtcgggagttggagaccagcctgaccaacatggagaaatcccatctctactaaaaatacaaaattagccgggcgtggtggtacatgcctgtaatcccagctactcaggaggctgaggcaggagaatcatctgaacctgggaggcagaggttacagtgagccgagatcgcgccattgcactccagcctgggcaacaagagcgaaactccgtctccaaaaaaaaaaaaaaatttagagtcaggatctccctctgttgcccaggctaaagtgcagtggtacaatctaagctcactgcagtctcaaactcctacattcaagcgatcctcctgcctcagcctcctgagtagctaagacttgcagttatgcactaccatgcctggctaatttttgtttttgtagagactgggtcttgctccgttgcctagggtggtctcaaactcctggactcaagcaatcctcttgccttggcctcccaaattgctgggattacaggcatgccatgcacccagcctctactccattttttacaaatctttgaggttgatgtttcttaaaacactgctttaattacatcacttccgttctcaggagctttttgtggctccccattacgtattgaatggtggacgaaagttaattatgctcctgtctcaactttgtttcctatgctcatctcttgcacagacctttctttcttcattactggtctactgacaaaccaagtttactctacatttctgtcttgcctggaatgtcctcttctacttatgatactttggctattttctttacaaggatcagctactcacttaggtcatcttgagcaaatattgtttgaagaaggatgtatgtgggtagaaagccagcaggaacctaagtgcccctagtaaaaagattttctccaaccctttcatagcatctacttatctgtgtattttcttttctcttctgactagtcagttctctctctttatatatatatatatatatatatatatatatatttttttttttttttttttttttttttttttttttttgagacagagcctcgctctgttgcccaggcaggagtgcagtggcacaatctctgctcactgcaacctctgcctcccgagttcaagcaattcttgtgccttagcctcctgaataggtggaattacaggtgcatgccactacacctggctaatttttgtgtttttagtagagatggggtttcaccatgttggccaggctggtcttgaactcctgacctcaagggttccacctacctcagcctcccaaagtgctggaattacaggtgtgagccactgtacctagcccagttctttatattttttagtgaaaatccttaaagcaggcggtctgatgaacttaactacttaagattttccctctgagaacatgtcttgataaggaatatcaagtcattggtcaatctatagatgatctctcttgagccaggtcatacccttaatccaatcagtaatggtccctggttaaagaacaagcttttgctgcttaaataggtggctgagggtggagtatatttagctagaatgaaccataagggagagacaggcactgtaaagaacaggttgaatataccaactatctgaattctgtcttttttttaagactcaatcttttcctttcttgatctctgacactctattgtgaagtatattcctcctcctatccctttactgttttagctcatttgggacttcattttctctgtgttttttttgtttgtttgttttgagacggagtctcgctctgctgcccaggctggagtgcagtggcgcgatctcggctcactgcaagctctgcctctcgggttcacgccattctgccacctcagcctcccaagtagctgggactacaggcacccaccaccacacccggctaattttgtttttgtatttttagtagagacagggtttcaccatgttagccaggatggatggtctcgatctcctgacctcgtgatctgcctgcctcagcctcccaaagtgctgggattacaggcgtgagccactgcaccctgcctttctgtgttcttataattgtaatagattgcaagcccctaaatggttggggctgagttttatacatcttttgatcttccttgtgcttagcctatacaaccttaggagacatttcttctagggttcttaaacacacattctaatatacgttcaattgtttttctttcagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttggcttaggcttactctgatattgctaacaatgtaagaatatctaacagcttatttaaatactactgtttgagattcatttatctggctgttttctgagtggcttattcttatttcatcttctattaatgaggaaatatcttcggcacagtgtatctcaaaagtgtgtgatgtctaccgtgattggcaaagtgatgattttaggtagtacatgaatgtgacattaaatagcattgaaataatatttaataagaaagttattccctttccttttcattcagttttctttcatttcttcttaatatattaaaaacagtcagtatgtctttaacattttaacacttttccagtacttctaattctcctcccacactgcccccatatttctttaacaaatagagcaggtctaggctcggagccttggtcaattatatagcaagaatttaataaaagtactttgatttcattttattttctttgttacctcctaattatagcaatgataattaaatttccttttttaaaaacagatataatttaacataccacacaattcacccacttaaagttacaattaagtattttttactatgttcacagagttgtacagccatcaccacaattttagaacacttctatcatcccaaaagaaaccctgtattataatttccctccaactccctgagcctttgacaaccgttaatctagtttctatatatagatttacccattctgggtatttcctgtaagtggatgtgcaatatgtgggctttgtgactggcttctttaacttagcataatgttctcaagcttcatccatgttgtagcatgtatcagtactacatttattttcactgcttaatgatactgcattggatagactgttcatcaggtgatggacatttgggttgtttccactttttagttaataatgctgctatgaatattcaggtccaagttttttgtgtgggcacatgctttcatttctgttgggtatatacctaggagtataattgctgggtcatgtgacaactctgtgtttaaccttttgaggaactgtcaggctgtgaaagctgccgtaccattttactttcccaccagcagcatatgaggtttccagttcctgcacattcttgccaacatttactattatcttgtctgaatatatccatcctagtgggtatgaagtggtgtctcattgtgattttgatttgcatgtttctgttggctgatgattttgagcaacttttcacatgcttattagtcatttgtatagcttcagagaactgtctattcagatcctttgtccatttttaaattgggctgtattttatcatggaattattggagttcttattttctggatgcataaattttatttttttaattttttaagttgatgtaggcgtgttttataggtgccaggcaccgtactaagtgcctttttgtacattaactggcagtcctatgatatatgaactaaattttaactccattttatacatggcttttttctctatttattttaacatatttataaccatctttttcttgaggttgcactactgtcacatgagcacgtagtaagggcagtactgctaacacctataaaacaccactgataatatagataaggtaggcagcaaatatagtgtctgtgagatttgaggctgcctttcttctctgggatagaccatcttttgattcttttcattgcgattagttggaaatttcacagtaccgggaatcagaaattggtcaaaggtttgcatagccccctttgttccgtgtcaaacaagatttagatgttacctttactgctccagcctctgcctgaaggtagaaatcttcaacaattcagatgcttttgggtttttgagctaaatatgcatggttatggactcagggttcacaaatagagggagtaccttaaatctatagctgagcctctgtaggaaatatgtgattccagaaaatgcaggcaaggctctgaataggtgtttcagaggaatctcacaggttgagttgggtggagggacacatatggtgaatgttacttaaactttcttcctactatgaaatccttttagatctccattatggtggaatctcattcctattttctcttcctgtatttaggaaagaaagatgccacatacagttatttgcatactttattcattctttcttagtgctgacatggaaagcgcctaatgactttgggtttagccatgatttagttatctcttttctcatgaggaggaaaaattgttacttggtaactgccaggaagttcaagccccagaatctcctcctaacagcaagcctacattattctttcaatataaaaatgagtagatggagaaaaacttgaggacagagattgtatcttatttagtcattgtatttcaagtgtctaacataccaacatatctgactaaaatatctagtattgtagttttacctgcttgaatctaagagtgatgtttaccatctctattctaaaggcaaacattttcttcctttttctcctaggttttcctgattgtgaaaactttttacttaccaaatgtaatggttctatagcagacaatagtcctctctttggacttgactgtgaaatggcacgtactacttttaatttttcaattggagtgttgcaagctgaggtctagtagaaaatgatttcttgagtctaatgcactaatgaacgaatacattcatttttagtattctgttttaatagctgaaagtaggtccttttactcacactttagaaaacttagatctgtattccaggataaagaataaatatcacataagtggctgggtgccgtggctcacacctgtaatcccagcactttgggaggctgaggcgggtggatcatgaggtcaggagatcaagaccatcctggccaacatggtgaaaccccatctctactaaaaatacaaaaaattagctgggcatggcagcatgcacctgtagtcccaggtactcgggaggctgaggcaggagaatcgcttgaacccagtaggcagaggttgcagtgagctgagatagcgccactgcactccagcctggcgacagagtgagactcgatctcaaaaaaaaaaaatcacgttttccaactagttactatgtttaatcaggtctttgcatgttgctagaagttgattccttgtgtttgaagaagtattttgttgttgctgccatgaggactttgccttaattgttggtttggcttagttttacaccttgaagatcagaaataggatttccctgcttaagttcccctcgtgctttgctttatctaattgtagtaagcctcttttcaaagacagtgcatcccctctcagtactcaggaaacagtttctcaattcttaatagagtaactaagacctaaaatttgagaatctgacatatcagggtgtatatcctgtccttgcctgttagtggctatgtcgccttagacaaatacccctaacctatcagcctcggcttctccctctgtgaagtgggggtaataataaagcctacctcaaaaggtaattatgagagtggcatatataaaattcttagtacagcactagctgataatagaatgggcttcataaaaattacctattagtggtatttagcataatactggatatagtacacactccataaatggtagatacaattattaatattatttgcattcatcttctttgtgcagactacactgtgttgatcctcttaagtgtaacattcagcagcctgcccagctttaatttcactcacactagatcctctagaaagcaagtttgtgccattgctgcagggaccctggtagattacagtagatggcagttgacatagtgtaaatagtaagaagaagcaataacttccacagttcagcagcctgactacatgttggtctttcagtgcctcacatccaaggggagagagctaacacgcatctcactggttgctgaaggaggctgctgtgttatggatgaactggtcaaacctgaaaacaagattctggactacctcaccaggtatttttcaccttgcctgcagctcttctaagagctatcgggctagaatggaataatacttaagaatggcccacagcttcagtttagttaggttttatctacttaaatattatcaaaggttagggcatcacataggtatattttaatgctgaaattgcacaatgtcagtgtataatgctcttgcccttcttgatcttcaatcttcttgtgaccttaagtcagcagaatattatcttccttgttccagaatctcccaattataatcattatctacaactgccaaacagctagagctttgctttctgataagacctcatctgaaaatctgcaagtcatcatttggcagtcaagtgatgttagagcttaatctgccttgacccccaaaacacaaacaaatatttttcataacagaaatttgaagctgaaaatgttagtctacttttccaaagattagcatgtaatctcagaatgtacacacagtgactaggcaagaagccagtgaaacattactgttcccatccgttgacgtggcaccagtagattcgtgatgacttagggacagagaggcaatgatagtgataaatactgtcctattagcagacttgacaattagattcttagagaacagtcacgtgtggcaaagttgtatgcacaagcatgtttgtcacagtattgcaaaaatgtgagtatataaatgtctgaaagtaggggattagttaaaatatgctgtatctgtataatggaatactctgtaaccatttaaaaggatgtgctaaatagatttattgatgtgcaaatgtgtttatgacatattataaatgatagattcattgtaaagcagctcatgcattatgattacatttttataaaaattaaatatatacctgaatctatatcaaaagtatggaacgacatttactaaaatgtaaaaaagcaatcatctctgggtgataggattatgactaatttttaattcttatttgtcactttggacactaagcatatatatattaacagtaattttaaaaaatgttatttttaaaatcactttccagagaggaaaacttgttaatatcctagcctgtccatttctctttttttaatgaaagcttttcgggaatcacgaagaagattcttaacccagtgacgaccaaactcaaagatgtacagaggcagttaaaagcactgcttcctcctgatgctgtgttagtgggccactccttagatttggatctcagagcactgaaagtgagtatctgatttaggactttgcattttcagtataaatgcctgttccatttatctcaaatctaaagtcttgggctcttctctcccaccctgctagcccacttgttttttcctttagcataagacactactcattttattctctttcttcctcagatgatacatccatatgttattgatacatcgttgctttatgtcagagagcagggcagaagatttaagctcaagttcttagccaaagttattttggggtaggtttgcttatatgctgtaatattgttctgacaaactgcatacaagttagcatgtagtatctaatttaatgcatattgcaaaattcagggtttctgctctctttgctttaaacatgtttttttgcatttcttatgaaatgaagaaattgtagcaatagagacaggggtttacattcacagtcgaggcttaatggacagaactgaaccatgaaggcagaagaggtaaccaaaatttcaaaacataacatacctatatgcctatacaaggtagtataacatacttatactgtcctattgtattaagacacatatgtacaaaggtgttcattataacatggtttaaaatagcaaaatagaaaacctcaaatattctagaagtctggttgagtaaattatggttatctgtattattgaatattttgttgttcagaagaatatgataaatctgtttgtgatatgaacacctctctaagacactcctgagaataagggatgcagagcaagatctatatatgcctcaatatttatatgatatagattagatttagttctatctataaatatatacatatattaagctttttaaaaacacctaagaaagtatttaagtatgtatagacacttatatacaaataaaaaagtttcaggaaggcaactttaaacaatggttagatctgagaaatgggcctggtccatttcttagagaagggcctggccagggagtcagccagaaactttttgttgggtagccttttgtccggatgctatgcttgctgtgaacaaagctattcctgattgttttgcacccccagttcctctcgcagggctgggcaattagctggaataaaggaaccttgatttttgtgatgcaaatctaattatcagaattctaacattttatatgtaatcagaacacttgagatggttgaaaaagcctatcattaaaagtgcttccagtatgtcaattttatattgactttccaggaaggatatacagtgtccagacagacttggtcatgatgccacagaagatgctagaacaatccttgaattggctcggtatttccttaagcatggcccaaaaaaggttagtatctttgcccagtgtgttcaccttttcttaaaatcatgggactagatcagattatcacagactaccaactcctattatctatttttatgaaaatggcagtgtgggccaggtgcagtggctcatgcctgtaatcccagcactttgggaggccagggtgggcagatcaccaggtcaggagttcgagaccagcctggccaatatggtgaaaccccgtctctactaaaaatacaaaaattagccaggtgtggtggcgcgtgcctgtagtcccagctactccagaggctgagacaggagaatcgcttgaaccagggaggcagaggttgcggggaggcagaggttgcagtgagccgagattgcaccactgcactccagcttaggtgacagagcaagacttcatctcaaaaaaaaaaaaaagaaaagaaaatggcagtgtgattgaatcctaaaaaaagaaaatggcagtgtgattgaagcctagcatgtatttcgaattaagacccatatcactagcataatgtggttaagtatatagtccctgcagttgggcttatctgttttaaaatatatgttctactatgtctagctgtataatctagggcaatttctctgaacaacatcagtttttggatctataatatgggaatacacacttttctgggatattgttgagagtaaatgagatattgtgtataaaattcttagcacagtgtcttgaatatactaagcactatcctggtggtgtggtgattattgtagttaatactaataattataaaaaatctgcatagatttttgttttcttggagtagggggagcatacaattgtttcaacagcagttcagtgggtaaatgttagaacaacacataagggagacatggaagaggacatagtctctgacaaactttattataatgcattctaacctattagattgtcccattgcatagtacattccatcatgactccattatgaaataaattgtactccacatagaataataagtaacagccagaatagtcttttgtgtcaggtggtagaaagacattctaacagatcttctttgagcatatagataataatagccaccactcactgaggtcttaagtgtactgttctaaaatgctgtatatacattatcttatttaatcctcacaacagccctgtgagttagctattatcattccaattttatacatgagcctttcgaggttaccaaaggttagataacttatctgaggtcccacagtcagtcagaggtggaaccagaattgaaacccaggtctgtcacattctgtcttttctgtataccagggattagcaaactttttctgtaaaggccaactagtaaatattgtaggctttgcagatcatattgtctttattgcagctactcaacttgctgtggtactgcaagagcagccatagacattatgtcaacactggtgggcacagctgaaataaaactttatttatttacaaaaaaatatgtattggtgtctgctaatctctgctctaaatcactacaataggttctaaaacccttttggtctcatgactctttttatattgttacccacacaatggtgtgttcagtcacttagtgggtgttaacccaatgaccactaccaaggaatatttatttttatttttattttttttgagacagagtctcactctgtttcccaggctggagtgcagtggtgcgatctctcttcactgcagcctctgcctccccggttcaagtgattctcctgcctcagcttcccgagcagctgggattacaggtgcctgccaccacaccttgctaattttttttttttttgtatttttattagagatggggtttcaccatgttggccaggctggtctcaaactcctaacctcaggtgatccacccatctcagcctcccaaagtgctgggattacaggcatgagtcactgtgcctggcccaagaggatttaacaaggggattttattactttgcaacaagtaagaacaccagggatagttcccaaagcactatctccccaaatgaaggcaaaagcagggcttttattttgctagtcggctgagtcattgcatgtaaaggcagggtttgttccttgacacatacatgtatagaaaatggagaataagttcctccctaggtgagatttttagtatggtaatgcagagagtttgccaagttcatctctaacttcaggcatctctggttccagctggtttttatcttgctgtagctggtggtcttcctgtacccttttgaaacaacaaggtgcaacaggggttacacttttatagtgtgcacctgaagacccagggactctgggttacaatatctatcaacatttaccatattagaaattaaataaatttttaatattagtttaagataaataaaaagccattatatgttaacacaaatcactttttttctttttctgttttttttttttttttttttttgagacggggtctcactgtgttgcctaagctggactggaactcctgggctcaagggatcctcctacttcagcctcctgagtagctggaacttaagcatatacagccactctgtccagctacaaataacttacttttatggaaaaaagaattttccataaaaattagtggaaagaacatcattgttttaggtatttttgtgaaaccttttaatatctagcttaatagaaaacaagtggcttttcatatctgctttcacattcagtctgttatgtcacatagttggagaaggaaggacctcaccccttgtgagaagatgtctggaaaccccaggattctcaaaccacacttggggcacttaattatgcttgatttccagtgaaaattgtgtctcacttggataaaaactaaccaaatctgaattaagcatgggcttaattaataataatgcattactattggttcattaattgtgacaaatgcaccatacaaatctattactaataggtaaaaatggaggtatgctatatgggaactctgtactattttcataatttttctgtaaatctaaactgattctaaaaaaaaagtttatttttaaaatttgtaactttaaaaattattctctctacatcacaactccctggtgggctcccactttacggaaggagaagaaataactagaatagacttct[450 bp omitted]gattgcagaactaaatctagaagcactagctaatcaccaagaaatacaagcagcaggccaagagcctaaaaacacagcagaagtacttcagcacccaaacacaaggtaatattttcagtttgaaacaagagcaaagacaaatggagtatctagtttcttatttaacaacacctgagaatgtttttatcctcttttgagtctattaaaaactatttaccaaaaaatgataacatctatcacaaaaaccacggaaaaaataccaccttctagccttaatatatagtatttaatttctaattttctgaatctagtggctggtctaaaatgatatccttgatcaaaaaaaaaaaaaagaaaaaataattggaatacgttgaacctaggtagcactgggaaagatgatagactagttggtattttggctagaagagtcaatctgtagccttgttgtattgcccagactatgaaagacacacacacagactcaaaagggctttgtctccagactatagcaaatgtatcagatctttagaattttgcctaatcttttgatagagagctttgggtatatttcttgtttatccttcctctctctattgaagcaacactgtccaaaacaattttctgtgatgatggaagtgctctacatctgtgctatctcgtttggtagctgctagtcacatttgactagtgcagttgaggaactgaatttttaattttatttaattttaattttaatagctatatattgctagtggctaccatattgtataatgcaagtatagagaaataactgtcaggttctggaaaactgttgttcttaccttaactcttctacttctttatagtgttttagaatgcttggattcagtgggtcagaagcttctttttttgacccgggagacagatgctggtgaacttccatcttccagaaattgtcaaactattaagtgtctttcaaataaagaggtgagtggcctgctgaacctttgcaggttatattcaaagcagaggggaatgtagccctttgcacccatgccagtgtcaagctttttttcatcagcaaccctggctacagttagcaagcctggcttgtgtctcacatcttgtatggagtacctaagtcctcataggggcagaactgtcagctgccaatgcctgcttccagagcccagcaggcctctggctttggtcttgcatacatctttgagtttctgttgtgtttctggttcatggaaacgtttatcttggttttgagcctggctatatcctttcgattttttctttttatattttatgtatcattgctgtatgttaagtcagagaggctacatcaaacatgagcttattatgttatcatattcagaagatctgtgtttgtttttttttaacattttgtttgtaaataatttcaaccttacagaaagcgtgcatgaatggtagaacacctgtatactttctgtctagattcaccttttttagcactctgccccagttgctttattattttatatgtaccctcatgcttatgctctctcatgtacacactctctctttcttcctctctgtatggcatttcctgaaccatttgagagtaagctgcatatatcatggccctaaacacttcagagtgtatttcatgagaataaaaatattattttatataaccacatcttaacatagttaccaattttagtaaatctaatattgtcctggtacctttatctacttgtcatctgtattctaattttcttggctgaccaaataatgtctttatagcatgtcttttccctttagaacagtatcatttctagggtcatgtattacaattacttgtcatatctttttagtctcctttaaagctgtaacagttcctcaacctttctttgtctttcataaccttaatactttttgagtaatgcatgcccccctccctttcttagcagagttgcttattttaggtttgtgtggtgtttgctcatgattaaattcagattatgcattcttagccaaatttcttggggtgttgcatccagaggcagttattactcatctgcccctcttttgtgctgtttattttgatcacctggtcaaggtgttgtctgctttctctattgcagagttcttgttttttctcttaattctaataaatatgtggggagatattttaagaacatgccagtatcgcttgagcgcaggaggttgaggctgcagtgaactatgatcgcaccactacactccagcctgggattacaggtgtgagccaccaggctcggccaagtgttcttttttatgcgtcttttgcttgagcttgttgagcttttgcaatttgcgggtttatcatttttatcaaattagaaaaaatgttgaccattatttctccccattattttttctttcaccaccctcccctcctttgggcactcccattgcatatgtattaggccgtttaaagttgtcccatagctcactgatgtgctgttcatgttttttccagttttttttcctgtctgttttattttagattgtttccgttgctatgtcttaggtttctaattctgctgcagtatctaatctactgataatccaatccagtgtactttcacctcacacattgtattttttacctctagaagttaacttttgttctattttgtatcttccatgtgtctagttaacattcagactttcctctagcttcttaaatttcagaatatagttacaataactattttaacatccttctctattaatttgataatctgtgtcatttttagattaactgaaattgattggtttttctccttattatggactatattcattcttctttgcagcctggtagtttttgtattggatgccagacatagtgaattttaatttgttgggtgctatatatttttgtatttctataaatatttgtgagctttggtctgagatgtggtaaagttacttggaaacactttggtccttttggatcttctttctttctttccttccttcttttcttatctttcttttcttttctttcttatgttgcctaggctgatctcaaactcctggcctcaagtaatctgcccacttcagcattccaaagtgctgggattacaggggtgagccactatgcctggccagatccttttgaattcttgcttttaaggtttgttaggtgaaaccagagtaaattttgtcccactactgaagcaaaaccatactaagtacttaatctccataaattatgagattttacactctagcttttgggaatctaaaccattcctggccttgtgttagcccttgcgattgtttcctctaatccttttgggcatcctttccttgacctcgcatagtttacttacatggatacactaatccctactcaactgaatatttgagggggattatttatagatctatcggtttcctatctttaaggatcactgtccttcattttccaatatcccgagaactgctgttcttaggaattttttttttcttcctgagcacttacatgggcctcaagggctctttgggcattattattgttattttaatagacttttatttttagagcagttttaggttcacaacaatattaaatggaaagtctaagctgggtgcagtagtttacacctgtaatctcaggactttgggaggctgaggtaggtggatctcttgagtccaggagtttgagactgacctgggcaacatggcgaaacactgtcgctacaaaaaattagccaggcctggtagcacatgcctgtggtcccagctgctcaggaggctgagatgggaggattgcttgagcccaggaggtggaggttgcagtgactgacgtatgatcgcactactgcactccagcctggcaacagagaccctgtctcaaaaaaaagaaagtacagagagttcccatttacccccacacccacccacacaaacaacttccaccattatcaacaacctgtacctgggtagtacatttgttaaaatcaatgaacccactatgacatataattaccaaagtccatagtttacgttagggttctgtcttggtgttgacaaatgtatagtgacatatatctaccattatagtatcatacagaatagtttcattggcctaaaaatctgtgatgaatgtgctctgcctgttggaaaccactgattttttttttactgtctccataattttgcctgttttagaaagtcacatagttggaatcatatagtatatagctttttcagactggcttctttaacttagtatatgtatttaagttttctccatgtcttttcactgctttatagttttttttcctttttaacactgaataactatacattacctagatttaccacaatttatccattcacctgctgatagacatcttggctgcttccaagttttggcaattatggacaaagttgctataaatgtctgtgtgcaggttttcatgtgtacataagtttcaaacacatttgggcaaataccaaagagtacaatttctagattgtatagtaagaatatgtttagtcttgtaagaaactgctgaacttctgaagtgtctatgattttgcattcccaccagcagtgaatgagagttcctgttgctccacattcttttcagcatttgatggtgtcagtgttttgttggattttggctattctgatggatatgtattagtatctcattgttttaatttgcagtcccctaatgacatgtaatgtgaagcatcttttcatatgcttatttgctatatgtatctcttctttggtgaagtgtctgttcaactcttttgcccatttttaaaattggattgttcattttcttattggtgagttttaatagttctttgtatatttgggtaagagtcctttaacagataagtcttttgcaaatattttctcccagtctggcttgtcttctcattctctttatcgtatattttttatagtttcttaggtgtttgaggagagagggtaactctactctttgttattcagtcttgactggggatggaaatccttgtaagttgcatttgagaaacttaatggcaatctaattttcttggccttttaagttacttttactgaggatttatttttcccgttttgtttaaagtctaattgttttactaagctatgtctcagagttgatcattccaagtcactttttattggtacccaaggcccctttcaatatttaggttatagtttcttttatttccagaaggttttcttggattgtattttcaagtatttggttccattgctttaattttcttcctcatggacttcacttatgcatatatgttgttccccgctggcctatctttcattcacctactttctctctgatccttttgatttcatttgtatactcctaattctttccatgcttttcattaatgccctttattaaaatttcacttgaatctattctttcttgacaacttgtagttgctttttcatatcctcaaatgcttggctgctaatattcaattcagtttagaccgtaatgttaactgtatcctttagccccatggttgatttttttttttagggggaataattttcatcagctgaaatgcttcgattctcactttatgtcttggcttttgtttttgtttttgagacagggtcttgctctattgcccaggctggagtgcagtggcgtgagcagagctcactgcagccttgacctccgggctcaagcgatcctcctgcctcagccacccaagtagctgggactacaggcatgtgccaccatgcctggctaatttttaaattttttatacagatgaggtctcattatgttgcccaggctcgtctcaaaactcctgagctcaaaatatcttcccaccttggcttcccaaagtgccaggatcacaagcatgagccaccgcgcccagctgttgctgtttttttaatagtagtttagattaatatggtctactattttctaattttactgatttgtttttgaacaaggttttcattcaagagcatctcttttattctgccttcctcagtgcagttttttcttctttttttgtgcttttcctctacttatcaagggattctctctccctttcctctcctgcctctcttcttattgtagtaaaaaacataaaatttaccatcttaactgtttttatgtacatagttcagtaatgttaggtatatttatattattgtgaaagagatcttataacttttttattttgcagaagtgaaacttgggctatgtttctttgtatgccttgtgacttattgttgttggtattgttgaggcttgggcatttgaataaatacccagttgttgtctttacagactgcttcgtgcaggggaagaccttcaccaatcagcctagttagagatttcatgacctcccaaacctgttctggagatttgtcttctctggggttatgcatgtgcctttagttgttccctgagccccttgtccctacttcttttcagagcccataatctctttcttcccctggtttcttactgcagctctaacatgccatggtgatcacatctgttttcagtggcttccaaacaaggccttcttcagtcctgtcagccttccgagtcacgcaaaacagaaaatagtccctcagacagcccccacagtacccagaacattggacacatggtcccctcttttttttccatcccaagagaagatctgtggtgtggaagaagccatattatgtcagatagggagaggtgtagatgggaccacaaaacatcacaaattttcctttcccatttactggaaacccttcttggtttcatgctggtctaggtgctatatagtttctcatggaatctctacagttctctcaaaggtgttctggtccgtatattgttgttaactcattgtttctgtgagagtgagaggctgaagtgaagcttcctagttctccatttccagaatgatggtgtggtgttgagggaagggaggaatttataatattgttcagaagagttggcattcttcacagcagtgtctccaaggagtaccaccttttctctatatatctgattcttctccagaagcatggcttctctgaggctgccaagcctcttgcttgtagtcaagtgctgagaactgtcaaaatcatgacccatgttccttatttgacatttaattggagtttttattttggggtttttttatgcttcatctaattcttccatgccccttgatttttttttttttaaccaaatctattaagcctcctctcccttgctttccctactcacaggcttgcagcagtttacaatagtgggagttacacttatttatttaattacaggtcatttgaaaatttttgtaatagcccttgtctcttagtaatgccgaaggtatggctcatatgtattttatttttattctttttattgattctgtggttctttggggaaggtgtgtggtttcaccattttcctgcagacctggaagtcagccccatattacctttcagtatgcgtaaaaagacaactactgtttatattattgtggctcatatccaggagccacaatagagtatgaggttcctaccttatccaggctgtgctgttctctacaggttcttgagcaggccagagtggaaatccccctgtttcccttcagcattgttcagttctcttttaaggccttttcacctgtcctcactgaggagatgaacaaaagggtaagtgaatgggttctgctgaatgatttatttagtgacttattataacctctcatcattaaggaaagtaatacatgctttatttaatttgttgtgtttttctctagatttttactatctgcatattaacatttaaaaatatttttatgaaaatgggaatcagactatgcatactgttttgcaactttattttttcatttaacagtatatcatacatctttctgtatcactacatatcttatttcccttgtttttaatggctacatagtattctgctatatgatatacctattaacatttgtgctttatacatttttgctattacaaataatacttcagtgaacatccttggacatttggcaagtatttatatcaaaaaaatctttggtgaataatcccatgcattgactcatgatttcagttctctttccatattcattcccatactatattctgttgtttttcctacagatgaggatcaagtggacagagatatcaactgtctatgctgggccatttagcaaaaattgcaatctcagggctctgaagaggctgtttaaaagctttggcccagtccagtcaatgacttttgttcttgaaacccgtcaggtaagaccggaaaattcagatttcattttctagattagtgttagacattcaggtgactgcttgggccatgcagatagcaaatattcgtaaagtaagcttgattgctaccaactggagtgtgagacatactctaatgagagcagttgttgacccacaagaatgtatacccagtattgtgagatcttttgttgtgtgtgtttaaagaattgagaaatctggctgggcgcagtggcctatacctgtaatcccagcactttgggagtttgaggagggaggattgcttgagcccaggagttcaagaccagcctgggctcaagcaatgtgagaccacattgctacaaacaatttaaaaacaagaattaagaaatctgtcagttttcatatgttggctcccatttctcaaataccaggccatacgaaaaaatatgtctgctggttgaatataacctgtggtccttatgattgtacctcagctttaaatgataaaatactctttcaaaaagagaagtaactttcatatcttagaaagttacttctttttttacattacagagtaggctcatggcttgcttggttaagatacaggaggaagattatgggagggcttttgttgttattgttatctcttatctcttagggtaagtttttggtattgtaggtttgtatttacataaaagccctttaaagagattagttttactttaacaaaaataatacttgcatatggttttaaaaatttatgtagttcaaaaggacttcacaagttatgtctccatcttcacagtcataacaataccatatcaatagataaagtttatatgtgaagcaataacatcataagcatatagagacatggaagaaatcatgaaaagaaaaatggaaacagtgtaatgtaggatgtttgtagaatgatatacaataaaggtaacaatggaggcctctagggggaagaattaggcagctagctaatgggattaggggaagacttcactgtaaatatattgttcctttagaattcggaactaggtaactattaaactggtgtattacaatgtatgaaagtgaagtaaaaacacttctaaagtgatctaagtgcaggatcctagatattttaaaatggctgtctctaaattttttaatttaatttttattttatttttatttttgagacagaggcccaggctgcagtgcagtggtgccatcttggctcaccacagcctctgcctccccagttcaaatgatttctcatgcctcagcctcccaagtagctgagacgacaggtatgtgcccccacgcctggctaatttttgtatttttagtagagactgggtttcaccatattggccaggctggtcgcgaactcctgacctcaagtgatccacctcccaaagtgctgggattacaggcatgagccactgcacccagcttccaaatcttttattaatggcttttctatgactaaaaataaaaatacaaagattgtccctgagaagatggattgggggatgagaagtgtatagcaagggactataacatcttcctttctcttggcccctttttttggttgcgggggtggcgggtaaaatacatataaaataaaatgtacctttttaaccatttttaagtggcattcagtatgttgatattgtgcagctatcatcaccatccatctctagaactttttcatcatcccgaactgaaatttcctattaagcaataatttcctattacccctccccccagcccctggtaatcattgttttactttctgtctttatgaatttgactactctgtgtacgtacctcacataagtggaatcatacaatatttgtccttttgtgtctggtttatttcatttagcatgtcttcaaggttcattcatgttgtagcatgtattagaatttcattttcaaggcaaaataatattccatttcatgtatataccacattttgtttatccatttgttgatggacatttgggttgtttcttgtttctaccctttgttttgtttgttttttttttttttgagatagggtcttgctcacccaggctggagttcagtggcgtgatcacaactaactacagcctcaacctcctgggctcgagcaatcctcccacctcagcctcctgctgggaccacaggcatgcacgcctggctaattttttgtaagacagggtctctctatgttgcccaggctgatcttgaactcctggactcaagagatccacccaccttggcctcccaaagttcttggattacaggcgtgagccactgtgcctgaccctgggttgtttctacctttgactatcatgaataatgctgctatgaacatggttgtacacatatctgttcaagtccctgctttcagttcttctgggtgtatacccagaagtggaattgatggatcaaatagtaattctatgtttaattttttgaggaaccattatactgttttccacagtggctataccattttacattcctaccagcaaagaacaaaggttccaacttatctacatcttcactgacacttgttttctattttatttaatagtagccatcctaatggatgtgaaatggtatctcatttgggtttgatttgcgtttccctaatgattagtgatgttgagtgtcgcaggcaatttgtacatcttttacagcaaagtctattcacttgtttgccctttttttcttatttatttttttcagttccagctactctgcagtgtttgcccatttttaaatcaggttgtttggcttttttattgttgaattgtaggatttctctgtacattctggatattaatcttttattagctatgtgattgcaactatttctccattctgtgggttgctttttgacactgctgttagtgtcctttgatatacaaaaggttttaatttttatgaagtctaatttgtctatttttaattttgttgcctgcctttgatgtcatattcaagaaaccattgccaaatccagtgtcatgaaacttttctatgggaaggcttttatctccatattgatgctatggctcagataatcacaaagatttagttactccgagttaacaaacagaaaagcagaccatttgaagatgtagcctatccagtggaagaacttatccttcccaagcttataaagttaagccaaaagacaaatgggaatctctgcccgtgacttgcagtgatgactttagtgatgcataataaatattatgaaaagcctgttgggtagttccattttaaatgacaaagttatttgttgtctgaaagctagtttctgaactttgatgatcccatttaaagttgacagtttacaatcaatacttgtgtagcccagcacagtaaaggcatccattctggtggctttggccactgtagtttgaatcctttccccaaccccttctttagcagtttgagctggaaagcaatgatgaggaaatcttggtctttctgcagcctcatctctgtatacagtatgaagtcctagaagctgcccagctggccatagaatccttggatggtattctggtagatggtatctgcatcaaggtagggtgacaagagaaagccccctttgcttgggtctggcctaccacagcctgtatttatagtgccccaggacatataggaaacactctcaagaggcccacgcacaagactttgttatggaaagtcttcagccaagtctaacattctcctactggcagtgattgaagacataacggctttcatttgtgtcagaaatcatcctgggctagatttgggtcttccttgcattctttgttactacttaagtcccctgtggtttattctggttggttctttgtggttacccttttcttcacctttcagggagatcaaatggtggtattttgaagtttcttgtgcacataaacagaatttcattaagggtgggaggcaggaaactgaagagaatatgtttacatgaaaatatgtatttatcaattaagtctctaacataattctgtgaggccattatctttagtttccttttacagaaaagaaaagaaacggaaaattttaggaaactgaaaaatgaagttattagtaatggcaacaacttgctagtatccaataggcctgaggattaaattgattttctaccactaacaccaactttccttggttaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgagtaagtctatgctactgaatgtagctttggggaaggaaactggggatggtgataacatgaggtcagagaaaggaagattcacctcctgggctggaccagggcagcagttcctgattctgtccttctcctttgaccctggccaggcagcttggatggtgatcagctttcttggcccttaataacataaggtgggggttcttgctttcagaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcaggtgagtgagtgaaggcgtcttggagaagatgtcaggagagtcctgctcagtgacacttaatcctttaatcttttttttttttctaccctggccctcagtcttatttcactctccagcttcctccagtcctggccacatcttttctcgcagatctctcatacttttgcccccaccatacctgctaaacttagttttttagtcttccagatctccaagggactttgaaggacaaaggcaggaagtcagagagctggacaattattcagtgatctagtctagggtttcccaaagtgtggtatatacacaagataaattgtggttgtcatagatggtcttttcttttttgttttcacttttatgattatggacttgtccgtctttttattatatctaagacatctgaatggacttgttttgctaatacttgttaaagtatacaataactacattgagcctatgattttgtggatggcattagttagacaaggctaaggaagaaattaactcactttatggaaaaatgttagagggatatacaagcagaagagtggaggtagaaggtaaatggctgaagcttgggaaaccctgtcttagtctaatctctcatacttaacagatgaaaagtaggggctagagttggtaagtcacttgcccaaggtcacaaagagacttaatggcagaagccagactagacccctcatcagcaatgtggctcccctagcttggggtcttggaagacccatgtggaggaaaggacagtagctgtcctcccctgaggaagtccttagccaacttggaggcctggggatgctgggtcagcagagaacctgcagtgtgggctccagtgttagaaaagggatttgtctggaacctttactggaatcccatagccttagaggcagaggaagagtgttgcagcccttccaaaggtaacgagagagtgttctggctgagtatcgacacatggctttgatcccagactctgaaactggaccacccgaagatagcagcctggcgctggagccggaagattggaaagctctacaacagcttgtgcccgggcactctctgcctcatcctgctgccaggaaccaagaggtaaggactagaaagggtatcccttcaggactctgtcccctggatttcagctgttcttagagaaaaagccttttgctgatatttaggcacatagtgaggacttacatgaatcatctctttaattttcaccgttctaaaagataggcattgtattcccatttcacatttatatgctcttgtataactacatttattggtccctcaaggagataatttatccccagttaaaaccaggagtcttatgtccttactgctctctggagtaagaagtagctgctaaccccacttgagtaaaaaaagtaaagtctcagaacaagccctaggcttaggtgtaaccactctacatgtgaggaatgtgttcctgccttctgtacccttttccccattgacacctatgttttaagagataacagggcctggtttgctgattctaagcctgaggaatactggagcaggactttgagtctagttgcagctttatcacctatctcctctgacaagtggccaagctacttccccactgtaggtctcaatgtccttttagtaacatgagggatttggaataaatcagttgattttcaaacccttttaactgtaaaccctttctttaaagaaaaactgatattaaatcttaaagcataaagatgggcagttttggaatgagtgagtgggcagctaaatgaatgagtgtatattggggaagggagggaaagatggtggcttttttgaacagtgtgaaaaccttgggttgtgttaatttttaaaagtcccttgagattctgacatctggttaggcgcagtggctcatgcctataatcctagcactttagaaggccaaggtgagcggagcacttgagctcaggagttcaagaccagactaggcaacatgacaagaccctgtctctaccaaaaacacacacacaaaaaaaaaaacaaaaaaaaaaaacccagccaggtttggtgttgtgtgcctgtggtcccaactacttgggaggctgaggcacgagaatcacttgaacccagggggcagaggttgcagtgagctgagattgcaccactgcactccagcctgggctacagagtaagactcttatctcaaaaaaaaaaaaaaaaaaagattcttacattctaggagttgacagagcatgaatacctctggccttgaaggtggatcagaagaaattcatttcctagcataaagttcttataacatgcatctgaggaccattagggagatggtctacctactgggcacctttgaaagaaccgctttctctgaaaagcagaaacaagtattaggtgcttacattgaggggaaaaaaaatcttagaccaacatactttaaacaggcttgtgggtaagctaacaggaacaggttaaaaagtgaccacaagttgccagtaaaagctttttggttaagatgtgggctctggggaacagacagacttgctcctcaggggcagtgtatggtggtaggtggactgggttttcatgttctcacgtagaatacttagattacagtccaccattgtttaggtaaactaagtcaagagtagcccaaatcattgttcttcctggatgttccacagagggtgaagccagaggaggaagtgctggggtcagggagcaaaaacacttaagttgtgactgagacaaaggtcctaagtttgacaagtcagtagaattaagcaccccctggaagcagcaaatcctgtggtgaagaaacctgaactactcctatcctttaaaagtcacattctgatttctgtagacatattgatcaaactcagcagcagtagcatgcatttccccaggctgtggaagcttgctgtgtgactgacttctctgggccttgtttgtgcagttgtgtccgtgatggcagcagatactcttgggaaacgttggggaaaaaaggaatagcaaaaacaatagaaggtttccttaggctggggtcttgatgcagctcttaatccttacatttttggtagcttcttaaattaatattgaaaacaacagtaatgtattaaacccaggtactgtgctaaatgcttctatatgcatttttggttgaggttgtcagaatctttactgaacaagtggagaaaaagtctcagattaaccaattttcctagggtcacatagctagtaagtgcatagtcaggacttgtaccctgatggtgtgtctgactccagagcaactctcctgccctcaaagctctagttctccatacacaaaagtctagtgtttgcatgtttaagttcatacatcaggtggagacagattctgtgtttgtctttgctcatttctacctgctttgcctcagagagctcctcaacgctgacccagttccatgaatattcattacaaggtggcagggaactaacaagtattgaaggctcctaaattccaagcaccacaccaggttttttacaacaaacattgttaaataagttaatgttttgtaacttttttaaacagcctctggcacctagcaggtgctacaaaagtatggaatgaacaaagactaagactctttaacagcaacttataagggatctaatgacagattgctattattgatatcctggttctgtcacttaacagttgtgtgacttcagcaagtcatataatgtctatgagcttttttattttttaaatgaggataacacttgtacctacatcagtgagcagttttgaggattaaatgagacaagtgcttagaacaactcttggcatgtagtaagtgctcagtgtatgtttgctattgtcgatagtcttcaccaaatccctgtgagatagtaatttaaatatttcatagttttatagatatgcctcatatctcttaattggtaaaggtaggatttgaatctagacctctgagactcatcagtgctttttccattaaaccatcttcagcaggcagctttccataaaccttcctgcccttgccccatggcacacacacatacttggaaaaatatctcctctaactaggcatttataaccattcattcaaccttatggataaaaacatacctttgtttcttatttattgcagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcata

SEQ ID NO: 36970 - DNA, 26942 bp, Homo sapiens
aaaggggtctgtgtgtggccggggaggatggcgggggagtgagccccatggaacagccaggaactggtaaggggaggtagggcacagatcccagtaaatgatggtaaatggtggtgaccccgagaggaaagtggaagtatttgggtttttaaacttccccctaaattcccacaagatttcattgttgcccccacacttcccctcttccccacatagggaatttccgatttcacttcccaatacgcaagtggccagagagcctcaacttcctcctcatgccctccctgccttgccccagctatagcctttgtggggaagccttctcttctcccgcgcgagtccggtgtcacccatgtcctccctcgcttgcgtccctctcccattcccaccccgtcggcctgaggggaggtcaggcctctcgctgcccatttttctttccccagtcaccagcccgccccggattctctactccctcagcttgctctgctaccactttcctgtctctccctctcccaaagcagataaaagatgaggggacaaagacagtgtgtgtctgggaagctgggctgagaggaggaggtgccgccgcctgggggtactccgatgcttccggggattccgagccagctggaggaccgcacgtggcgaacggcgggcgcggcgcgtagtcagggaaccagggtgcctgactgggtgtctcgtggagccatcccgcgggggtgtgggggggccacggtgccggaaggcgcgcggcccagaggccgtctccgccgaacgcccgctcctcgccttcctaaccgcagcactttcgcgagcctccctacgaggggcggggcgaaacaggtgcggttgccacggcacccggaccacagcctcgcgagatttggaatcagccaatgggggcggggtaggggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggtacccacccatcactccagggggcggggggcgcgtccggggcacacccctcactcggagcctgaccctcccgtggctgtcgccccgccgtcctttgtctccgaggccccagtgagaccctcagtgaccactccctggtccaagggccctgccccttcccagagtaaacccactgggggtctaagagtgggcgttgtcggctcccccagcttctgtcctccccagaatcttccagggtaaccaccaagccctcctgcagatcccagccccactcccctcagcagcagggccgcagtaggaagctgagccattcctgcgctccttttcttggtctccacctccgtcccgcaggctggatgcacctaattcacggaaatcaaccctcccctccctgtcttcttaagtgtcaatagcaaaacacaatgaaacttttagccattcccttctctggtgcggtgtgggtctgctctgcctcccctgggacggtggttttgtgtaggagggaggaggaggatcggctgtggcttgctgactttggggcagccccttggaggcaggggacagttgaggttcgaacacttctcccaatggcagctctcaagaggtcagtgctgccctgaggggtttcaggaagcaggatgaggtggtggcagtgggagccctgcaatgagattctggccctaagcccttctgtgcactgagggacagaatctgaggttccttcacccacttggacctcacttttccagttaagtggcctctgcacgcgaggagagtgagctccaggactctgcctgtctcagtgctgtgaatgaaacacagtgctcccgcccctcaaggagtgcaatgcccaagctcacttttctccagagaaactcgagacatgcccgtcccaacccccaggcgacataccaaagtacttcacagaccctgtcctccctgccaccccacgttcacggactccacatgcctttcataattctgcaccagcgaagagcctctgaaggaatctttgaatcctgccttccaggtccccgccctgcacggtcacattcctttccagacgccatccagctgtgcagggcagcttgccctagagccaagctggtggccaggcctactccaggcacagagctgaccttcagcagggtctgttcacttccaggcatttcagcccgccctcctgttttacggctgttgatgtttgtctgtcaaggccaggttgagtgcagccctttgggctaagggtcctgaagaggcggagtcctcttcactttccttgtgagggcacaccttttttgaaaggagagacatggcacaggaccagttttctgaatttggaagcctagagtttcagagctggaaggatcttagacatcatcttggcagcccccacctgactggttcaggaaaccgaggttcagagggtctggctgatgtgtggaagtcacccattaggtcagccagcactgactgcctggcttttgcacagccagttactgctttctgctgcttctacccgaaaaagagcaattcgagattgctttgtccgagaccggtgctttgatgacattggtgccacaggatctgagaggtggcacacgtttatttccttcttgctgccacctcatctccagaggatccctgatcactgatggccctgccgaaagggccctatcagcccacgctgaggcccagagctgtgccaggatgtgtagtgtggggagtgagcccggcgaggagggtgcaacaaaggaggcttttctctggctgatacagcctctcccagctgagtcttgaagagactcattgagtcgtgaacttgacttgccggccttctccccctatgtggctgctctaagaataaaatcagctggagcagaccaaggcaaggtgcagtcagggtgtcttaagagtgtcttgcaaaaacttattgcataactgggactgccacttgtgcgagatgaaacctgtgcgttcttggtgagatggaatcggaggcatctttgctgcttcccctttcttgttttctgccatataccctgggctctgcagagcaactggtttctgggtcctatagatattaactcactttctgggctcatttatgaggcatttttatgtatgtgatttcccagagccaattctgcttcccatccttctattctgtaatcatctctccagcgcctcctgtccccagcaggaaggccaggactggccttcatgcattgctactggcactggcgagagtgaggcccacgttttgctcgccctgcaggtcagctggtcttgctccactgccttgcagagcaccccttgccctggccagctgccctctgcccgtgggcccctggtcactgggggatggggccaaagggagaagctgatcggctcagagtcctcccgtctgttggaaaggcagcttcaagtctgtgtcctacagataatgggtcagtcttttctttgctctcactacctttttcagagaagttttttgtttgtttttttgagacagagtctcgctctgttgcacaggctggagtgcagtggcgcacaatttcggctcactgcaagctccacctcctgggttcgagcaattctcctgcctcagcctgccgagtagctgggactacaggcgcgtgccaccatgcccagctaatttttctattttgggtagagatggagtttcaccatgttggccaggctggtcgtgaactcctgacctcaagtgatctgcctgccttggcctcccaaagtactaggattacaggcgtgagccaccacgcctggcctttcagagaacttttcaaaggagctttttctgcgtccagtgaaggatccctgctctcaactgagactgccccttgcctttctgggctgttctaagcttagtgtgaaactcagatatgcgtggctgagccctggcccgcaagtcgccagcctctccacggctttgttcttcctcagcctgctcggactttcagagaatggcgcgtctgtgcttctccgtcccaccgtctaccagcctgtgtggtccccagcttttgccagccgtccatttcaattccctcacccaagcggctggttgaaagggcagggctggccctagcagcagtaggaagcggccagctctcttcagtgtggagatttagccaagtgctggaggattctgagatgggatttcagcgccccagcgtgaccttctgcttcccctccgaactgaatggtgacctaggcttgcacagttttcactaacaagtcagcagcttgaaagttgacctctcaaactctaggggaaaagtgtgtgaggaagtgctgatttgggtcagtttgagcctgctggttgcattcccagttgagaaagtccatacgatttgccggccaccccgggaaactaagacgatagaaaaccacctgtcagttccccgctgctggagaggaagccagagatggagcgaaggagtacagagagccctttgttgtgtccggagcagtgatgactgtgtcttgacgcctctcttctggctcttgctctcatgtaggttcatgtgtgcccagctgcccaaccccgtcctggacagcatcagcatcatcgacacccccgggatcctgtctggagagaagcagcggatcagcagaggtaaacagctgtgaccacagctcgggctgctggtgttgtcacacatccttctctctaagatctgcaacttggttcagatgctgcccttgagatttctccttttttttttttttttttttgacggagtcttactctgtcacccaggctggagtgcagtggcgcgatctcagctcactgcaacctctgcctcctgggttcaagcgattctcctgcctcagcctcctgagtagctgggactacgggcatgtgccaccacgcccggctaatttttgtatttttcgtagagatggggtttcactatattggccaggctggtctcgaactcctgacctcatgatctgcccgccttggcctcccaaagtgctgggattacaggcgtgagccgccacacctggctgccctcgagatttcttccagtctcagcctttctaaaaaaaaaaatgtggccgggcacggtggctcacacttgtaatcccagcactttgggaggccgaggtgggcggatcacgaggtcaggagattgagaccatcctggctaacacagtgaaaccccatctctactaaaaaatagaaaaaattagctgggcgtgttggtgggcgcctgtagtcccagctactcgggaggctgaggcaggagaatagcgtgaacccaggaggtagagcttgcagtgagccgagatcgcgccactgcactgcaggctgggcgacagcgagactccgtctcagaaaaaaaaaaaaaagtgtccgagtaagaacccattttacatcagcctcccatctccacagtgctctgtgcactgagagggcgggagctgctttctttcttggctccctgggcctaggcaatgggagcagccatggtgagaccacagccaatcttatgtggctgtcatgcttttgaacccctggggcatgctggaaacaacaggatcagaatcgggccatgctgtgagggtgcaggaagcattgctgactctgaacaagcccctggtccccagagcttattagctttagtctgtgtttaacagcctttgccccccaaagccatatacattcctcacacgtccagcaggactgagagagagccaagcaaaaggagaagctggtagaaattcatgaaacgggctggtggaaatttgcttacatttgcttagaggttgacagcagcctccctggctgaggccttcttgctatgcagtagtgcaccgtgcccattccaattgtgtaaactcctgcctagattctgccaagctcttttgaagatctggttcaggatgagcctgaactgggtcctccatctgtcactgcccctttttcacagacgggtggggcgctttggggcctgatgctttctgggaggagcttgagggtaggctggtacctggcaggtgaggagtggagtctacagctccaaatgtgaaaatgaaataagatcaaactcaaagaggggttgaggacaagtgagcaagtttgttgatgattaacttgcagatccttcccgtgtcccttaccctctggactggcctttgctgggtgagccttgcagtcaaagccggcagctaggatttggggtgcacatgtctctctgctagggctgtgagggcatggggactctgttcttggagctgagaaaccttgcttctctttccttccagccttgcgggccttgcccgtgtgggactgcatcagagcgtactgaaatcactggccctcatctggtttcagagctgccagttaagctgttagattctcccacccctggtgacagtgatgcacctaggagttaagggagtagatttggagacccctttaaaaaaaaaaaaaagcgagggctagtatttttatttcttactgctattgttgttccaacctagttttagtaaatgccggataagcaaaagccctgtcatttgccaaagcaaggtcagaaaatctgattaagttactcttttatttttttgagacagagtgtcgctctatcgcccaggctggagtgcagtggcatgatctcggttcactacaacctcctcctccctggttcaagcgatcctcccaccttagcctcctgagtagctgggattacaggtgcatgccaccacgcctggctaatttttatatttttagtagatatggggtttcgccatgttggccaggctggtcttgaactcctgacctcaggtgatctgcccgcttcggcctctcaaagcatcatcacagccttgaactcctgggctcaagtgatccttccaccttagtctcccgagtagctgggcccacaggcgcgggccatcatgctcggctggggttgtatgtcttgtgttgcttgccttggcccctgccctctgagatgctccctccccacctcccactccctctgcttcctttccctggtaggaaagaggcaggcagaggtgtctacactggctgtctctgggacaagcaccaaagtgtatgctccatatcagtggatctgcagacacagcatggcgttttgattgggagcaaggggtggacgtaggtgttgccttgtggtccctgccctggagttgcctgtgcagacaacaggttggaggaacaagccagcaggacatgaggctgctgtcagtgtgctgccctgctctgcctgtgtggcctccctctcccctccaggtgcaaagtgtggcccctctgcatccctgagaggccaggctcccctatatccacagaaggtcatctctacccattatgggcaggaaggagccggtggctgaaagagaagcacatcacgctgattggaggaggggtttcctgctgtgaagtagcagaagatcaaaccgattttactagaccatttcttttcctccatagccctagaggccttggtttagatgtgttttactaaaagttacctggttagggtttgaatgatggtgttttattgtcaggagaaagaccatcgctcagtacctcttggaggtgctgggtgtaaactccaggatgagccccgctaggtgtacacaggaggagtggatttctgtttcctggaggccccgcccgtcagtcatggaaaggcccgtgtggcctgtccagcggaggaggtcggagtggagcagtgcgttcccggcagggctggccacctgctactgcctttgctggtggcgtggaaagcaggtgtttccctctcggaaagatggggccggcagagcacgcaccagggccccagcacaacacgcctcccctggcctgccagcccgttccctggaaacatgtccttgtggaggccgtggatggacattggggttgctaattgcatttacttccatttcccaccccgtctggccccgcctggcccctcctgactttttttcccctttccccatggtcctaatgtgtgcaggaaacacggtctgaaaagataaggtgggctggtgcaggcccaaagcagtcaggatgcagccaggctctgtcagggacccctgaggactgcctcagggacgagaagggggccgggttggggtctcttgggctgcctttgcctgtgtgctaatctgagtgactttaaagataccgttctcctgtgtcagcagagaaaggtggcctctgggggctgcgttcattcttgagtgctgcctgtgtgactgataagggcattccaaagggcagctgggtccggcaggggtggtgcccttggctccaggggctgccgaccagttgcgtggtcccggcagtgcctcatgccgagtcatcccccggcggggcctctgtgggcagcccggccagttcgttcgttccccaccatggtcactaggcaactgtgaactaagcgggagtttttgtgtctcaatctccccatgaaagctgtatcagcatcagcagggtagtgtttctacttgcagtagcagatcagagacctggccagctttgtgtctgactttctgctggccactgccacatcagtgagttccattgagttatcacagcagctgcatctaggaggaagctcctgcctttcagaggaggaagcagaggcttaggaaagttaagtaattggcctaagatgacaggcaggccagcaagtgtcggcgctaggatttgaacccaggtaggggctgtgctcctactgcggcggagctgagaagggtgccttggcatgaaggctgtgggcgaaggagtgccgggagcttgggtcagacagacctttgcccctgttgggtcattactgtggacacacagtaatgtgtgtccctcctgagacacacagaggccaccctctgtttctctcccacccaaggttagactccagtcctgaaatggacctgaggtctggggctttgaacagcagtgctggtattgtgttccctgttcccagccataaatgatcccttggggtctccagggagcctggtggcctgggctctcgtttgccctctggtggtctgcaggctccctctaagcctgggagctgtcctgatccttagtggttggatggggcctccctgcccacactcccacctgtgtgtcctgagccctccggcccagaggcaggcctgcgccgtgggccgcccccacttcctgccgacacctcctgagatggagatgccgctgccagcagcacccccaggctgaggtttcaccagggtgctccgaagaccatcaaatgctcccaggggctgcccaaaggccatgagccaggccaggtgctgtgtccctcttggattcagcatccatagcacaagtagatcagaaggttcaagtcccacgttagtacttggggagctgggtggctctagggagttgctgtagtccctgggagctgcatcagtccatcaggaaacaccatagcctctccagttattgtagattaccagaatttacatgttaagctcttgccctagtgcctggtgcacagttaagtgttcaagtgtcagctggttcatagtcaagagattgaaaagcccagggctttccagacggtgatctgagtaacatcctggggagtatcctcggggaagtgctgactcagccggggtttcccgttgggttccaggccctcctttgctcccagctccaggcctcccaaaaccctctgctcgccccacctggctgtggtctccctctgtggcccagcaggccaggatgccaagacagcttttggcctcagcctctgctgggggcgtgcaggctctgccacagaggaggcgtaccaggcgctgcccgcgctcagcacctgttccccaggctgcgcactggcggtgggctggggagcagctggccgagcgcctgcaaacattccgtttatatttgggggatgaggcattcttcatgcatttgaagtccttgcctacacacccatcagaatctgagcttcttaagcccaaaatacaaatcctgcgagtaaataagagcaaacatttactcctgctcgcagtgtgccaggctcactccatcctcccgcggccctccaagctggaaacctactatcttcgtgttacagactgagaagctgggaaccgaggctctgagaggtcagagacctgctgggtcacacagctcgttgttgagtagaaggttcaggatggaaatgtgggcctgattccagagttcctctgccccctcccgcccctcttttgttgcttctgtctgatttgctggggtctacgttgtgtgtagtgaagtccaccctcctcaggtgccctgctgtacaaagcattcctgggctgccgccaccatgacagagagtattcccatcgcctgaaagttcccgtgcccctcatagtcactcctggtcccaggcagcccactgacctttgtctctaacttttgccttttccggaatgtcacctaaatggaatcatacaggatgaagccttttgcttccaccttcacttagcaggatgcttctgagctgcatctgtgtgtttgagagcccctgtggcccgctcctctttgttgggggtccttgtcccatcatagggatgcaccatccgttgtcatccattcacctgttggggcgcttgggttgttccacccggggcagttttgagtcaagtacgtggttcgtgtgggcgtgtgctgctgctgctctcaggtaaatgctgaggaacggaggcgcctctgtgctccactggaaaacccttccggaggagcttcagcctgagcaagcccaggaacgaggcccagcacgcgttggaaacctgtgtgatggagagctagggcgagaaatactgaagcccacgcagcttgaatgacaggaaacaaaagtcgattggagacaaaccctctatgtttcatgttctagaaatctttggaatgtataaagcagcttttccccctgcggctggaactacctgtgttttggaggctgctggggtagggcggggaggcctgagaacctccctcttccccttctgtgctggcgggaaacatggtccagctgttctcaggaaggcagaccctgtaaggccagcgcctggagaggggcgccccagagccgcagtggcctggaggaggctgggtgggacgcgggtcgccatgagaggcacctgcgtgcacgctaccctgaggtgccatgcctggctcagcctggttgcccggagccactctgttctttcatcccacagccccaggacttttcgttttcactttttaaaaattgtgataaaatacacctaacatataatatttaccattttaatcttttttttggaggtgggggtacggagatggagttttactctcattgcccaggctggagtacagtggcacgatcaatctcggcccactgcaacctccgcctctgggttcaagcaattctcctgcctcagcctcccaagtagctgggattacaggcgcctgccaccacgcccagctaatttttgtatttttagtagagacagggtttcaccatgttgaccaggctggtctcgaactcttgacctcaggtgattcgcccacctcggcctcccaaagtgctgggattgctggcataagccgccgcgcttagcctttttttttttttcttttgagacagagtcttgctctgttgcccaggccgaaatgcagtggtgcgatctcagctcactgcagcctctgcctcccaaattccagcagttctcctgcctcggcctcttgggtagctgggattacaggcgtgtggcaccatccctggctaatttttgtatttttagtggagatggggtttcaccatgttggtcaggctggtctcgaactcctgacctcaggtgatcagcccgccttggcctcccaaagcactgggattacaggtgtgagccactgcgcccggcctcattttaaccacgttttttggtcatggaccccagaaaagtagattttaactatttgtaggtgtgcatttcactggcatttagcacattcttcattgttcagccgtcaccaccatccagctccagagctcttcacttcccaaatggacactcttcctgttcaacaccagctcccctcgtggctccctgcaccccgcagcccctgcactccccattctatattccttttctgtgcacttgattactcctggtatctcctgtcagtggaatcctacagtgccgtatctgtccttttgtggcaggatgttttaaaaaaacttttaggttcaggagtacatgtacaggtttgttatacaggtaaatggagtgtggtggggtttggtgtatagattatttcatcacccaggtaataagcgtagtatctgataggtagtttttcttttctttttttttttttggagacagggtctcactctgtcacccaggctgggagtgcagtggcacaatcacagctcactgtagcctccacctcccgggcccaaacaatcctcttacctcagtgtcccaagtagctgggaatacagatgcatgccaccacacccaaatttttttaaatttttgtagaggggggtctcgctatgttacccaggctggactcaagcagtcctcctgcctcagcctcccagagtgctgcgattacaagcgtgagccaccatgcccagcctgctaggcagtttttctgtcctcacccattccaccctcaagtaggccctggtgtctgttgttctcttctttgttgccatgtgtactcaatgtttcacacccatggatgagtgagaacatgcggtatttggtgtggaacatgcggtatttggttttctattctagtgttagtttgctgaggataatggtctccagctccatccatgttgctgcaaaggtcatgatcttgttcctttttatgggtggatagtattctctgtggtatatgtaccatgttttctttatccagtctactgttgatgggtatttaggtggattccatctttgctatcgtgaatagtgctgcaatggacgtatgtgtgcatgtgtccttatggcagaatgatttctcttccttagggtttatgcccagtaatgtgattgctgagtcgaatggtagttctgttttaaattctttgagaaattgccaagctgcttttcacagtggctgaactggtttacattcccaccagcagcgtataaatgttcccttttctctgcaacctcaccagcatctgttatttttagactttttaataatagccattctgactgttatgagatgttgtctcattgtggtttgatttgcatttctctaatgattagtgatgctgagagttttttcatatgctcgttggccgcgtgtgtgtcatctttggaaaaggtcacagacttatttcatcacttagcatcatgtcttctaggtcccaggattttctgagctagagcttcctggtggcttatgatcccttatcagagggggctctggcttttactcactaaaaccactccctctgcaggtgggcctttctctccagcccacccgcttgggccatgttttctgtgtccttttgctcggcatcagttctgtcactcccactggggcctgagctagtcaagctaacagcaaggcccctaccttggtgggtgccaaagcctgaagtcttgttgccttgggcagtgccgggggtgctggcaagccctgttctgtacttgataccggccgtccagctctgatctagagagtggctcagtgttaccgctgtgcagtgtagcctttggcacctcttgaaacccggcgtcttttaggctgagtgaggtgcctttgagggcagcgagggcctggtgggctaaggagcgccggtgggcctggtggggcgtgcagttacgtggtcactgcctgcatggcacaggcctgagtgctgtggccctttttgtcacctgtgggtgtggctggccagtcactgtgtttccctcacagcaaaagcacattttctgtaataaacaggaaattttagtcacctgcaaagaaatgggcttacctctgttgactccagcttgagatgacggccagtaactgggtttcagagcaggtggggcagggcttctggacctggggcagggagttttggagtgctcactcttctttcttccttcccctcctttttctctctttccccagggccccccagccatccagggggaggggggagtggggccttgctgggtggagtttgggagggtgacctcagctccccaggcgccgtcctgactcccaggccaaagctaacatgggctgagcacagcccatcagggcgccctcattcccaagaactcggttttggcatcacagcctccccagctgtgtgaattctagtttcagcttgtggcgggctgaagacaaatgatttgacaaggggagaagctgggccccctttttgctgagcgaggaacctcagtccttgagtcatcgccttttcagtactgacctgcgttcccagagctggccataaaaggctgtgggctgcgggccccaggcaggcgctgcaggcttagctagtgtggcctcatcccccgggggcagaggcggcctctccctgcccctgtttccctcatgttgcccttggcctctctttctggttttctgccgagacttcactctttgggcatcctctcctgtggagctcagagccagctgcagggagtccgggtgcccggggccttgtactttggaagcaggagcctgtggtggcatgaggtgccctggcacgatgcccttccacaccttctgggcacagggaacctggcagctctgctgtctccgaccatccacctgagcctctggaaggctgatcgggcctccccgtccaggctggaggccaggaccccggctcccctgcactgctaccctgttaagaagcttggccctcggggctgcttctggtcagagtgccctatttcctgttgagctggggcagggaacggccgcacatcacctgtggagaggctgccgaggctgtgtggctgaagctgtggatttgggattttccttacattttggtgactttgctcaaggatgaaagtccttgaccggtgatgggtccaggccgctggccccttgttcccacagagccctggcttcccctgccccagcctgccaaggaggctgtccctgtcgggtcctgggctggaggcccagtgctcccacacgccctcctccctgcagcccggctgaggaattggtatttaaatttcacagatggagaaagtaactgagaagttaggaaaagaacttcaggtcacagagtcagtggcagggggcgggagtggagtgcagagccatcttagttagtggcccgagttccttctgggagcgccaggtgtggggaggggctccgcgcccctgtggctttgggctcacagatggcgccaagcacgcttgggcctggggccggggcaggcggcaggagtgtttatcccatgagcgagcttgactccgcacaccctgtggtgccatttatcttggcgtgcttgtgcgtagaggcagcctctcaggagcctgggctgtggacctgcctttgtcctggagggctttgcagggtgggagcagcggatgccaccaagggggaacccgtgtagtggaggagtcagcagcagctcccactgggggacggcagggctgccctcccatcaccgtgggcgaccctgtccagctgctgcttttccttaacgctttgtccttggacctcccacctcgctgctgtttttctgccccctcagtctagagagcgcccatctccatccccagcttggcaagagggtggtgtttttcatggagatgccaggagcaggtggtgggctgaggactcgtttgggcccaagctgtgcgactctcagactgttgtgtgcaggagtggcttctcctgctcttttccggagcctgactgctctctgggaagtacttggtgcttctgaagagggccggcctacatttgggtggcctgggacctgtgggaagactgagccagggacgtggaggcttgcccagaatcaggcagagaggatgtggcccctcgggggtggggcccaagctccccaaggattctaggcctttgtttccacatggcccgcctgtcactccttactcttcctagaccgggagggacagaagttttactctaggggcagaggaagaggtgaggatttcttttgttttgtttttgagacagggtgtcgctctgtcgcccaggctggaatgcagtggcatgatcacggctcactgcagcctcaacctcctgggctcaggttatcctcctgccttagtctcccaagtagctgggactacaggcctgcaccacctttgtagagtcgggattttgctatgttgcccaggctgaagtggaaatatttagaagaggcctagttgtcatataggattcaaaactgctgttgaagaggcctagttgtcatataggattcaaaaccgctgttacagagacccaaaaatcattggcttaagtcagatagccaatagtttatgtgaaaaacaacagtctaaggccattctgaacatgcagctttcatctctgaacccgaggtgcttcctccagctcctcccatcacatcagcatccccgtcctcaggagggagaaaacaacagagggctcatgcaccttttcttgttcattctgctgaaggaggctgggaaatgcaatctgaagctgggaggccatgaatccagctgaaactggatagttatatctggttccttcctttaggaggaatttcaattagcagtctctgccacaggcgacagaattcactttaattggtgggccttaattgggtcataatgggttggtgggaagcaatatagaatagagtttagaatccaggcgcggtggctcaggcctgtcaccccagcactttgggaggccaaggcgggagaatctctgagcccagcagttcagcatagacaacatagtgagacccccatctctacaaaataaaaatttaaaaattagccagacatggtggcacacgcctgtagtcccagctactcaggagtctaaggtgggggggatggcttgagcccaggagttcaaggttgcagtgagcgaagattgtgccactgcactccagcctgggtgacagagcaaaaccctgtctctaaaaaaatgaatataaaatttttttaaaaagaatatggagcttaaagctggagtctgtccagtccaaccactttgttttggagaagtgtttaagacccaggaaggggaagtggttcgtagcacttcctgggcttcttgtagagcagaggtcagcaaactttttctgtaagggtgggatagttaatacttccagctttgcagaccttatagtttctgtcacaacgactgaactctgctgtgttagacaaaagaagccatggataatacaaatgagcatggctgtgtttcaataaaactttatttatacaaacaggtggtgggccaggtttgatccctgagctgtagtttgccaacccttgttgcagaaaataagtgagattcctgcaaaatggggagcctggcacatcagcactgaaaaagtagcagctgcagttacttttgcaggcgcctcttgtcactaccgtcccagggcatacagcaggcaggtggcaacactggagtctatgttctaccctctgtgctgtgctgagcacagtgctgggtctcctcctcactctcgccctcctctgacccaccttagagcttgcactgtgggacgacctttgcattagcacctgtttatgccaagtgctacatgggttggggagtgttatggtgggggcaggaataggggagataatcctgccctcagggtgctgtgctgtctagatgaacacctaggaattttttttttttttttgagacggagtctcgctgtgtcacgcaggctggactgcagtggcacaatctcggctcactgcaacctctgcctcctggtttcaagcagttctcctgcatcagcctcctgagtagctaggactacaggcatgtgccaccacacccggctattttttttttttttttttgagatggagtctcacactgttgcccaggctggagtgcagtggcgcaatctcagctcactgcaacctctgccgcccaggttcaagcaattctcctgcctcagcctctcgagtaactgggattacaggtgcccaccaccatgccgggctaatttttgtattttcagtagagacagggcttcactatgttggccaggctggtcttgaactcctgaccttgtgatccacccacctcagcctcccaaagtgtcgggattacaggtgtgagccactgtgcctggccttttcttttttttttttttttcgcgacagttttgctcttcttacccaggctagagtgcggtggcatgggcttggctcaccacaacctccacctgctgggttcaagcgattctcctgcttcagcctcctgagtgctcgcgccaccctgcccggctaatttgtgtatttttagtggagacagggtttcactatgttggccaggctggcctcaaactcatgacctcgtgatcctcccaccttggcctcccaaagtgttgggattacaggcgtgagccaccacgcccggcctataggaattttaaaaactatctcaggctgagaaataccaggccaggttggagatgagagccatcagagcagcaggtcccttggcgcccctgagctctcccttctcttccccccaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggtagaccctggggtgaggggagcagcctattgccaggcagggccatggggctctgagactggcactcagggccccaggattgcccgagacccttcccagctcacttcacaggcagacctgcactgcgctgtttccctctatagaaaccagtctttggtcagcacccgcgtgcagcctgctcttaactaagattctctacccggcctccctctaaacctgttctgtttgtggtttataccccatctactttcaggaagggtttgactgtgcttacaacacagaaacagcacacaggaagttaccgctgaagcaaaggaggcagcctcagaaatggagtgttgggggatagagctctaaggcttgttggcttccctctagggttttttgtttttgtttttgtttttgaagcggagactcgctctgttgcccaagctggagtgcagtggcatgatctcggctcatagcaacctccacctcccaggttcaaatgattctcctacctcagcctcccgagtagctgggatcacaggcacgcaccactatgcccagctgatttttgtatttttattagagacagggtttcaccatgttggccaggctggtctcaaactcctgatctcaggtgatctgcccacctcagcctcccagagtgctgggattacccctctggggtttactgagcctgaagtgcactcagcacagtgctggatgccgggtactggcggggagtgacacacagcccctgtccactcctcagccttcatggggaaagcagagcacgcaaacaaaaaataaacatcagttatttgtgtcgtctcggagcgagcacaggctgctgcgggagctggcgctaggggctgtcccagtggagtagaagggctgggggggcctggcaggagctgaagcttaagctgtgacaggaagcagctcgtgaggagacagggtgccagcctgcagcccggggagcactgtgcatggaagccaaggtcacgctgaggcagtgtcagttcagcaggccttgcagaccatccttaggtctcctggcagcccaggcctggtggcacctatcagcagcctctgaatggccaaagggtttggaatctcagtggctgaccaagtacttgagtgagagccggtgtgggtggggccaggaaacaaaggttaatgccaccagcgggcccttccaacacagaatgacagaacacatgcccttggcgtgtctgactttggatagcaccctatcgtgagccagcctagacgagtcaccatgagtgacagtcccggctgtggttggggttgaccccgtggacaggagtgtttgacacagattgtctgaacagctgagaagtgaccaagcccacatttgtatcagcagggcacctagctattctttcaggctcttagcacagggctcggttgtttcagaaataggctccagccaggcatggtggctcatcctgtaattccagcactttgggaggccaaggtgggtgggcgcatcacctgaggtcaggagttcgagaccagcctggccaacatggcaaaaccccatctctactaaaaaaaatacaaaaattagccgggcgtggtggtgcgtgcctgtaatcccagctacttgggaggctgagacaggagaatcacttgaacccaggagggagaggttgcagtgagctgagatcacaccactgcactccatcccaggtggcagagcaagactctgtctcaaaaaaaaagaaaagaaataggctctggccaggcatggtggctcacgcctgtaatcccagcactttgggaggccaaagcaggaggatcccttaaggccaggagttagagaccagcctgagcaacctagtgagaccctgtctctatttaatttaaaaaaaaaaaaaaaaaaaaaggcccttgccgtagctcctatctccaggccagccaggccggagcgtggctggggaactgtcctgcctgccaagccaggccctttggtgatacgtccccagttcttcaacagagcagggtgcttgcccccacctcatggcatgcagggggtaccagggtagacatcatgtgggcatgaaggcttcagtgacagatgtgcctgtggccagggtcacagtcccctgatctccagaatataactgaggactgaggatgggcacttcctggggagcccatgtccctgcctgctcagaggcatggagactgcaggcgttgagcacagtggccctcgtacccactctgtctggaggccagtcagagggcatgtgggtgctacctggtctgagcagtgagaactgacccttcatcctttgccaccactgtcctcccattgtgccccaagtaccctgggccccacctcaccctgtagatgaggaattctcattctggcctgaacctccgtgagctgtgtgcacgggcgtgggtcagatgccggctctggaggacagagggctgcgtgtttttcttatttttaattttattattttattttttgatttttttggagatggagtttcactctgttacctaggctggagtgcagtggcgcaatctcggctcactgcaacctccgcttcccaggctcaagccattctcctgcctcagcctcctgagtagctgggattgcaggcgcccgtcaccacacccagctaatttttatattttagtagagacggggtttcaccatgttgatcaggctggtctcgaactcctgactttaggtgatccgcctgcctcggcctcccaaaatgctgggattacaggcgtgagccaccgcgcccggctggctggatgtttttctagatctctcccttctggagcctccctgtgagtggagccagctttgagagaggaacccatacaaaaacccaggtgactgaccctggcctcaaaggacaaaggacgtcctgagctgaggggtgtgggtgtggccctagctgagtttctctccttgcagggcagagagagctcccttgctcagccacctttgaggacagacaggacaaggggcaggcatgagcccctgcctggtcgtctgtgagaccatgtgtgactgccaggccccaggcacactgagtcaccgcgcctggaaaaccctgtggcctccagtgttgcctcacacctgccacttccttttcctggagtgagtggtgctctctgtgatgactcccaccggcctgggatctgcctgccacagtgtccctggggagactctagatccagacccacatggcacggggctgcctccctcaggcagttctcagccaggcccccacccagggcacaggctcaggctgagcggggtggtggatgggctggagccggggagaagggcagcaaggctggctggccgcagccctctgtggctggacacgacttggcaaggccgagggatctgagggctgggctactctcgagggctgccaggttcccagcttgctgcagggaaatgaagggggtgccgccctgaacaggcacatgcctaagcaaggtattgatgcttggataaagctggcaaccaccaggagaagcctttttgggatttttcaaatccttcgtcatccgagctgtgatgatggagtggagcgtggcacgggcccattggagttctgtgggctccatcggcactcagcagggatttggacgtgcaggctggtgggccctgcaggaagcctgctccctgctctgctgcgtgggagggggcagctcgggggaagggggcttgcagagaaacagaagaacatgggctgtggggcaccttcagcagcccggggttccaatcccagctcctccatgtgggagccaagcaccccaggcagcctttcccagccttgcttagggccgggttgggagaatcccaccccgcagggctgtggtgagggttgaacggagggtgtgtggtgagggttgagcggagggtgtgtgatgcgtggtgagggttgagcggagggtgtgtgatgcgtggtgagggttgagcggagggtgtgtgatgcgtggtgagggttgagcggagggtgtgtgatgcgtggtgagggttgagcggagggtgtgtgatgcgtggtgagggttgaacagagggtgtgtgatgtgcccagtggtacacgacaaattgccttctttgggttgacagactgggttttactcttcctgaatcatcacaatgatccgtgcaaggccaaggctgttgtcttctgtttcaagtgcgttttcctgtcctgtcctctgtcctgtggcagtggacagctgtggctcttgccagattgtgtctgctcctaggactgtgggagccggtggtggtagcggccttgagcttgacccatccctcctgcttccctgttcctgagcgagcaccttggagtatccttggagtgtccttggaggctctgctctcgggggcagcctgggccaagagagcgcctgatgctcaccccgtcctcacaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggtacggctgtcccgaggccccatgcaggctggtggccatcagggcagaaggaaggcccagggcactggatttggagggaatcccatctccatggggaagggcctccctgaacggaagcagctgggttaatcaccagcaccccacccaactcagagttgacccaggcggtgacactgcagaggggaatgtggtgactcaccctgcgtggtggggggagggcagggccatgccaggcgctctggtgccctgtccatgaatccttgccgcagccctgcaaggaaagagctggaggtgcctcctgtgtacaggttagagagccaagggccagatggttttgccgagtcgcccctgctagtgtgggggagcagcactttatgcttgtgaagccctgactggaaccacttggcctggagtctgggaggggcctcccttcccagcccttgtccttcctcccccgcccacaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcctgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 36971 - DNA, 64294 bp, Homo sapiens
ggagtgggccaggccgccagccccgccagccccgccagccccgccagccccgcgatggcttgggccgcgctcctcggcctcctggccgcactgttgctgctgctgctactgagccgccgccgcacgcggtgagtgtcctgctccgctcggccccgccagacaaagggggcggctcccgcccgggctgcagcccaagggtctcggagcccgcggccggcccggcccgagtcccgctccagtatcccgggcaaggcgagaccctcggaggtgggagtcccggggccccgcacgtgggtgagggggccaggccgtgctccccctgccaagaaggtgcaaggtgggaaggtgcggggtccggtaggtcccccggggcgaatcgcccaccgcgacaagtccgagtctggcccttagcgcgacggcagggacctaggagggggtttcaggtgaggaccgagggtttgtgggtggggagccgtgcggggacagcctctgcgtggcccgggtggaagaagcgctctccactctccagcctctgcctgcacctggcacccacctacgcgctgtcaaaccctgccttgctttcggcagtcctatagggatagcctcgctcctcaacccattacacagatgggagtgttgagccagcggagtgtagagcccctgggggatgtcttgatcatgccctggaaccacccaccccgggattccccgtctggaagacgggggtcggtgggcttagtaatttcatttgccagggagaaactgaggcctatgaagtctctaccttcccctgaggtcccacagcctggacagaacggagccagggtcagatgtcacagcctcctggtcccaaaggttttccagctccattgagcatctgtgatttaggagaaaaagtaaagacagcctcaaatcaaggagatagctgtagctctccttttcataaaatattttttaagttaacttgaattgcataaggaatagctgaatacattcgacttaacacaaatatttatcctgttataggtaagaccgaagccccttaaccctcccccagcccctgaagtctagtcctctctccctctctgggcctctcctgttgctgagtctgggtagaaccttccatatttaaaaaaatatactttttatttgagactagtttgggatttacagaaagttgcaaagatagtacaaaaagttcctgtatttctctcaccccgttttccctattgttaacatcttacattgttatgggacatttgtcgccactaaaaaccaacactggtccgttactcttaactaaacttcaaacttcacgggattttatccagtttcccattactgtcctcttttgttccaggatccggccccaagttaccacattgcctttagttttcatacctcctcagtctcccagatgttttaaaaattactcttacataaaaattactcttacatacatagacatgagcttgtagctaatacagagccacgtaagagagagttagtttacattcgtgtctgaaaattccggaaaccttgggaactttttgatttttaaacaatatggtagttgaattttcaaacaataagctcactgtatttttcttcaacctccagacatcttttcagctgaaatttacaactgtgtagtcaatcatttgccttaaaacaagaaaagaaaaagacagtgaataaatgtctcagggaagaaatgaattatttttcctgtcaggctttctcaatacactgtatagaaatgttttcagacattatgttgcttgctcttttcactccagattttagttttgacatctgttctttttgctacaagcagatctttttgctacaaggagatcgaatccattcttttgatcctctctggagtcttccatcatgtgaatacgttatgggctctttttttgtttgtttgtttgtttgagatggatcttccctcttgttgcccaggctggagtgcaatggcacgatctcggctcaccgcaacctctgcctcctgggttcaagtgattctcctgcctcagcctccccagtagctgggattacaggcatgtgccaccatgcccagctaatttttgtatttttagtagagacaggatttctccatgttggccaggctggtctcgaactcctgacctcaggtgatctgcctgcctcggcctcccaaggtgctgagattacaggcgtgagtcaccgcgccctgctgagcctttgatttttatacctgtgggcaccttggaagggtcaacagtgggtagtggggagaagtgtgggaatgagggtcactggcagcttgagggtaggtgcatggaccctggggaccccagtttagatccccaatctcactttctccttccagttcagctagggacactctggttatctccattttacagaggaggaaacaggctcagaaaggctaagcaacttgctcaaggtctgtctggattaaaactctgggctgtaagaatttttagcttttacttttagtgataggatctcacactgtggcccaggctggagtgcagtgtacaattatagcttactggagccttgaactcctgggctcaggtgatcctctcatcttagcctcctgagtaggtgggactacaggtgtgtgccaccatgcccagttaattttaaaaattttgtagagatggcatcttgccatgttgtccaggatggtctcaaactcagctcaagcgatcctcccaccgcagcctcccaaagtgctggaattaccggtgtgaaccaccacgcctggctttgcaagaatttttaattcacaggaagaatgaattctcagtcttcccacacattatactggtaatctgaacactcaaaagtcttagaaccatgtgacttttagatactaagaaatgcaactacaagcaaaaaattcttaaagaaggacaatggccgggagggcggatcacgaggtcaggagatcgagaccattctggctaacacggtgaaacctcatcgctactaaaaaaaaaaaaaatacaaaaaaaattagccgggcgtggtggcaggcgcctgtagtctcagctactcaggagactgaggcaggagaatggcatgaagccgggagatggaggttgcagtgagctgagatcctgccactgcactccagcctgggcgacagagcgactccatctcaaaaaaaaaaaaaaaaaagggcaaacaagtgaaacaagtgggtgaccctgatgccgtctgaatggtgatccagtttgggttaaaataagcaaggctctccagctcccttgtctcatttctttatcctgaccaagccttgaggtaatttccatcacccttatcatacagctgaggtttaaaaagatgaagtgactttcccaaggtcatacaaaaattatactccacatctaggcccctccaaaattcatgcttatcccagtaagacaccactacttctgggagtgagcaactccgtctttacctttagaatttaatttaaaacttttaaattaggaaacatttcaactatacagaaaaagaaaaagaatacggtaagaagccccatgtacctataccttgatttgacagtcattaacattatttaaaaaatattagacataggctgggcacggtggctcacacctataattccagcactttgggaggctgaggcgggccgatcaagaggtcaggagatcgagaccatcctggctaacacgatgaaaccccgtctctactaaaaatacagaaaattagccaggcgtggtggcaggcacctgtagtcccagctactcaggaggctgaggcaggagaatggcgtgaacccaggaggcggagcttgcagtgagcggagcttgcgccattgcactccagcctgggcaacagagcgagactccatctcaaaaaaaaaaaattagatgtcatgatattccacccttgaatatttcagaatgcatataaaactgacaactacaattctattttcttgcctgagaatataaaaagataattcttaatgtcatgtagttcccagttcaaattcaaatttctgcaattacagcaagaattttcgagccccattcggtgaacatgagggtggtgagctgagagttaggagtatggcttgtgggccccttgaaactaattgatttgccttgtgagtatcagaagcattcttcctgcttcccaggcctcagtttatctgtacttcgaggtggctcatggaggtggtctctcaagccccagccatatcaccaggctactgcatctcttcctttgggcttgtgtgaccaccacagggagcactgagagagatctcttggttgggaggctccttttctgggggtccggaaggcatagtggcatcaagcgagggtcactgtggcccagtggctggtctgggcccttgcaggatgcagaatttgtaggcacaaataaatctgtctcattctaacatgcactgaccagaggtcacccaacagtggtccgtgactggattcagccctggatgggctgggtttgtgctgtgtgggacatggggagaaaattgggggattccatacacaaaaatctagatttccaacttcttctgaaaaatgggaagatctagcaatactttcctgggactcagtggtagcaccctctctaaatcttgccacagtccccactactccctattgcctctccagcatgcagctattctagttaccactgtacttcctctgctgttttttcctgtgttgagaaataattctgtgaatttgtgtctatttcaaaaaccagaaaacaaaaactagggcaaggccacgtgctttttatgcacagtggtagcagtgcggggcaggtatggaagagcatctgggaaaccctgttaatggcagactgaaaaccctggaggcctgtgggtgagccctgggggaagaatgggttaagcaggttaaacagaattttgggttgctccagctcacctgtgcaactaagcccccttttgttccccattaaatcctcccagagcttaaggccctgcattgagttgaaatgattgaacagagaggttgggcagtctacccaacattgcacagctgaaccatgccagcctctgctctggacaatctagaagatggactctgtgtcaagtgcttaacctgcattggctttcttaaccctctcagcaactctgggaggcaggtgctgcccattgagcaccgactgcatacatgattcattcagaccagccactgttctgagtgctggagtgaacaacacgccctcccttcatggctcttccatctagtgaagatgcgatacgtcagggggcatggaggcgggtgacatcccatccttgactcctttccctggttcacaaagggtcaagtgggagagagatccagggcaggcgacaggggtcagtgagtgaggaataggccgtttttagaggaacccatgtgatggggctccagtcggaaatcagaaaagatgccttgggatctgacccagggtgggcaggaaaccggctgtgtgggcaggagccggggatggaaaggtcagggcccaccgccctgcccgccagggcctggcagtacctaaaaaaaagtgagagtgtccgtgggtggggctagagcccacagtccccaaaacagagcctccttcgcccccgctggctgcaggctgagtcaccctggaatgtgaccacggcctgagttggattgagggcccaaggctggaggagccaacatcaggggtcaggcgcctgggctccgggcttcctgcctttgtctgcgcctccttgggacttttctggggaaagaggaaagctgccaggaataacacctggctcgctggggagctccggccacagccaggagaaaggcaggggaagaaagcctgctcccgcctgcaaagatgttttaggagaaaatttcagggcctgcatttgagtaggtctctggaatatctctgcaaaatggaggtgaaaatgcccacttagggtgactgggggccagggtagtgtcaagagggtgggcactgcagccagacctgtctggattagaaacccaagtcctctatgttggaccctctggcatgtgacttagccctctgcacctcagtttcctcctctgtaaaatgggcctggcagtaataattgcttcctcataaggttagggggaggattcattgagtcactgggataaagtcctcagtgtggtgtctcccacaccatcagcgttcattaaatgttagccattatttccaaacaaggaaacgtttggaaaatgccaagtatagctcctgatgtgtagttggcactaggtaaatggtgcccaggaatcttactgctcctgcttctcagctgcttcccagctactaggtgccaggtgctctgtaactcccctcatccttggcacagcccaatgcagtcagtagcattattgcttccattttacagatgaggaaatagaggcatggagaagctaagtcacacagccagcaagaagcgtggctgggatttgaagccaggaagtatggtgctaaagtttgggctcatcgtgaccatgccctcctgcctcttatgcaaaaatcactgcttctgggtccagtctgccaggctctgacctgggctggaagggggctgccatgaaccagttattccaaggctacttgggcagcacgacacgtggagacttcaggagaagtggccttagcccaggggctcacaaaaagatgaggcacaaggcaaggccctgcacctccttagactcacagagctcaaatttgcaagtctcctctttgactagagaagccgggatgggctggggagaggagggaatggttgggagaggcacttcctaggccctcaaatttcatctttgcttctgctcccatccttcccagccttggccctcaaatctggccatttgctcctgcccacgagctgtcccaccctttgggttatactgggggcagccaggtagagggaaaaagggagcaggagacaggggcagagggaggtagagagggagggggaaaggaggaagagaagtggctgcttccctgaactgctgggtgtggaacaaaaggccctgtgctgaaagtgggagactcagatgttaggtctggctccccggggaccatggccattgcttccaccacattgctctcctgggggggtcacggtagttccctgacacatctccttccttcctcttgtctttctctggtatgaccctttaaaggtgtggtcacatcacttactggctcctgctgcaaaccctccagtggatccctgccacgcgtggcataggagccggactcccaccttggccttggccctcgtggtccacaaagtcatctccagcatcatcgcctacgtctcgtccccacattctccactccagccacgctggctcctgctgtctcgaaaacctcaccgagcatgctcccaccccagtacctttgcacttgctgttgcctctgcctgtaacactcttctccctgcccctcccagagcactcccttcacatccttctggtctttgctcacgtggcatctcctgaggaggccctccttgaccaccttttgtaaaccagcccccctcactgtctcacaccaccctgttttcttttttctttaatggaatataattcatatcccatttagttcacccttttgggctgggcatagtggctcatgcctgtaatcccagcactatgggaggctgagacagggagtgcttgagcccaagagttaagatcaacctaggcaacacatcaagaccctgtctctataaaaaaatagaaaaacaaagtcaggtgtgatggcatgtgcctatatatagtgccagctactcgggaggctgaggctggaggattgcgtgagtccaaacgtttgaggttatagtcaactatgatcatgccacggccctccagctccccttttaaagtgtataattcggccgggcatggtggctcacgcctgtaatcccagcactttgggaggctgaggcagatggatcacaaggtcaggagttcaagaccagcctggccaagatggtgaaacccatctctactaaaaatacaaaaaattggccgggcgtggtggcgggtgcctgtaatcccagctactcggcaggctgaggcagagaattgcttgaacccgggaggtgcaggttgcagtgagccaagatcgcgccattgcactccagccttggcgacagaccaagattccgtctcaaaaaaaaaaaaaaaagtgtataattcaatagtttctagtatatccaccgggttgtgcaatcatcaccatcatctaattccagaatattttcatcacccctaaaagaaaccatgtacccattagcagtcactccccatttccccctcctccagccctgggcaaccactaatgtactttctatctctattgatttcccaattctggacagttcatataaatgaattaatacaatatgtggccttttgtgtctggcttctttcactgggcttaatgtttttaaggttcacccacatcgtagcatgaatcagtacttcattcctttttgtggctgagtaacgtttcgtggcattgatacaccacattctgtttatccgttcgtcactcaacgaacacttgagttgttttcacttttcagctattacgaataatgctgctgtcacccgaaagcggtcctgatccagaccccaagagagggttcttggatctcaggcaagaaataatttagagtgagttcacagagtaacgtgaaagcaagtttattaagaaggtaaaggaacgaaagagtggccacaccatagacagaccagggcgtttccgaaggcaagaggaggaatgtgtctgccttagttacaattcttcttgtttatatagaagataaaaatcatgggagaggtgtgctcttctaccacaagggctggggacaaaagattgttacctaacaatcttccataagaatctatattattatctttaaagcaaaacttattcttaaactaagaaggcttttgttcataaaatatcgggacagcaggatgtttcctgggtctgttaagtcctggatctgttaagtcttgggtctgttgggtaagcatgatttaacgtgttcccttgatcgtaaacatcctgcgcttaagaatgcctagcttcctggcccagcatggtggttcacgcctctaatcccagcacttggtgaagcggaggcaggtggatcacctgagatcaggagttcgagaccagcctgaccaacatgatgaaatcctgtctctactaaaaatacaaaactagccgggcatggttgttcattcctgtaatcccagctacttgggaggctgaggcaggagaatcacttgaacctgggaggcggaggttgcagtgagctgagatcgcgccattgcactccagcctgggcaataagagcaaaactccatctcaaaaaaaaaaaaaaaaattgtctaacttcttcttgggattgcagcccagcaagtctcagcctcattttacccagctcctattcaacatggagtcactctggtttgaacacctctgacactgcttacgaataatagtgtatacatttgtataagatccaacgttttcaattctttagggtacattgctgggtcttgtagtaagtctatgcttgacgttttgaggaactgccagactgcattccaaagcagctgcacgattttacattcccaccagcaatgtatgagggttctcacttctccacatccttgctaacacttattttcttcccttttttggtggtgggaacagggtctcgttctcttgcttaggttgtagtccagtggcacagtcacagctcattatagcttccacctcccaggctcaagtgatcccccaaactcagcctcctgagtagctgggactacaggtgcacaccaccacacctggctaatttttgtattttttgtagagacagggtctcaccatgttgcccaggctggtcttgaactcctaggatcaagagatcctcccactttggcctcccagagtgttgggattataggcatgagacaccatgcccagccttattttccttttttaaaatttttgtttttattatggccatcctggtgggtgaagtggtacctgtaaaccaaaaagtgtctgagacaggtctcaatcaatttagatgtttctttttccaaggttaaggacatgcccagtagagaggtctgtgcctttctccaaagacgactttgagggtttcaatacttaaagcgggggaaaggtgggctgtaagagaaagagggaaggtatggtaatccccatgtcacaagagaaaaggaacgggtagggcgatagtcaatgatgtatttctctcatgcacagtaaatcagcactttacataaaataaggtgaacatagagtagctgcctatggagatactgaaacttttatctgtagctatctgcttaggaatagtaggaaaggcagcttcttgcatgactcagctttcagtttaattttttcctcatggcagagtgaattggtgtcctgagtttttattttcctttctccccggttttcttttctccctggttttcttttcttttcttctttttttttttcttttctttcttcctgcacgttttttgctctgcagcctcaaccttccagactcaagcgatcttcctgtctcagcctccctagtagctgggactacagacatgtgctaccatgctgggctaatttttttaatttttagtagagacggggtctcactctgtttcccaggctggtcttgaactcctaggctcaagtgatcctcctgtctcagcctcccaaagtgctgggattacaggcatgaaccaccatgtatgcctgccccccttttctatttaagatcttttggagaaagcattttagaagaaaatgaatctccggtctcaggttttgtctgatctctcatgtctaggatggtttatttctagacgaataggtcccacattgttaggaaagctcagttttagtaggttgtgaagtctcacatcacacaaagaaaataagagagaaagaaaacaggaaaaaaggaggaagtaagcagataaacaaaaaagaaagaacgaacctggaaaactgatagaggccatattactctcaagtccgtatatcagtaggcaggtatgaaaatgatttctgcatataaagagattgcttttattttcttccaaagtttaagttcagtttatagggctttaagaaaagcacagcttaacttttagtgatttcacatcaggaaaaatgaggggaggaaaaaaaaaagaagggaaaacattgaaaacattcttttggagacttggagccaggagaatttttagaattcagtccaaattgtggaaaataataaaaatggaaaaacattagacaagtctagactctaataacaggtgtactatagttaattttgaaacatgacttttctctctccaattccccaattttattaaagacaaaatcatagtaggaccaacttatttgtaaaataagttttagttatattatacttggcttgattattttcataaaatgcagcaagactgatcatttgccatatgagctctctcttctttttaaaattggctttgctggaagcttttccataaggaatctgagtctagacctttttaaaagcctcacacccagccaaggatttagctgtgcctgcagatacctgtatgaattgagtgaattcaaaaagtgacattctttgctttccacaggtcaggaccctgtaaacgacagggtatatgaagccagtttttccaaggtgcttttattagctctatagttcagccttattttctcaaagtagtctgaaaatatgtcattccagttaaagccttggtaaaataaccagtgtctccaattatgccctgttataaaagaaaaaagatacttaggcaaataactacattgccataaattaagaatactcacaaatagtttccaagttttggaaaaaataggtaaagagaaagaaattctgttttaaatttttctcatgagagtatactttactgaattgttaaaagctataaatagcttaaaagaagagaaagttttcttgactctgtaaaacaaaacaaaaagaatcaacaaatgttttaaacaaaaactcataaaagattatttcaatctcctgttagttcagttcatgcaattaactcctgttctgctcaagatgggattagcagtcctcatgaatacatcagttctccatgacagtcctggaagtttttctccctattccaatggcacaatctctaaggttgtcagaagcccatgtttaagagtactcctcagagttctatagctgattataaatcacctataaaaagatcaaactaaaacaactgtggatgacaaaagtcttagaacagccatagttaaagacacaattgacaaggaaatttggttacgtctgtggtattcaatagttttacataataatcataattactactgatgatgtatactaagtcatatcagaatcacaggaatctcatacaattttggaacacatactcatttatataagcaactcatttatataaatataatccaaagaagattaaacaccatttcatatttgacaatgcttcctgtatgattttattttaccaaataagccgaatatgtctcttttggacttcagaggacctaatgccaaaaaattaatgaggtcaaaaggactgaattgactattttattttggaaagtttgtcaaatatagaaagtttaaaacacttgacatcacaaaatagaatcacaggttattgtaaaataagtcattcatttagccaaaggtataactcagagatttcagaaaaaaggcaaaaacctttattctttttttttttcgagacactctcactttgtcgcccaggttggagtgcagtggtgcaatcttggctcactgcaacctccacctcccaggttcaagcaattcttgtgcctcagactcccgactagctgggattataggcacctgccaccacacccagccaatttttttgtatttttagtagaaacggggtttcaccatgttggccaggctggtcttgaactcctgacctcaagtgatccacccgcttcagcttcccaaagtgctgggattacaggcatgagccaccacacctggcctaaaaacctttattctttgagagaggagacttaattttccaaataataagctctaataaatacagcatgaggccaattaaatcctgtttctcaaatcttataaacaaatctattaaattttaatcatcttgaccctaagatgtaatttccataaaccattttctaaacttttataattttttaaagggtgggataatgcttcaagaaaaccttgttaatctgacacaggagcccagatgctggtcttgcatcagtgtgcctttgatgttaatgtttaattaatagagaaactctgaactaatttaatctctcagaatcagcccttacaatctcatatgcccacctcttccatgatagtccctgggcctagagaggttgaatagttttcatttctggctccatgtctcacaaatgcagcttattttgaatgtcatctcctcctaggtctgaagatgatgctttaactgctgtcagtgtttaagatttagcaggactcagtgtcctttttagacccaggagtcaaagccctgtaactaaacagcaccaggactttaaaaacattacagaaagttacaaggatgtaataaccttcattaaaaatttttttatatcagctttcctaggcaaatcaaaacacagaacaatttagacatattaagaaatgccaggagcacagaatgttatattggatgaaaacatttcctttagacctttatgataaagcatttttagcatcaggctacaacagttaggacctgagggaaaaaatttatatgagctgacgaaaatgttgatggagagaattattctctcagtccttctcaaagaggagagaaagctgaaaatagcaagatgcaataaaagttgaacttttgagttaaaaaaattaaaatctcatgtaatgttattaacagtaaaataataccttaagaaaattttgttctaaccaattctttagtgtattagtgcatttttaatatcaaaacccaatctctagaaagactattataaataatttccttttaattatagtcaacttgttcacataaaatgtttttcataaattctctttttataaaccttattatgacttacacaaaccatttacaacatgcttcctgttttatcctaaacatctctctttcgtaaatgatcaatcattttattttaggacaaaaaatttttacgggattctttccatatacaattatttttcttttaacctttcttgccaaagatacccctttataattttctttacatgcttcttatttacttattctttttacgttgtttaataaacaacctttgaattagacaaaactatttccttttaataagaacacttttttaagaaaaatgtttttctgtaactttttaaggaaaaattggaaatgacccagacatttaatgggtatctattatttaatttaatatcactttagattctgaattatatgacatttatttataagcatttatttcattacatttacctaattaattttttaaaatagtttacctagattacttatgaaaactgtgatagtcactatttaaagttatttccctgttaatcatttttatagctgtgaatttcagatgtttacttaagtaagaactttaaagttaaatacatgtgtgttttttgttttttgccaataactcaggatttaactgttttcattaaatgaacaatattaaatgccttatttatcaaaaagttacacaatgataattctcttttgggctggatttatagcttcataatcctcatgccaaattttgtcaccttataatatctagcagagataaatatataaccccttgactaatacatataaaacaataatgtatattgacaattctgaaaccatttctaattttattttaccaataattttaaaaccagcttatttgttaaagatttacttaagtcatgtgagcttgaaaaaccatttgggcttaaagtttctatttttctgataaagtatttgatttttttctttaagccaatttattagacctcttatgtatttttttgtagtgaaacattatatacaggacatataaatacatagacagacaggcagcagtagatctgataagattcataagacccctttttttctcctgttataaagctcctggcttttcttaatatgtctaagttgttttatgtttttatttgcctaggaaagctgatataaaacaattttaaataaaagttattacatccatgtgactttctgtatcgtttttaagtcctggtgctgttaagttatagtgtttgactcctgggtctaaaaaggacaactatcttagacttccaatttcttgataacctgtttcattaccctaggcaattgtcagccaaacttgcatactaaaggaacaactcttgggtgaaaatcagatagggaaatgtatatctctaaagagagagagagacagacagagagagagagagaaagaaagagggagagagagactgggtgtgttagagggagattaaaaatggatgccaagccacaagccaaacataaaattatagaaatcttctgtaggattttatgaggagacaaactttatttagataggtagatttaaatttagtctctgtcttttaactggacctctgagctctgggcagagtccacactgaatcctgggtctctaaaaggagagagatatcatgagactaagccatgtaatgcttttacagtgcactttgttacaaaagcatttctctaagtattttaaccactccctctcttaaacacacaagagtagttcctgtagtaatagctattttagttaataaaaaaaaaagaaatcagataacgcaatacaaaaacaatcagtttaagatctgagaggaacttgtctttttacactcttagggtttcataaggaaaaacagaggtttctccccagaaggagtctggcaccttctctgttttctttaaggaatcccaggctgttagaaattattttaggtcccttatgcagcagagggcggcaagaggaaggagagacaggcagaagtaaatggagaaaacagaattcagtcgactgggaagaaaaaatctttttctcaaaaaacaagaacctaggagagaaaaaagaaagcataaaggcatacacacacacacacacacacacacacacacacacacacaaacacatacacatgcatacacacacatacacacgcatacacacacacataaacacacacacatacataaacactgctgacaaaaagagttaaactctgtaaaatatttgaggagatttattctgagccaaatatgagtgaccatggcctacaacacagcctcaggagatcctgatgacatgtgcccaacgtggtcaaggcacagctcggtttgtacattttagggagacaggagatatcaatcaaatacattgacaatatacatttgtccagtccagaaagacaggacaacttgatgtggggggtgcttccaggttataggtggattttaaaactttctgattggcaattggttgcaagagttattgtcaatagaaataaatgtctgggttataataagaggttgtgaagaccaaagttttctcatgcagatgaagcctccaggtagcaggcttcagagcgaatagatgtaaaggtttcttatcagacttaaggtctgtgttgatatgaatgctggagggtataatgagtcatgtctgacccccacttcccaccacggcctgaaccagtctttcaggttaaattttattttattttttttgagacggagtcttgctttgtcgccctggctggagtgcaatggagcaatctcagctcactgcaacctcctcctcctgggttcaagcgattctcctgcctcagcctcccgagtaactgggactacaggcatgcaccacgaccatgcctggctaatttttgtattttcagtagagatgacgtttcatcatgatggccgggccggtcttcaactcctggcctcaagtgatccacctgccttggcctcccaaagtgctgggattacaggcatcagccactgtgcctggcctgcactttaccatctacaaagcaggaaaaaaaacttcaaacttgccttccttgttggaagtgagttgaaactccagaagggagttacgtgctctccatcgtcatggaagcaggaaaacttgccttccttgttggaagcaagtaatactccagaaaaggagttgtacaacaaaataaaacttagctctcaaattgtagctctcttagatctcaaattttcagagattcgggattctctgcagcagggagctcccagccctactggtttgaccaatgaagacagataccaagctgttaccaaacaccaacaggagatttgtcaaaggccagggccacctacatggagtcccttcatggtcgccaatttgtaaactaaaaagtatctaagctaggtctcaatcaatttagatgtttattttaccaaggttaaggacaatgccagggagaagaaaaaccacagaatcacagaaacagtctgtggtctgtgcctttcttcaaagatgactctgagggtttcagtatttaaagggggaaaagtgggctggaggggaaagagggagggtgtggtcatccacatgttacaagagaaaaggagcaggtgaggcaatagtccccgagtgctccattcagattacctccccgactgctccattcaaaatcacactctgcaacctacactctttatgcccttccttgccttatcaaatggtgacaagtgccatggcttctgtaggcgacctggtgagcctcccctggacctgggcagcatcccctggttggggtatgccttggactttggaaaagatgctgccagcttcctcacgaggatgaaggagaagcacggtgacatctttactgtaagtgcctcttgtgcctcgggagggatggggatgagcagctgggcctcatatctggtttctgttgattccttcaacatatgtccctatgccaacccccccaccccaccatccaacatccatctgagtggtcgagccaactttctatccagctgcctgtccagctgcactctcaatgctgacctaacatcatcccttcagtctccctcttgctcttcccagcgtggagttatgcagtcactcaatatctatccaatacttgtatatccatgcagctgacctccatctatccattccatttccatccgttcaacatccatcttcccatcccattcttctgcctgtccacctggtgtctactaagcgtccttccatccttatatctactcagcattcattcgtcaacctccgtctatccactcacccatcagtttttccatagattcacccgacatctgtcaattcatttatccatcttctatcccttcatgtgtctgcccagatctacccagagttcttccactcatggatccaatgttcatccaactttcatctgtatacagttggccccctgtatccatgggtgggttccatatctctggattcaaccggccacgaattgaaaatatttgggggaaaatgtgttggtactaaacttttttagacttttttgttgtaattcttccctaaaaatatagtttaacaactatttatttagcatttacattgtgttaggtattataagtaatctagagatgacttaaagtatatgggaggatgcatgtaggttatttgcaaatattatgccattttaaatcaaggacttgagcatccatagattttggtatctgcaggaggtcctggaaccaatcctccatggatactgagggataactggtcagtttccaccaactttcatttttctgtttatctacgcatctttctgttcatctgccactatccacccaacactcagctatattcagtattcgatgtctccccactggatatacatctatttatatctcatccatccatccttacaacatctattcaaacgaccaccacccacccaccttccatgtatccttccaacttccatccaatcaacattcatccttcactttacccagtatctacctagcattctctcatccatgtacccaacatttattggtacatttggtttccaaccaacctctagctgcccttccatccatctttccatccaacatagattcattgatctatccttccatttatccatctatctaacattgtatccacaagtatttacccagcaatttccttccttccttccttccttcctccctcccttccttccttccttccattcatttacccattcaccaatccatccatctgcccatttactcttctacaatccacccactggaatttacccaacagcatccatccatccatccatctattcatccatgtatccattcattcttccttccatccatccatccattctttcatccatccatccatccacccatccattcatccatctacttatccatccatccttccttccatccatccatccatccattcttccatccaaccatccatccatctatccattcatccatccattcatccatccatccatgatgtgcacaggatccatctgccgccttctctcctggctactggagatatggcaataaccaagataatcatggcaggtgcttaagagtgaggtggtagagaacacagtctttgattttaaaaagcctcaatattcccaaattccagtcctagtcctgccacttctcagctatgagatcttgggcacatttcttctcctttctaagcctcactttttcagctataaatgggtgagtgatggtccctacctcacagggtggtaggtggtagtgaggcatagataagagaacatagtgtgttactgtccagtggggcagtgcctggcacacagtaaggccctgaccactgagagcggctgctgttcacagtgacactcctcactctatccctggcaacttcccacagatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgtgagtggctggagatggcacctgtgggagggccagggtgggcgactcatttctactcatgtggcccaagttattcttggttccaaagcaaatgttcggtaaagacattttgtcttgagaacacaaacagaaacaaaacaaaaaacaacccaaaagaattgggtggaagaagaactctttgtctctcatctctggcgggtttttttgtttgtttgtttgtttgtttgtttgtttggaggcagccctgattttagtaggaggagaccagggtttgggtcagccacacctaaattcaaatcccagccccatcactccctagctttgtgactttggacaaacctctttccctctctgagcctctgtttcctcctctgtaaaatgaaggagagaggtggaatgatgaatatttctgagtccatactctgccaggcagcatgcattatctcattagtcttcacaacaatgctggaggctaagtaacttacagccccatttcatagatgcagccactggatctcagagaagtgacttgtctcaggccacatagccagaagtggtacagctcctgaaacatatggaggaatcattttattttatttatttatttttgagacagagtctctctctgttgcccaggccagagtgcagtggcataatcttggctcactgtaacctccgcctcccgggttcaggcgattctcctgcctcagcctcccaggtagctgggattacaggcacgtgccaccacacctggctaatttttgtatttttagtagagacaggatttcatcatgttgtccaggcaggtctcgaactcctgacctcaggtggtctgcccgcctcagcttcccaaagtgctgggattacaggcatgagccaccatgcccagccacatatggagtcatcatatcaataagagaacagatgaacatgtttgctctgcattcattcagcagacatctgaggacccattgtaccctggtcattgccctggatgtagggtgtgcagaacggtgccaaccaccatttgaaggcagctattataggccaggtgtctgataggctcactttcatatctgtgcattagcctaaagaggtgggcatttttatccttattttacagatgaggacactgaggctcagagaggtgaagtgacttgctcaaagtctactgctagtaagtggcaggactgggatttgaacccaggtccactgacttcacagcgcattctccttcatctaagataccaaggctgataagaccctgtgtccgcccctgcagagttcacacagtccaatggcgatcttcagtgatctgtctccaggaggaataccctctggaggttaggaagagcatctaggaaactgttttgcaagatagttaaggctgaagcaaggccagcatgatgaagtggatgttgatgagacatgatgcctcctctgaaccttggcctgggggcagctgcttggagcctgagtgtcctgggtcctgacattccagggggaccctgggggtcccattagcaataggaatccacagctcactgaatctgcccctgctacccagggaggatcccagtttccttcagtgtttgcctcaggaattttctggaatttcttacaagctggcgtgatgtcttctgggcacagcagccacatctgttgagggcttgtctctgctgaggaccagcgcttggagtggggtggggagaagagctgggtcagggtccattgaaggccagatcccatgtattgagcacttacaatgtgccaggcaccgtgcggaacccttcacatgcattgtcatacatgagtcatgagccatgtctgtcgtttttcccactatgttccaacttgaacatcccaaaccttttcatacccaggagttcatggacgccctgtgcaaaccctgccctggtggattacccaggcacttctggcttactcagtctaaaggtgtccatcctacttcccaaacagcagtccatcctacttcccaaacagcaggcatgacagatcagggccctgattggcactctcccactgttcttgttgctgccactaggtgttgctgttgaccatgggctgtgcaccgcccatggacaccccacttcacttgctgtagggatatcctttttggtccagatcctacacaaggagcagagaggccttagacttagatgcaagatacccctttcttggcttctaatcatatcctcagtcatggctcagtgtagactccatatcatggaggctcagtataggggagcttccagcttctgccacactcttccagacggggcctctcctcactctgtgcaggtccacacgatgggaccagatctccagcccacatccctttttccttgtgtcactctcatgtgaggtcatgtcttttttttttttcttttctttttttaagacacagagtctcactctgttgcctaggctggagtgcagtggtgtgatcatagctcactgcagcttcaaactcctggactcaagcaatcctccccacctcagcctcctgagtagctgggactacaggcacctactacacatctggctagtgattctttgtgtatttattctatttttgtaaaggcagaatctcactatgttgcccaggctggtcttgaactcttagactcaggcgatcctcccacctcagcttctcgagtagctgagactacaggtgtgagccaccacccctggctaatattttattttttgttgagatggagtctcactatgttgcccaggctggtcttgaactcatggacttaagtgattctcccaccttggcctcccagagtgctgggattacaggtgggagccaccatgcctggccagggtcacatcttattggcagtcctgagtcagggaacaccacagctattccaacagatcttcctatctttagatttcagggagagatgagttgcttttcagttccttctcttccagaacgctatgggtcccttatccaagctgtgtgccttagggagggaaagactctcctggttaagaattcagatgctggagttgggcagaccaggatttcagtcccgctttggctgtgtgaccttgggcaagtcactttcctctctgtttctgagtttctccatctgtaaaatgggtgtcataatagtaactcttattcccaggtttgtctgaagacgaaatgagattaggctcagtataacagatgggaactattgttgacgatgacagtcataataatatcctcttatttaagctactcttccgcaggacctctttgccaatggggagcttgagctctgggacccttaggtttggggagggaggtgcctgtaggtgtgtatttccctttggaagccaaattttcatgcttttgtttcctgcctcaggactcttctccacagagagctccaggcactcacagaagccatgtataccaacctccatgcagtgctgttgggcgatgctacagaagcaggcagtggctggcacgagatgggtctcctcgacttctcctacagcttcctgctcaggtgaggctgtgcagcccccaccctcctgctggggcccggcactttgacctgtgtcagccatgagcagtggccaagggaaccgtgaggactctgtgggtgggggaagcaatttgagacacccaaagcaaagactgtaggaaagacgccatgcaccagggccccggctgttcatctgacctagctcatgaactgtaaaaggagacactggctggaaatgggaccttacaggtcattcagagaggaagtcacagagcaagacttcagaggtcatcttgtcctgtggcttccagactttgggatttcacagaacagaaaacaaaatgtttgggagatcaacttgggaccttaaccttttatctggtcttgtaaatgtatgttaaaaactgcacaaccgaacgttccttccttcagcagtgccgggcactaatccaggctctggggatacagcagggaacaggacagatgaagtccccaaattcacacagctgacactccagtgggggaggccgaattgagttatgtcagagagtgataaacacgatgacagagatccacgggtggggtgacagcatctggggggctttcttaggccgactgacgaggcagggtcatgctctgggggtctggcttctgagccaagacctaactgcaaagtgcccaccacgccaacactctaggcaggggaaacagcaggtgcaaaggcccagaggtgggaggaagctcagagagacggccagtgtggctacagcataaagagccaaggagggaaggtggacaggaggtcagagaagtgggcagaagcaggcctcaggcagtcgggaggtcagggaaggctttggaaattatgctgagtaagatcgggtgacatcaggggtttgcacaggggcaggacatgatctaacttagtttgaaagccccctctggctgctggatggaggatggactgtaggggtaaggaggggtggagagggaggcaggaggacctagcaggaggctgccaggtgtcaccaaggtgagagaatggtggtggcccagggaggtggtgagaatttgggtagcttttggagatagagttcactggctctgccggaagatttgactggggcagcggtggggatgggggagcgtgggcgtgagtgagagggatagagtggtgttaaggacagctccctgattttagtgatgcccttaaccaaccagaatttaatttaatttaaatttaatttaaaaaaggacatttcaacccctccaagaaattagagcaacatagttctaggataaagggcagtcattcgttgacacatatgggcatgtgggtatatttatgatatgtgtgtgcatatgtgtagactcggcgtgtctcagctcttttaatgctcacaatcgctctaggaggctaggactttacatattccatttgacagatgagaaaactgagacctggagagcctgagtcatttgcccagaggcctgtgttggggtcaggacagggctggtcccagagtctgcactctcagccacagctctcagcacacgaacagtccccattctttttgttttgccctggggtggtgcaaacagtgtcaagggctgtaattggtgtgggtgatgctggtctggtccaccctgcattgtatgatggggactgaggtccagagagggccagctgaaaccacccagcaagttcacagtagtgatcctcccaggtctcctggctcctgggtccctgtgcagacaaagaagtcagagagagataggctggggagaggcaggctcaggggcagctgggtctggctaggctccatggtacagcggcaggcacaggggaatcagctcagggggaatcagacgtaaatccatacctgtaacccggtaactgtgtcttcagggcctgaggcctgggctggagctcctgccccctggcttggcagctgtaggcctttccactgccatcaatcagcagcccctgaaatacaaagagaatgggccagttggatgggagggacacagaggtgaaaggggtgccggttcaggcagcccgaactgtgaggtgccacctcttacacccaccagcctggcctgtgttggccctggcctcactgagtcacacccaaagttctcctctgtcctcaccttgtagccctggcctcccctcctcccacctacctctctgctgccccttgagcaggtcaggcacgctctctctttgtggcctttgctatttctgttcccttgcctgggaatgctgttccccacaggtctgcgtggctcccaccccacttcgtttaagccttatcgcgagcgccacctgctcagagaggtctttcttgagtcccattttcgtgatggctccctcctgtgacccagcttggttcagctttatttttctttgtggctctagcgccgcctgtgggtcgtgtgtgtatttacatatgggattatcctgtcttcagccgtgctcttttgatatggagctgccggcttcgcttccacagagcaaaaccttgtggtcctctgggtttactttttctttttgttttcttttccttcattttattttattttattttaaagacaaagtttcgctctttcgcccaggctggagtgcaataatggcgcgatctctgctcgctgcaacctccgcctcccagattcaagcgattctctcgcctcagcctcctgagtagctgggactacaggtgccgccaccatgcccagctaatttttgtatttttagtagagagggggtttcaccatgttggccaagctggtctcgaactcctgacctcaggtgatataaccacctcggcatcccaaagtgctaggattacaggcgtgagccacctctcccggccggtttacttttttggtttatttttcattgcctgttttggtagaaatatatgtaccgggaaatggttctctgagttagcaaaaaacaacagtgcaagtgtgatgataaatgatgaccagtgtcaactgcagtgtcaccgagaccacagggccttgggagtaccgcagtggcctggcaagcacgtgtctgtctaaaaggggcggctgcaactctgctcctgctaggtttccaggtgggaccgcaggtcagccagattcctttttcaagatgagatgagcaggaaatccggattttgtgtgagtttccccaaatgtttgaaggaagctttagtttgtttttaggaactcccttgataaaacacatttgtggactgaatccagtgtgtgggctgcacctttacaacttctgccaccactgtgcaggtgagggacagagcagggaccacgcaggcctctctcggcccccacctaccctcattcctgcttccattctctcttcatctgggaaaacccctctcctgagagatcctggtctctggtctttgtctgcacagggatccaggagctcaaggggagggtgagagggtgaggccccggggctttggttgcgtctctttgttgtgactctctgctgaggcagagatgacaaaatgaaagcctgcagtttccctcccaggactgaggtcagcccgctgggctggggctggactcctggggcatttaaagggggctggaggtgaaggcgcgtcctctgagcgtggtcctgtgtgtgtgcgtgtgcgtgtgcgtaagtgtgcctcagtgagagcacatgagagctcatgctagctcccatgtcttaccctttttcacacttgaccaggccctgacctccttctcgggcctcccagagcccctcagatcaagcacaaccttctcactgctgcaaatgcctgccttgcgtggccagccctgacagcccaggccctcccatcctctgcctcacaccccggctccagtgcctgcaccagccacagctggcacctctcccaccaggcacggttgcactctcagctctgggcctttgcacaggctgtgcctgttgcctgaacacgttcctcttctgcttcccccgatcatcctgcagatctcagctcagaccctcccttctctaggaagtcttccctgaatccctccctgggagcaggcatctcctccccttctctgtgcccccatctcagcaccgtcccctcgagctctctgctgcagcctcatcagcctccttgctgctccccagcaccgggctccctcctgccccaggacatcacacctggtgcttgctctgcttcctacccctccctctgctctgcccatggctgactccttctcagccttcagctgtcagcttgacaccagcccctccctcacctggcacctgacaccacagcccccgccctcccatcctgctacccagctttgtgtctgacagtgccgcggggcaccagctggcgcattattcattttactcatcctctcgtctgttgtctgtctccctgtgctgagaggtcagctccttgaggacagggatttttgtttttttcactgccgactgttcagtgcccagaatggtctttggcgcacagtaggattagtagttgctcactgggtgtatgaatgaagctcttgtgagtagctgtggccacacatgagtgtcccaggaggacccctgaccctctgtctgccgcccccagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggtaagcaccatgggggccccagtgggtgggggggaggatggaaagacccagagggggagcccaattcaaggtagaggaccagaggcaacacaggcagaaagacatccaatgcccagggaggcagtaagatccccatcactgggggtatgcaagagcgcaatggtggggagccagggcttggaccagagcttgggttcctggtggaaattctgattcagcacatttagagtggggctggagaatctctgtgtgtgtgtgtgttcctttttgtgttttaaggtttgagttgctttaaaagtttttacaagtagttcgtgctgattataaaaaattcaagccatatagaataatttacagggaagaataaaagagcgctccactttctccccagcctcagcccaccacttccctctacagaggcaaccaccatcactagcttggagtacatcctgggagcactttctctaaacagacacacagatgtgtgttatttttatttttattttatttttgaagcttttaacttcttgttttttactgaggtataatttatatacaggaaagcacacacatctaaacgcactgagaggccaggtgcagtggctcacacctgtaatcccagcactttgggaggctgaggtgggcggatcacttgaagtcaggcgtttgagatcagcctggtcaacatggtgaaaccccatctctactaaaaatacaaaaattagccaggcatggtggcgggtgcctgcattcctggctactcgggaagctgaggcagaatagcttgaacctgggagttggaggttgcagtgagctgtgatcacgccactgcactccagcctgagtgacagagccagactctgtcttaaataaataaataaataaataaataaataaataaataaatgcactgagaagtggatctaaacattttatgctctttcccagccagtattcacccctgcgaggtagccactggactggtttcttttacctccaattagttttgcctattcttcagcttcctagaaatggaatcacacagtatgtgcccttttatgcctggcttctttcactcaacttgatgttgggagattcatccaggttgttgtatggatcaatagtccagtttttatttattttttgttttttgtcttaaaaacaatttttttgagacggagtcttgctatgttacctatactggtcttgaactcctgggctcaagcgatcctcctgccttggcctcccaaagtgctgagattatgggagtgagccagcatgccttttttttttttttttttttttttttttttctgaaccagggtctcactctgtcacccaggctggagtgcagtggtgcgatctcggctcactgcagcctcaatctcctgggatcaagtgatccttccccctcagcttcttgagtagctgggactacaggcatatgccactaggcttggctaatttttaaatttttttgtagagatgaggtttcactatgtttcccagactggtctccaactcctgggctcaagcaatcctcccacgttggtctcccaaagtgttgggattacagacgtgagccactgtgcctggccaacagcttgttctttttattgccgtatagtatttcattaaagaaatatgccacaatttgtttatccattcctggttgatagacatttgagtagtcccccatttggagctgttaggaagaggttgttgtgaacattcttgtacgtatctttcagtgcacacgtgcatttcttttagctgttggcctgttttttgttttgtttttgtttttgtttttttgagacagagtcttgccctgttgcccaggctggaatgcagcggcacaatctcggctcgctgcaacctctgcttcccggggtcaagcaattctcctgcctcagcctcctgagtagctgggattacaggcacgcaccaccacgcctggttattttttgtatttttagtagagacagtgtttcgccatgttggccaggctggtcttaaactcctgacctcaggagatctgcctgcctcggcctcccaaagtgttgggattacaggcatgagccaccacgccctgcctagcctgtacttctataacttagatatatcacactagaagaattgttgtaccgcttacagctttcactcaactccctgtctacagcatttccacatcgatttgtaaaaatctacctcatctgtttttgtggctgcagagcgtacttagtgttggtagagtgtcctggctgattccgtgtgcaggggccgtaggaaccactgggcggcgccattccctgggccatgtgcccccaacttccctgatgagcagaatcctctcaggcccttcttcataacgtaggtccctcagccccatccaggtccataggaatccaggtctccaggggagagcttggaaaactgcatgtctgacaagtgtcctgagaaggctgggaagtgctgtgtgtgctgggctcagagacttgcagcagaggcctggatttgaattcctgcgctgctgcttccttgctggtgactcggagcaagttacttctacttgccccagttcctttctctggagggaccgtggaggggagtggctaagacagagtctgggctctgacggcttgaagagctttaccagctccccctcccagcatctgtgtgttttctctgtgcctcagcgatctcatctgcaaaatggggggaacagcaggatcttcctagagggcagctgttagaattggctgaggtaacaagaaaaagcactgtggccgggcgcggaggctcatgcctgtaatcccagcactttgggaggccgtgacgggtggatcacctaaggtgaggagttcaagaccagcctggacaacatggcggaaccctgtctctactaaaaatacaaaaaaattagctgggcgtggtggtgggcgcctgtaatctcagctacccgggaagctgaggtaggagaattgctagaaccctgcgggtggaggttgcactgagccgagattgtgccactgcactccagcctgggcgacagagtgagactccgtctcaaaaaaaaaaaaaaaaaaaagaaagaaagaaagaaagaaagaaaagaaaaaaagaaaaagcactgtttgctgagcacttactatgtgccagatacgaggttaagcattgtcatagtcagtgctcaaacacttcatcacccatttccttttgcttatatatttttaaaaagccaaactttaatgcattattgattttgtttacattatgagagaatcataatcttgtggttaacaattcagagttacaggttgtataaaatataataccccttcttccaagcccagcttcctgtgaagccaatgttagcatggtggtattatcccttcatggtattttgtatgttctcacaactagagacaaatatgcacatctacagtgtctctgtgtttacaaagaaaaattgtatctgttatttacaacctgtttttaacctaacaatatagctgtacattcttctctgttgatataaacatcttttagagatattagctgatgcaattaaacaagagaaaccaattatagacatcagaatgggtaaagaagtaaaactattcctatttgcagatgatctgatattgtacctggagaaccccagaaaatcaataataaaacaaactccagcaataaatgaatccagcaaagtagaaggatatgaaattaacattaaaaatacaagacatctggccgagcacggtggctcatgcctgtaatcttagcactttgggaggctgagacaggtagatcacttgaggtcaggagtttgcgaccagcctggccaacatggcgaaaccccatctctaccaaaaatacaaaaaattagccgggcatggcggcaagcgcctgtaatcccacctacttgggaggctgaggtgggaggatcacttgagcctggtgagacagaggttacagtgagccaagatcacgccactgcactccagcctgggtgacagagcaagactccatctcaaaacaaaaacaaaaacaaaaaaccaatacatttttttagccctcacatggctgtttcagtagttagccatttccctctgacagatgtcaatattctatctttctttctttttgcttttataccatttcattgtacttgtatctgttctaccatctggttatttcatttctctctgcccacttcttagaagtggttttgccaggtcaaaggccctatacattaaaatttttatctgcttctgccacatcatttccaaaaccacagagcaattcatccgcctacctaaagggaagaaatctgctccaccagatgccatcaatctttccatttatttgctaatctgatgggcagaggtgggtaacttattgctttaatttgcatgttaccacaaccttgccaacatgcagttatcagcctttaaataattgccaatctgatggaaaaaaggacatctggctctatgtggcatatcactgactactgtgatgaaacatctctgggtgtgtgtggtttttttgttgttttgaaacagagtcttgctctgtcacccagactggagtgcagtagcgagacctcggctcactgcaatcttgacctcccaggctcaagcgatcctcccaactcagcctcccaagtagctgggactacaggcacgtgccactgagcctggttaatttttgtatttttttgtgtttcagtagccatttgcatttcctgtttatgagccggctgtttgtgtcctttattatctttttagaggaactcatttgagcttatcaaatcttgccatccatgctggaaggttgttattcacatacccatgttgcagataaggaaactgaggctcagagaggtgagatcacttgtcatagacatgcagctggtaggtggaaacttggtctgtctgtctgcaaaatcctgtgcataaagcacctgccacatcctagcactgattgcttccccaggaaaaattgggtttctccattaccatttcctccacacagatgctccagaggagtctgattagacgcagaggaactccccccatcactctgggagcagccctgggctggctataggaaggatgcatttctcaatatgagcagcaggtggcaatgtgggacggtgatttctcatcttaattgggaccagaggcatgtgggcaaagcagcccccgaacattgctgtggggtgcttgaagcattgcagcctcttttggcagaacctgctgaaacataaaataaaatgcacattcctttgatcctgtacttccacttctaggaatttatcctacataaatgcttgcacatgtctacagatacacaaacatattcattgtcacattgcttataattgcaaatgctagaaacaatttaaagtccatcagtaagggctgattaaataaattatgcattcatctaaaggccatctatgcatctaaaacagagtgggacatactggtagtgaatgaaatctactgttacaaaaaagagcaagctgcaggcagagggtatactatatcactatatatacatacattttatatatatatatatatgtttttgcttttgagacagagtcttgctctgttgcccaggttggagtgcagtggcacgatcttagctcactgcaacctctgcctcccaggttcaagcaattctcctgcctcagccccccgagtagctgggattacaggcacgtaccaccacccccggataatgtgtttgtacttttttagtagagctggggtttcatcacattggccaggctggttttgaactcctgacctcaagtgatctgcctgcttcagcctcccaaagtgctaggattaccggtgtgagccaccacacccggccatttttaaaaatgtgggagtatgtatagatttttgcctttgggaaggccgagaaggggtggagagaaaatcattttttacaagatgtggacttgaactcttagattctttatttttcttcttttttttctgtatgcatacattattcttccttcactttttaaagtataaatatattttaaaagaaagttaatcctttgagaacccttaggccattgagtctggtgtttctcatacagtagggagttgggggcaggggacagttaaacagaccccctagctaagcatagtgcttctgtctggaacatttattttactggattattttggggggctgtttatttgaacattgttttggggaaaaaggcattcttatatcaaagaatcacagagtctgatgcaaaactctgatgcatttcaaaggtaaaacacaagactttaaagacatgtgtcttctgggggcctctctgtactatgcccccaaatctagagggcctagagggctttcccagaaaaaacttgagaggtattcaagtctgggtcctcattttttggatgaggagactgaggtccagagatgggcaggggctcagccgaggctacatagcatggggactctgggatttaaaccagatacaccaatctggtttaaattggtgggctgccaatcaccgtgggcctggcagccctcattcatggcatccggttatcacaccaataagaaatacctcgtaataatggagagaatgtagcaagtagcattttacaaacttctaccgataccaagtgtgttctgtgtgtgatctttctgaatcctcctgaccatcctatgagctagatggccctcattttacacatgggggaaactgaggctcagagatgcaaagtgacttggccaaggtcatctcgttagaaagggaagagctgggatttcaatgctctctgtcttcaaactttgtgctctgtatttcgcaatttattattgtttcttaattaaagaagcaattcatgaacatgttctccttgggctaataatttgctaacattcagtaagatttgttatttaataatatagcgtttattaggactgtgtcagtcatctctgtgctttagatgttaataacgcatttgatctgtatataaccctctgtggtgggtacttttattatcccaatttacaggcaagaaaactgagatgctgagatgtgaggtgacttgttcaaggtcaggcactctgctacagcactgggcctcttaactgggctcctctgacttttgttaaaaaaaaatcaaatatttcaaaaaggaaaattctcttttgaccacattccctctaaatctatccccaggtaactattgctatctgtttgctgttatccttctagaacagtgctgtacatagacaaataatgggaatcacatttgtaatttaaaattttctattagacacactaaaaaagaaaaatagaagtgaaatcgattttaataatacattttatttaagccaatacatctaaaatattattagcattttagcattaaccaatgttaaaattattgataagatattttacattttgtttctcatgctgactctggaatccagtgtctcccctaccctatattaaatgtggctgcattcgagccagccgcatttcaaatgctccataactccctggggcttgcggctactctgtttcccagaacaacacttggcctttatgcagacattaaaatacagcatgaggctgcgcacagtggctcacacctgtaatccagcactttgggaggccaaggcaggagaatcacttttgttcaggagtttgaggccagcctgggcaatatagacagaccttgtctctacaaaatataataataataattagccagttgtggtggctcacacctgtagtctcaactactcaggaagctgaggtgggaggatcacttgagcccaggaggttgagggtgcagtgagccagactacgccattgcactccagcctgagtgacagagcaagaccttgtctcaaaagaaaaaaaacaacaaaatagcaaattgtactggaatcccaagtagacagcaagcctctgttttcccagtgggaagatttttaaaattttgtctttttttgatttttggggcaacctaaatattgaaataattaggaatggaagtaaatagttgcatttctccgtatctgttttgttgaacgtctgtagtgaattgtataaatgtgctgtaaccatttcgaacatttgctttcttcccacgaccacatttcaggagggggctttatgcagactccccctttaactacacagctttgctcatctgcagggccccaggttgagccaccaagctcagttttccagaatcttctcttcctcactcccatatgcactgaattccttgaatctctacagtatatgatgtttcactggaaattatttttggggggtttgccagattttctattattttattttaaaaattatttcgcgtggtttaaacattaaaaatgtaaagtagattacaaaccacatacccgatatggggttaacatccaaaatagataaggaactcatacaactcaataccaaaaattccaaataacatctgggagcggtggctcacacctgtaatcccaacactttgggaggccgagttgggcagatcacgaggtcaagagatcgagaccatcctggccaatatggtgagaccctgtctctactaaaaaatacaaaaattagctgggcgtggtggtgcacgcctgtagtctcagctactcgggaggctgaggcaggagaattgcttgaacccgggaggtggaagttgcagtgagccgagatcacgccactgcactccagcctggcgacagagcgagactctgcctcaaaaaacacaaaaatccaaataacctgactgcaaaatggacaaaggaccagaataggcatttttcccaaagaagacatacaaatggcaacaggtatgaaaaggtgttcaacatcactactcattggggaaatgcaaatcaaaatcacaaggagatatcaccacacacccgttagaaatgtcaaaagatgacaaatattggcaaggatgtggagaaaagagaactctttcgcactggtggtgggaatttaaattggtatagccatcatggagaacagtatggaggttcctaaaaaatcaaaaatagagctaccacatgatccagcaatccctcttctaggtatatattcaaaggaaatgaaatcactgtcttgaagagatgtctgcacctccaattcattgcagcattattcacaacagctgagacatggaaacaaactaagtgtccatcagtgcatgaacagatacagagatagtggtacaatggccccctcttaacctcaggggatatgttccaagacccccagtggatgtcaggaaccatgggtggtactgaaccctgtatatactgttttgtcttatacatacataactatgacagagtttaattttttttttttttttttgagacagagtttcgtttttgtctcccaggctggaatgcaatggtgcaatcttggctcaccacaacctccgccccccagattcaagcgattctcctgcctcagcctcctgagtagctgggattacaggcatgcaccaccacacccagctaattttgtatttttagtagagacagggtttctctgtgttggtcatactggactcgaactcccgacctcaggtgatccgcccacgtcggccttccaaagtgctgggattacaggcgtgagccaccatgcctggcctgataaagtttaatttataaatgaggcacagtaagagattaacaacataataaaatgaaaccaattataacgatatactgtaatgaaaacaaaataagggttacctgaacacaagtactaccataccatgacagttgacgtgataactgagacagtggctcccaagtgactaatgggcaggtgtggtctacagtgtggatacaccggacagagggatgattcaccccccaggcaagatggagcaggatggcacaagagttcatcatgctactcagaatggtgtgcgatttcaaacttagggagtttttcatttaatattcttggaccatggttgactatgggtgatggaaaccttggaaagtgaaactggataagacaggactgctgtgtatgtaaatccacgaaagaatgttattcagccataaaaagggagaaatcctgccatttgtaacaatatagatgaacttggaagacaatattgtaagtgaaataagccagacacagaaaatcaaataccgcattatgtcatttatacgtgggagctaaaaaagttgaattcagaggaacagtagaacagtggttaccagggctcaggaggtggggaaatgggggtgtgttggttgagggtataaactttgagttataaaatgaataagttctggagatttaatatacaagtatacaatgtattgtatacttgaaatttgctaagagagtggatcttaagtattctcaccatgcatgcacgtgtgagtgtgcacctatgtaaggtgatggatatgctaattagcttgattgcagcaatcatttcacaccatatttgtgtatcaaaacatcatgttgtacaacttaaataagaattttcctttgtcaattatacctcagcaaggctggaaaaaaattaagtaataacagtggtaagtctccttccttttcttgtcacatccccttccaccaattcccactgctcataattgattagttttattagtttcaaatggatccttctagagttccttcacacaagtgcaagtgaatgtgactatattcttatttttctttttttccacaaatgcatactaaacacgtggttgctggcactttgctttgtgctaacaatatatcacagcaatagataactcttgggtaaggtttagtgtgtcctctacactgctctaagggatatacaaatgtaaactgatttgatccatgatccaatcactgctatatatatattttttttgtttttgagacagagtcttgcttgctctgttgtccagcctggagtgcagtggtgcaatctccgctcactgcaacctctgcctcctgggttcaagcgattctcctgccccagcctcctgagtagctgggactacaggcgcccaccaccatgcttggctaatttttgtatttttatatttttgttagagatggggtttcaccatgttggccaggctggtctcgaactcctgacctcaggtgatctgcccgtctcggcctccccaagtgctgggattacaggagtgagccactgcacccagcccactgctatatttttatcctgtgttttttgccaggcaggacagagcaggatggcacaagatttcaacacactactcagaacagcatgtaatttaaaacttatgactgtttatgtccggaatttttcatttaatatttttggaccatggttgaccatgggtaactgaaaccttggaattcaaattcttttgtattttgagtatcactctgtcacccaggctggagtgcagtggctccatctcagctcactgcaacctccacctcccgggttcaagtgattctgctgcctcagcctcccaagtaactgggattacaggtgcctgccaccacccccagcttatccttttttgtatttttagtagagacggggtttcaccatgttggtcaggctggcttcaaactcctgaactcaagtgatctgcccaccttggcctcccaaagtgttgggattacatgcgtgagccactgcacccgcccagaatgcaaattctttgttatacaacactatctttgactcatttttgccaaatgaccttcatatgccttttaaaaaaattgtggtaaaataataaataacataaaatatactattttaaccattttaattgtataattcagtggcagtaaatacattcacaatgttgtataaccatgccgttatctatttccagaaacttttcatgattctaaacaaaagctttgtgcccattaaacaataattccccacctgcctttcctcccagcccgacatatcttctattctactttctgtctcttctattctactttctattctactttctgtcgaatagtatacttctattgtactttctgtctctgaatttcctgttctaggattctcattatatgagattttggagacagagtctctgtcgcccaggctggagtgcagtgtcgccatctcagctcactacaatctccgcctcccgggttcaagctattcttgtgcctcagcctcctgagtagctgggattacaggtacacaccaccatgcctggctaattttttttttttttttttgtattttagtagagacagggtttcaccatgttgcccatgctggttctctaactcctgagcccaggaaatctgcccaccttggcctcccaaggtgctaggattgcaggcgtgagccaccatgcctggcatatgcgtcagaatttcattcctttttaagagtgaatacattgtgtgtatatactgcattctatttatccattcacctatcaaccgacatttgggttgtttctgccttttggctactgtgaataatgctgctatgaacattggtgcacgagtatctgtttgagtctctggtttcagttctttgggctatatacctagaactagaattactggatcatatggtaattctttaactttctgaggaactgctaaactctttttcacagcaactgcagtattttacattcccaccagcaatgcataagggttccaatttctccacgtcctcaccatcacttatttcctatgttttaaatagtagccatcctcatggttgtgaatggtatcacactgtggtttttacatgcattttctaatgactaatggtgttgagcattgtttcatgtgtttatcagccatttgtatctcttctttggagaaatatctattcaagtcctttgccaattttcaaatcaggttgtttgttttttattgttgttgagtcgtaggagttcttttatatattttgggtgttagacccttatcagatatattatttacaaatattttctcactttctgtcagctgtcttttcatactgcattaccttttttgcttaattattcattgattgtgcaaatatagagtgcctcctatgtactcagaactgctgtaggcacaggggaaaagtggagaatggtcctgccttgctttttaaagtcatctgtaaacgccgtgtttacagtgatattcaagattgcagttgtgtggtcagacttcaaagaatgccagttatttctaaagctgtgttaaatttctttgcctctttttttagccatcccatcagatgatgcttagaagtatccagagttggcatcaactgaggtggtttcaacactgcccgcgccctgcaggcctaaacctctggatgcccagttcccacgcacgtgattttgacatgatcaatctggggttggcacctgggcatccagagatttaagagctcccaggtaattcttcagagagcctgaaaagtggagaaacataggaagataatgtatttcagttgaacacttaagcttattgctttacattgaaatgtcacccgaaatggtgacattcatttcaatgtaaaacaatgagctcaagttgaagtctaaaagttaaacatattcagcgtattatttgaaaatgaagccaacatactttaaaaaaaaaacatagtctacattttcgaccctttcaaatgccctgtgaggtgcagccaggtttagaatcgctggtggggcgagtcttcctgaaacacggcttgtggttcagaagagtcagtgagggagtttccaatactttgaaacttcagagcaatccaaaatgactctcacttttccaaggggtgatttcggagaaaaccaaattttatattttatatttttgttttaaactttatatttgtgcatataaatagcattaccgtggagctttaaaacaatgtatattaaggctcatgtatggttcatgaaaatattttaaaaaaaaaaaaagaagtagaaaagaaaacaatatctaaatagtgtcattcttcagtgcccggctttatccccttaccagtctgcccttgggaactctctgtgtctgtaggtaaaatgtactaactcactttcactgctgtatgtttccagaacataaacacaccattgtctgtttaatggtgatgcacgctagtgatctgtgggccaaagttgaccttcagagatgcttctgtggtctgcacagtgattaaaaactttttacttggatgctaaccttaaaaaacatcagaaggttatacataattgtctggattatcagcttcctttgaaagcacaggccttctggccatgctggggtgtttccctctcctgccgagggctggttggtgggctaagtgccatggcccctttctggcccgtctctcttttacttggcctgccttctctggagtgagttgagtttgagactccagcccaatctgccagttaggttgttgctgatgtctttctgtgattgctgctgtgctgagcctgctcacagtggcctcctcctcatgcacatgggctggcattgctctggggttggaccctggggagggagaatgctgctcagtgtttagtgttccttctcctgctctggaaagaactaccatttatttaatgcatgatatagttttgctgtgtccccacccaaatctcatcttgaactgtagctcccataattctcatgtgttgtgggagggacccagtgggagataactgaatcatgggggtggtttcccccatactgttctccttgtagtgaataagtctcatgagatctgatgattttgtaagtggtttctccttttgcttggctttcattttctcttgcttgccgccatgtaagatgtgcctttcaccttccactatgattatgaggcctccccagccacatggaactgtgagtccattaaacctattttttaaaaaataaataaataaataaattacccagtctcaagtatgtctttgtcagcagcatgaaaacagactaatacaatgcatatttattgagcacctgctacgggccgggtgatggggacatagaggtgattgaaatagatcaggctcccacctgcaggagacaagaccccttgcttctttttactgggggtaagacagataataagcaatttggtattgaaagggcttcctgctgtgggcctgtcctgcagcttctttcccacaggaactccccaccctcaatgagtgacattcagaagacccttggcctcatgggaggtcatgcctggccagccctgggtgtgggatggtgaatctgtaacccctactctctgtgctctgtccctgcaggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggtgggtgtgaatgtgcaagtgggtgtgtgcaggtgtgcatgtgtggttgcgatatgaacgcatgtgtgtgtgcatgtctgtgcacctgtgcaggtgtgcacatgactatgcctgtgtgtgcatgtgtatgtaggtgtgcatttgtgagtgtgtgctgatgtgagtgtgggtgtgtgcacacatacccactgcccaaaccagttccctgacttcctttactgtcaaatagcatcacgaacagaaacattcattcggtattcttttctttttttttcttttgagacagagtctcgctctgttgcccaggctggagtgcagtggctcgatctcagctcactgcaacctccgcctcccaggttcaagtgattctcatgcctcagcctcccgagtagctgggaccacagttgcctgccaccatgcctggctaatttttgtatttttagtagaaatggggccaggctggtctcaaacttgacctcaagtgatctgcctgcctcggcctctggaagtgctgggattacagtgtgagccaccacgcccagcttctttttgttttttgttttttgtttttgtttttttttaatttggaaaaatgttaaatttatagaaaagtttaataaatagtttaatgaactcctatatatgcctcaccttgattccccagttttaaacattttaccacctttgctttctctctctctgtctctctctctcttatgctctcttttccccactgggattattttattgaaataatttgggaataagttgcagatatcatgcttttttatccctaattgcttgagtgtaagcaagaacatctcctgcatgaccacagtacaataaccaatttcaggataatgagcccaaatacatgatcattatctaataaacaatctgtattccagttttgccagttgtctcaataatgtcctttttggttcatcttggtccagcatccaatccagaatcacacgttgcatttagtcattctgactcttctgttttcttttcttttaatttttttatttttttgagatggagtcttgctctgtcgccaggctggagtgcagtggcataatctcggctcacggcaacctctgcctgctgagttcaagcgattctcctgcctcagcctcctgaatagctgggactacaggcgcatgccaccacgtccagctaattttttgtatttttagtacagatgggagttcaccatgttggccaggatggttttgatcttttaacctcgtgatccaccagcctcagcctcccaaggtgctgagattacaggcatgagccactgcacccgacccattttctttaatctggcacggtttctgtgcgtttcattgtttctcattacatttacattttttgaagtgtgcagaccagttattttgaagaattgtttagaagttccattgagacactgggcatggtagtgtgcacctgtagtcccagctagtcaggagggtgaggcaagaggattgcttgagcccaggagtttgagaccagcctgggcaacatagtgagattccacctcttaaaaaaaatcctttgagtacttaccgtagacctcaaagattctgtgttgtgtcgattaccatttggggggtcaggaggacagggggcagagagtcaaggaaacatatacaaggtgattttagatgatgatatgtagagtatgaaacagggctgtgaatagagagactttcgggtctgctctagctggggtggtcagggaggcctccctgagatatttgagatgagccctggatgataagaaagctagattcagagacttggagaagatatggggatagaagattccaaataagggaaacagcaagtgcaaaggccctggggttggatcttgcagagtagagttggatcacacagctgaagcagagtgagggagggggcgtgagaccgagggaagaggtcactgagggccttgtgggtcctcataaatgaggacttgggatttttctctgggcgagatgggggcctgggagagttctgagcagaggagggacaggatcttgggggcaaaagcaaaaacagggcaacaaggaggaaactgtggtggcagggtcaggtggtggccatggaggtgatgaggacgtggatagattttggaaatttcaggaagacagagtcagtggacttggtcatggaccagatattggagtgagagaaagatggtagccttccatgctgcacagctccaggcctggttcctgccctctctcctgatccccaagccccatctttctcttggccccacttcgacggtgacagttgcacaagctgacatttctgggtaattcctctcccatcgacttgcagcttatttttagtttcctcagagccattaactgtccttgcaggcagagactggcaaggggtggggactgggatcaattggcagttgtcccccacatcagtgcctaataacatatttatgtgcagagatgacttggagctccaaagtgtctccagaactctcgtgggaatgactggtgtcagcaaaactggatgctggctgaggggtttgagtggcagaaagtccagggaacagcctttggcagggccaggagagctgggcaggagctggggacaagatgtcctctgaggttgagtcgttgacagcgtccagaattcaggcaggtgggaaaacttttcaagggccttttgggagtggagccaagagggtacttggcctaggagtttctggcacaggctctgtgacctcccagcctgagtttgaatcctgattttgacacttcctggcaagtcagtcacttaacctctgagcacctcggtttactcatctgtaaaatggagatggtagcacccgtttcaagacgtggttgtgaagatgaaaggaggcaggaatacatgtgcaattttgtaactgtgccttgcagataacaagtgctcaagaaacatcttcaacaaatatttagagcacctaccatgggccaggccccattctagaagctggggatagagcggtgagcaaaacagacaaaaatccctgcccttagggagctggcattctggtgggagaagatagacaattaataaacacataagctgtcatcacagtgctttgggaagttagagaggaacatcatttgagtcctagagttcaagaccagcctgggcaacatagcaagaccccatctctgcaaaaactaccttattttttttgtagaaaagctgggcgtgatggtgcgcacctgtagtcccagctacttgggaggctgaggcaagagcattgcttgagcctaggaggtcaaggctgcaatgagccatgattgtgccactgcactccagcttgggtgacatagtgagaccctgtctcaaaaataaataaataaataaacaaacaagtaagcatctaaaatgtattagaagtcaggcgcagtggctcacgcctgtaatcccagcactttgagaggccaaggcaggcagataacttgagatcaggagtttgagaccagcctggccaacatgatgaaaccctgactctactaaaaatacaaaaattagccaggcatggtcgcacaggcccgtaatcccagctactcaggaggctgagacatgagaatcacttgaacccgggaggtggaggttgcagtgagccgagatggcaccactgcactccagcctgggcaacagagtgagactcccatctcaaaaaaaaaaaaaagtattagagggaatgtgttctatggagaagagatgcagcaggaaggcaggcccaggaaggcctcactgaaaggtgacatctgagcagagactgaaggaagtgaggggtgaaccatgtaaatatatagaatgaagtttcccaggcagggagcagcaagtgcaaaggccctgaggcaggactaagggtgacacggtggggaggcagagctgccggaccacacaggtccctgtaggccatggggagggctttggcttttactgtgagtgagacaggtgcctgctgtagggctctgagcagaggaagaacctggcctgtctttcgctttagagggatcattctggctgcagcgctgacaagagactgtagggggtggggaagcagaggcagggagagcagagaggagcagcaggatccagacaagagagggtgctgctgggccagggtcaggggtggttagattctgaacatatatcaaagtaaagccaacaggatccgctgttggatgggaccttgggggaggccatcaaggatgaatccaggtttgggcctgagtgacaggagggatggcagagccatgggcagaagagggagatggcgggaggaggaagtttcagggagaagatcgggggttgggctttgggtatgttgaatttgagatggagatgggggagtggacacctggagaagagagtctggagttcaagtttgaggtccaggcttgggagttgtcagcatagaggagtttaaatcctcaggactggaggagatactgcaggcgagggtgggtgaagaagggggcatccctggggctctccagtggtgggaagggtgaggaggaggggccaggaaggtgggaggagagccgggagtgggaagctgggtcagatgctgcagagaggctgaaaaatggtagctgtgattgctgctgtcaggtcggagatgatgagtcaggaataataatctcaaaagatactgagcacttaccctgggccaagcatcctgttgagcactttgcaaccaccatctcataggatcctcacaacagcttcctgaatccagaacccctgaacctggaatcgagagtgatggaaggagcagtgggagtctcaggcatccagggaggactctgtgggccgagacctaaggtccaggcaaggggaagaggaggctgtaagggaaggtggggtggggtggtggggggcagacggaggagagtttccaaacacaggtcaggcttccctgccagctctgagcccactgatgctggtaatgccaggactgaaaccattgattgacatgatgtccctcagccccatccatcacatctgatccttctcttccttcccgatatctggcttggccttcaccccatcacatcctcagcagccacagccacacatccctggaaattcctgggtggtcctgagaggtaggggagggggccacgggagctgctgggcctgcacatagctccgctgagatagtgatcatcgagaagaatccttgaggcatctgacaacggagtagaaagcaaaaccacagtattgagagtcagacagactcgggtggaatctcacctctgccactaaactagttatgtgacctcaaacaagtcacttttctgggcttaagtttcaccatctgtaaagagggttggtttttttgtttgtttttttttttgtcttcagtagttttatcttgaaataattttagattataaaagagttgcaaagatagtacaggagttcccaaatacccttcacccagctttccctaatgttacataaccacaatacattcatcaagactaagaaattcacattgggacattgctagtaactaaagtctatactttattcacattgccccagtttttctactaatattctttttctcttccaggagccaatccacaatcccacattgcacttagggcttttgtttgtttgttttaaatagactctatttttacagcagatttaggttcacaacaaaattgaaggaaaggtgcagggatctcccttagcccccttctcccaatgcctcgcctctccatcgctggtgtccctcagcagagtggcacatttgttacaatttatgacctacactaacacatcatcacactcgggatattcttttattccgttggaatcttctaaatcataaaaattaaaagaaacacaatctgtgacccccatccctcaggtctcccttcttctgccaggctacatcctcagagggtctccccctgggggatgactacaatggcctccagtagctctaggcaatttagcaatcccatggaggagggcttcccttcccctaaattctagcacagctcccaagactgatactcactggcccagcccacgtcatatgccccactctgcgtggatcactcagtgcctccgcctgggtcccatgcccacacttgaagtctggaaggatgggtcagtcctggatggcccacatggacttagacttaagaggaggtggttctttgaaggaaagtggggtgctgttaccaacgacaaggaagcggatgcaggcaggagcgggcagcggaagtcccccacttccactgatgggccatgttgtcaggaggcaacaagaaggagcatgtgaatcaccaagggtgtggtctggcccgcagtcagtgcctcccagaggtcagccactgccattcacaggaaagctagaacaggggtggcactgcttttgggtcatggcctttggctgcagtaggagggaatgaagacaaacaagaagtgtcttcctgagtaaacggaggcaaggctccgtgggtgaaagctcaaattccagggtggcaaattcaggatctcttatggttgtgtgtgcacacacacacacacacacacacactcacactcacatctgtgcagttgggtaaaaggcggtcttggtcacctccctaacttgccacagctttttcctgcaggcagagatagccaagcgcccatgtgttccactcctgcttggtaattaatgagcggtggcccccatctaaccatctgggccagataaaatggccttggcgctgagctaagctggtgttgaattatttatcatccgcatttgcctggctatttaagtgatggacagcaggtgaccttgctgtgtcagctggacctgaggtgctggtggaactctcagaaagggccggaggcccccccgacttgttttcaaatccaggggaggggccagtgggggaggagtaaccacttctgagcacctactatgggcgcagcacgtgtgggattgcttgcattcagcctcactggacccttgcgtccacccaggaggtggcaatgttacccccagtgttgagacccaaagggggacgtgacttgtccacagtcacagaaagtggggagctgggatttgaacccacctctacctggtctcagtccagggatcttctagcccacctcccaggctgtcttggagctccacctctaatccaaagggatgcagatgtttatttgacaaatatcagtgagcctccactatatgctgggcagtgggtagtgaccggggagtacttcgttttccttttcagtaaaaggcctaataatggcacctgcgtgatggaagtattgagcagaggagtgtggttcctcctggcctcacgggcactaaagaggaaggcaaaatctatctcaccatcactaatgctatggtgcatttctttccagcctttccccataggtttttcttctgtggttaagatcatgcagctgttttaatctaaccttctatttggtttaatattgtaacatgagcatctctcatgacattgtacatcactgtagaaatgatttggatacagcctgggaaacatagtgagacctcatctttacaaaaaatagaaagattagccgggcatggtggtgcatgcttgtatcagctacttgggaggctgaagtaggaggatcacttgagcccaggaggtggaggttgcagtgagccacgatcgtgccattgcactccagcctgggtggcttctgtttcacttaaaattagtgtgtccattaaaaaattttgaacagtttaaaaggtatttgcaaggaaagtcagcctccttcctccttatcctcttgtcttcccagcttctgtcccaaggtaacctcagttacccgtttctggtgtctcttagagatggtctgtgcttctttgggaggctgtggcaggaggactgctcgaggccaggagtttgagatcagcctgggaaacatagggagacctccatctctaccaaaaaaaaaaaaaaaacctagctgggtagcacatgcctgtggccccagctccttgggaggctaaggcagaaggatcacttgagcctaggaggtcgaggctgcagtgagctatgattgtgccactgcattccaccctgggtgacagagcaagaccctgtctcaaaaaaaaaaagagatggtctgtacttcttcatgtatatttctctttaaacaaacacacaaatggcagcatgctgagccaccaccctgcaccttgcgtttgcatgcttctgtgtgtcttggctacagtcccacatcggtacacacagagccagcttctttttaatgacttcctgcatcacatcatccaatggatggatcttcattgatctcattgatctcttattgatagacatgagattgtttccagcatttttctattacatgagcactgcaataattatctttgtgcatatgtccttttgcccatgtgtaattatgtctgtaatgaaattagtgggtaaacatgatatttaatgatgatttaatattccattattatgattgaatagaatagtcacggcagacaaaaaccttcccccaaattgagattagttggtattcttcccatatctggatcactaaagggtgccatatacacattttagccacataccaaagagctgaggctaaaatgtgtatgaaaatgttcagctaagactgaagccttgaagcaagaaattccactcgttttcctaagtgtttatctattgggaagtttaaataatttttattcatagctttcagtcatcaatgatgattgcggctttgttttatacgtacacaacacacacacatttattcttcaagtgactgatagaatttgaagatacaaagcatatagggaactttttgcttcccaaactacatcaagaatgattatatttggaagcaaatctttagatatcacaccagttagctattgttgcataacaaacatccataacaactcatcagcggcatacacccatcagcatttatttaactcacgggtctgtgggtctggctcattggggcagctcagctctgtccatgagtctctcatcctcctcttgggatcagtgggcttgccgagcaagtggaaacacaaagtctctcgcggcttaggcgtagagtggctgttccttcaattccacctcaatctattggccaaagcaagtccacggctgagcataaattcaaagggcaggggaaatacgctctggctcttgaataggaggaacagcaaattcacatggtaaggagcgtggattctgcgattggggaagaattggggccaacaatgtgatcattctcagatgtgaacagtcttaactgatataccctgttcctattactgacactgttttgctgattagctatgaagattacctgtgtgacctaggattagtgactttgcacacagtcagggatgccacgagtggccttgaagtaggtattttgggccacagggcagttttggccatgtcctgaggctggagatagacactggtcatgcctgggtgtttggcagcagtgggaacccaggcctactggcccctctgtcttggcccgagctgtgtccctggcagagacgagtcagctctgccctcataatggcataacaggggcccttctccttgcaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttggtgagatcgtcagaccctccaagatagcccctaagactgcgtcatcatggacccccaaagccctccccaacatggactcctgtcttccagggtccatcagtgtgtcctccgacctagggtctccctaagcctcctatcttcacacacctggcatctccatactccagcctcagctaggggtcaagtgacagaaaacctaacttcaattgactaaggtgaaaaggtactttgagacatgtcactaaaaagcccagaggattggcttcaggcacaggtggatccatgcactttaacaatgtcgtcaggactactcagttcctctccacctctcagccctgtttcccactgggttggctccagtctcaggctggcagtagctgttggcagctcaaggctgacttcctcctggctctgtgagactctgaatctcttacagtgttcccaccaagagtcccaagactgtgtctcattggctttctttgggtcatgtgtccatcctgaaccaatcacagggctcagagggatgctctgattggccagtcacagccccatcccaggagttgagcatagaagcagcagtctaacccctgagaatgagagaggggtggaccctagaggaaaatcaggggcccgtttccagaagagaaatatatgccgggcagacaggaacagagattgatggccctactctctccccagccttctgatatctccctagctcccaccttccctcacaacttctcttggggtcagacctggataccctcatgttcaaacgtctctgagggaccacagagaccacatgtcatcgtgtgtcctttttcaccttgctatgtgactgtgtgggcgaggcaggcaccctctctgagcctcttcatcttcctctgtaaaataagagctggggttggcatatgagcaggtgaagggatagcccgctgactcttccttgcacctgccccatgcagatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtaaatggcaggggcgcctggtcatatggggtctgtgggagaacaatcagtgactttgggatgagccagatctgagtggcagcctggctctgctctttgtttgctatgtgacattgcccagattgcttcacctctctgtgtttgcttcctcacctgtgaaatggacctcataatagcacctgcctcatgagattgataggaagattaaatgggatcatgcataagcagatattgatggccccactctctccccagccttctgatatctctttggctcctaccttttttcacagcttctcttggagtcagacccagatcccctcatgttcaagggtctctgaggaaccctagaacatgaggggatgttcattcacactgagtgctttgtgatagctcagccattttccttatttcagattgttataatgtcagtttctcaacacttttgccttgccccagactttgagaagaagtaaactttcacaattgctaacagattgggtgtttactgtgtgtcagaccctaaactacatgctcatctatccatccattcattcatctgcccatctactcatgcatctgtctattcatgtattcatccatccatccacacactcacttatctacctatccattcatctatccatccgcccatccattcatccatccacccaccaatttaccctttcatccacccatctacccattcatttatccatccagccacccatccactcatctatccatccatccactcatctacccatgcatccatctgtccattcatccattcacaaattcacccatccatccattaatctatccatccacccatgcatccatgcatccatccatccatccacatactcacccatctacccatccattaatctatccatccacccatccatccatccatccacccatgaagctactctttcatccacccacctacccatgaatccatccatctatccatccgtctgtccattcaatcatctactcatttatccatccatccacccactcatttatctacccactcactcatatgtccatccacccattcttctacttatccacccatccatccatctatccacccatctactcatccatccatccatttgtccattcatccatttattcatccatccacccatcaatctacccattcattcacccatctacccatccatccatccaccccatctacccatccatccatctatccatccctccattcatccatctttccatccacatttccatctcttagtctatccactggttcattcacctatccttccacccatctttcagtcggcagctactccatgccaagctctgtgctcagctacaacccttgccttaccactgtgcagtgtaaccaaaggaaattggcattttctttttaaaaaatattttaatttcttttattttacattacaaaagtaatatatatcatagaatataaagaaatacagagaaatatatacttaaatgtaaaaaatatgtatttcccttcttctccagttctacagagttctctgaccaaggtttggagtgtgccttgcgaattgttttcatggctttacaggcatacacacaacacattcacatgccatgaaaagattggtgtgtgtataggatcatgcaatatatactattctgaaacttgcttttttcactcaacaaccaattgtagaaattctttccatgtcagtacacacaaaccttttgccataattttttaaccaatcccctatcaattgacctgtatatggtttccagtttttccctcttataaacatgactgtcatgaacatcctcatacatttttcttggtgtgagcttgttctgggaatggggtcagaaaaggaccttcttcctatttcaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacagtgagtggggggccagggcagggccagggtggctcctgatcccctggttggcaggcgcccttctctcctgggactgagggctcagccaggagaatggtttggcagaggcttcacatggacagcccgtgagccatctcttatttgtggttttacaactgtgtgcttttataaatcagaagagctcgtgtaaaaaagccagatttcggatttcttttgaaataatcagatctggcagcaggttcttccctccaagactggtgtccagattccaaatactggacattcctttcagctgaccgtagctacccgtctgcagctgctgccgcatgttcagaacttcatgttaggaactggccgaacttcactgttcccacttggttattttaatacctgtggggccgagagcctcataaattatctcccttgaaccccaggagctttggccaccaggatcacaaacagattggaccaggggttatgacatctgccctgtcctcctgtccagcccctgtgcaatcataagctgggttaccttctgagcctgtttcctcaactgtaaaatgagggttctgattataactataccccaggagtgtcaggataaatgaattggatctttctaagttcttaacccactgtctggctcattgtaggcatttgaaaaatgttaattattaccataattgttaatatcattattgtgcatgcattgtgctaagtgagtgggcacgttacataaacctttagcctcagtttcctcaagaaaatggagtcaattatgaacataatacagctcatatgcattccttaaaatcaccttgctgtgtgaaatcatgcaacaaaaactgcagggattcacgcctgtaatcccagcactttgggaggccgaggtgggcagatcatttgaggccaggagttggagaccagcctagccaacatggtgaaaccccgtctctactaaaaatacaaaaattggccgggtgtggtggagcgtgcctgtaatcccaactactcaggaggctgaggcaggagaatctcttgaacccaggaggtggagattgcagtgagccaagattgcgccgttgcactccagcctgggcgacagagtgagactctgtctccagaaaaaaaaaaaaaaaaaaaaaagaaagaaagaaagaaaaaactgcagggattgagggaaaagggggactggggccaacactcaaaaacctcatcagtgacataataaaaaaaaaagagagagagagaagaacccagtaaaaaaaatggtagtaaagttttatacatgttacctggctaagaactatgtaagtgctgtaataactgtggctgtagatcgatgcttagttgtgtgcatgtgtatattttatggatttctgcacacccaggttcagctgggtgcagtctttcgtcttcacctcatgtttctcacaagtgaaattgcacgtgagcaaatgtgaaacttgcattatattcaaatggtgccctaatatatcaatcctattggaacaaattcacctgttcaaaacaagtgttagagcagaaccgactggcattcctacctcatcaagtttttggacagataaaaagagatagcgggtactaaatgcttagatggtgcctagcgcacagtgttccaataaattagctaatttgttgttatttttatctcactgaattgtcatgacaaccctgctggtccatctaaaaccgagtctaggcaggtcagatcatttgccgtgttcccaggaagtggaggtgcaggagttcaaatccaggggtgggcacaaaaccgccatcccttagaaactcaccctctagtttcctacagcctcagagctggaagagactcaacatgcctttcccctctttgaccagatgggagaactgagacccagagtgggtaagaacttggcgagggccacattcccataagcggcacagcccagatctgtccagagtgttaactcccctctctcctcatctgccctcttcttcactccttcagtgagacaaaagaatccccaccatgtgctcagtgctgcatcgggcgcctgggttggggtagggaatagtggtgggaaaagagtcataagatattctcctgacccttacgaacatgggcattggtaagatgaggcagggaggcagcaaccgttgacatcccccgtagggctgcctccacatttatgggggcactgattacatcataggcatggcagctgcgaatagttattatgacagttttcccagaagatggcagtagagagtgcttgttcttgcaaagttggtctatttaggacaattttctcagagatggcagtaaaatgtcttgagagcgatgcctgtttctaatctcacaaagacacctaagggttagcagcagtcctggccaagatagacagtgagggttccaggagtgtggggaaaggcggcaaagtgtgtgggctggaggatccagaggagtcgccgtattaatcagcacaggctcagctctgcacctgccgagtctcagtggcttttaccaacagaggtgtagttccactcacacggtatcagctgtgggattggagggcttccccactctgtgcacagactcgggccaggctctttccctctttcggctccaccgtctcaatgtgaagcctgcatggctgccaggcaggagggacagctggagagccacacactggctcgcgaatgctttgacacaggagtgacacaggccacttctgcacacagcccattcaccagaactcatccacgggcctgcctaaccttacagggggctggcaaatgtggtgagcagcaaatgcgtttcttctacttcctcactcctctcctcactttactcaaagttggagtcagacttaggaggcagccatggctcccctgccttgttcccgataaccccctgccctactcctctccttcacaccttccatgccatctctctgcagatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtgacaggcaccagatgggatgggctttctcagtgtcagcactcaggtagggagctaaggaagacacagcccagacaagatggctggaaggagccagccaggactccttagactgatcaagccaaaaaagaaggtgccgatttcatgcattctagtgcagaagccccaactgtgatcacgatccagtctgcagacgtgttttgtttggacttcacttaaaaaaatgccttagttgttatcatctttgggagagttcattcaaaatgtccagcttctcttgaaaacttggtatatctggccacactgggctcacattcccaagggtaactcttggccagagctgagtggcagccgcctcccttatgcaggacatgtgctctcggcttcaccagggttctgaccgggtctgcttctgcattcacagcgcctcctggacctgaaggcatctgagtgtgagaccctgttctaactcttagaagtgacattgtaagaggtggtggggaccagctaattggtccaacccagcctgagtgcaccaccctttgaacaaatgtatcagtgatgaaaatttgcctttgccccggcttgcctgtaatcccagcactttgggaggccgaggtgggcggatcacttgaggtcgggagttcaagaccagcctggccaacatggcgaaaccccgtctctactaaacataaaaaaattagtcaggtgtggcggtgcgtgcctgtaatcccagctattcaggaggctgaggcaccagaattgcttgaacccaggaggtggaggttgcagtgaactgagactgcgccacggcactccagcctgggcgacagagcaagactctgtctcaataaataaataattaattaaaataaaaaacagcttaaagagaaaaatggcctgcaaaccttttttatgatgctatttttattaatataaagtcctgtttattgagaccctttaaatgcctgcgagagaccctacagacagtatgtctactcctcacagcatctctatgaagagaaggagggttgtgcccacttcatagatgagaaaactgagaggtgaggtgacttgcctggggccacatagctcataagctgtagaactctgcaggcagatttactgtcccaggagcaaatgctggatgagcaactcctgttctttgggctcaaggggactggtgatgggacaattcttctcgacttcaggagctgacagagccagaggcacctaaacttgggtacatcttgtaagacacataatgaggtccctctagctttagctggagggagataaaagaaccccagacctctgaatgtcccagaggctagtctcttctcagagcagcactggggtttgggggcttccctgggcctcagcctccaggcacccccaggattcccagagagacgctgtgattggcaggaggcaggatatccccagggaaacccatcttcacgcctgggtgacccccactgccgcctccttcttaactctgcaggaaatcagagctggcagcctccagtgggaggacagagccggtttccgtggcaaccctcagctgcctcatcgtggctgggaagggaaggaagcaagccggcagaaatagctatggaaggtcttgcgcaggctgcaaccctggtgtgctgggcgaaaacccttatgactccccccttccaaatcaggctgggttgtcactgagactagattctcacctgccttcaaagaagggccaattccctttaaaggtcgcacctccttggaaccacagtcattagtgaattacactcaaggaaaagatgtgctcccaccaggcagctccagctgttacctgagatactgaagtgcagctcaggagacgattatttaaacctgcccttgttttaatcgttatttttctctttaaaaaaaatagaagctataaagaaaagagggagagatgagtgggttagctacctgctatgcgctagttaggaagttacctggatgccattgtatttcttcatcccttgcttaagaatcaaaattactggacatatgttaggaatactctttctttctttctttctttttaagctcagtggcaagaatgaaatactctttttttttttttttttttgagatggagtctcgctctgctgcccaggctagagtgcagtggcgtgatctcggctcactgcaagctctgcctcccgtgttcacaccattctcctgcctcagcctcctgagtagctgggactacaggcacccgccaccacacccggctaatttttggatttttagtagagatgggatttcaccgtattagccaggatggtcttgatctcctgagctcgtgatctgcccgcctcggcctcccaaagtgctgggattacaggtgtgagccaccgcgcccagccaagaataaaatactcttaagttgatctaatgaagtgtttccttaccattgtgattattgttactattatttgctatattttaatattgttgtttaccaaatattctcctttaaacagactcgctttttaaacttttttttttttttttgagacggagtttcacgcttattgcccaggctggagtgcaatggcacgatctcagctcaccacaacctccacctcctgggtttaagcaatgcttctgcctcagcttcccaagtagctgagattacaggcgcacaccaccacgcccaactgatttttgtatttttagtagagacggggtttccccatgttggtcaggctggtctcgaactcctgacctcgtgatttgcctgcctgggcctcccaaagtgctaggattacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgttacaaaacgagataagcaagtgttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttgatgattaaaaagaataaacacagtgtttcctgagtagcagtgattgttatgccttgctattttaataaagattctattttcgtataacattgtcaagtggaaacatgctgaaatctattaaaccatctttgtttgtg

SEQ ID NO: 36972 - DNA, 151265 bp, Homo sapiens
agcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcaggtagtctcaaaagccctcagcaccaacaggggagaaagcaccgtagagtgagactggagtggggtggtcgtggccgagtcaaagttcaaattggagcattggggatgtactgcgtgcgcccagccgagggaatactcttgaagtttcctggcacaactgtcgcacccggggttcttccaggctagaagccgtctcctactccaggagctcctccggggaagtacgaagctgtggggtcctctgccgctcttagcgcgggagggtggcgggtgcaggacactttcccttactccctcaacgcgtgttttggggatgtgttgatttcgtgggtgctcagaagcaagagaagcggaaaataccttctattttgaacgtgcccaaagcagggaaacttggcttctgcctaggaacgcataggaagacttttattcttggaatgtaggattagcagaaaccaagggcacaggagacaggtggaagcagctccctgtgaagtgatacagaaacaaaaggactttggaatatttgtggatttaaatcccagttctggccttggctagtgagtgacctcgggcaaattatttaagcctactaaacctcagtctttccatctgaaagatggagataataagtttttctttttaaagaattgttttattggaaatagaaataacatacagaaaatgcctccctagcacgggacttggcttttcagctaagtgtaattttccttatcagttatgattgatgatgaagtctatggtgaagacagaacaaaataatgtttaaaactctggccatataatgactgtggctatgcatgacccgtgtgcagtcacctctgagccccccaccttcactgcaaccccagtgggtcccaagcaaggtgcttgggttttggagctggacaattctgtgcaattcctggttccggtatccactacttggatgacatcagggacgtaacttatcttccacagcctcagttttggcatcagtaaatgaaaaaggagcccctcagtacttgcctttcccttccccggctaaatgtacaactcattttttttccattctttgctttgggatgagtaagaacaaagatgtaagcagagtaaaaagtccattgagaatacattttattagcttggtaaataacgtttaagaaagttgtccaaaaggagaattggagcacttttggaaaagtacactgcaccggctttgttggcatatgaaagtctgcatggtcgtcaagaccgtttggctaactgggcattctagatgtgtacctcatgctagtctaagtacaggggcaaccctttataatgtagtgtcagtgttcttaaccagatgttgttttattaatcttttataggagatgattgtttgggaggggcaattgatcccccaatttatataaatccagtttataaatcactttatagtgggattctactagcctgagaaataggtgggttttgactgacagtttgaatgacttagaagagtgttaagaaagtccactgggtttaccagttcactccccacaaaaaataaaaacaagaagcaaataatataacagaattctaaaaatgagtttgtttttgttttgggaagcatctagtttgtcagaggaaacactgagtgttgaatactaccctgggatgcacagaactaaggcaatgagaggggaggaactcagttcttgccccaggtatcatcagatatctgtttattagcacccaaatactcaaggtaaatagtaatgacccattctttctttttttgagacaagagtctcactttgtcacccaagctggagtggcaccatctctgctcactgcaacctccatctcccgggttcaagggattcttgtgcctcagcctcctgagtagctggaattacaggtgtacaccaccatgcccggctaatttttgtatctttggtagagatggggttttgccatgttgcccaggctggtctcgaactcctgacctcaagtgatcctcccacctcggccttccaaagtgctgggattacaggcatgagccactgtgcctggccagtgaccccttcttaataggaagtatggttcactaaagagcaaacatgattgttttagtttaccatttccgatggctttataatgtgagattttcattgactgaactaagaacatttaaaagaagtaggcaagcttctcagaattagaaagatacctctagaacaatgactcattaacgtctatattgacttgtgagagaggtaagctgggcaaaaagctaagaactgtactttcctggtaaaaacagtagtggagtttgaacttttatactatatttgcaagctcaaagatgtaagccttaatagacagttcacaagacagctgttacagcgtatctgaactgaaaccagggtattgagattgctctcccttaagagatattagaggtataaccttgaacatgaaatcacatgctttcattgctttaactcagaccctggggtgcaggacagggtggtggtagtgaaagagggggaaggactgtgtccttagatcttggagcctgaaaaagcaaattcttagcagcttatctttccaatatagttggaacttacctcctacctttttctctctagtctgattctagttattggttgtctttaaattgcttagaattgtttacaggccaaaatatttactttgaaccctaaaggtaagctcttcctcctttcctttttgggactctgtatcccattacccctctttcaaaaagatagtgccacatatctttttgtactgtatgattcttgggagagaatgtaacccaggtcccaagcgattcattttctcatttatttattcatttaactaattttttcccagtgtttgattatgaaaaggtttaaactttcagaaaagtcaaaagaattttgcaatctagaatctacctagattctattattgattagaagccagggtattgatttcaattgattaatcaactggcattgattagttcctactgtttgcctggaggtttgctcagcaaagctgtaaaaacataaaaggcagggtagggttagggaacaaggagagttttgatttggcggagcataggctaagagtttgtgaaggaatcatgtaactttggtttgaaaagttatgttgaagttgtatcatggaggacattaaatttcatcgtagaaagtttatactttttcctggttgcaggtgggagccattgaaggcatgggaggaatggagtgccttgtgttttagaaagctcactgaagcatcagtgttaggctaaattggagggaaaaggaccggaagtctgagagatgtgttaggaagctttgtaaatgtctcggggcaagtaagggttgaactgtggatagaatggagaaaaaaggaagtagaatagcacttggtgacagatttgacttgaggacttctggttttagaactcaggcatctgcaattataagggagcatcattaagaatctggaagtcgctgggcatggtggctcatgcttgtaatcccagcactttgggaggctgaggcgggcagatcacctgaggtcaggagtttgagaccagcctggccaacatggtgaaaccctgtgtctactaaaaatacaaaaattaaccaggcgtggtggtgcatgcctgtaatcccaactactcaggaggctgaggcgggagaatcgctgcaacccggcagcagaggctccagtgaaccgagattgcaccactacactccagcctgggcaacagagcaagactgtgtctcaaaaaaaaaaaaaaaagtatctggaagtcatagaaggaggaagtttgaggagaatgatgacgtcctgttatagagtcagtgggtttgaggggctgattggttatccttttggaggtgacagctgacagtggtgatactgtcctgaaatgcccaatagcaatgtcaggactgaacaaacatttggactagtgattaatactcaaggggtggttgaatgggaatgtacggaaagagaaaaaaggataagatcttgaagaaaatctgaatatatggagtccttggagcaaaaaataaatacaggtgttcaatgatctgttagtattttaatgcctgtttatctacagtgttactatagctgcagttctcattaataattgaccacagttcctaactaaaagaccatatctgcactagtaaagtgaagtaagtctttccttttcccattctgggaagttcagggggtaaggtgaggcagaggaaagaagaagagaaagttaaataaatttttttatctaggacttttagagcatacaacgctttttccaggtaacccacttgcagatcagaagccaggtaatttaatgaacttgtctatcttttcacaaggcaacagctactttttttttttttgagatggtgtctcactctgttgcctaggctggagtgcggtggcacaatctcagctcactgcaacctctgcctcctgggttcaagtgattctcctgcctcagcctcctgagtagctgggactacaggcgtgtacccccacgcctggctaatttttatatgtttagtagagacagggttttaccacgttggccaggatggtctccatctcctgacctcatgatccgcctgccttagcttcccaaagtgctgggattacaggcgtgagccacaacgcccggccaaggtacagagtttttaagtggcagaagccacatttgaagctgtgaaggcatactttgtttttttattttttatttttattttttgaaatggagtttcaccctgtcgcccaggctggagtgcagtggggcgatcttggctcactgcaacctccgcctcctgggtaaaagcgattctcttgcctcaccttcccaagtagctgggactacaggcatgtgctaccatgcccagctaagttttgtatttttagtagagacggggtttcactatgttggccaggctggtctccaactcctgacctcatgatccgcccacctcagcctcccaaattgttgggattacaggcatcagccaccgtgcccggtctgagggcatactttaaatctttcatgctattcccaccggactgcattgccttcctatatgctactgactgtatgctaggtactgtgttaggcgtttgcacatgtaggctccttactgtggcccctctgttttgagaaggtgatcagcagggaagctcaaagcacattgcacaattggttgttgcacaattggcaggatgtctgccctctgattgtgccttgttttcacccaacttcttgaactctacaggaagggccagcctctctcagaaatgccagcccctaaagctggtacaaaggtcatgcaaccttcctacttccctgagttcaacaatcacttcattcattctccttaagatcatacctaaaatcctggcttatttaagggtgaagtggagaaaagctctattttcacttatgcatttgttttaccccatcaatcttctgccttccctcattgtcccacagttgtgcctgtctaaggtcactttttgcttttttcttattttccttccctggggagtctttggagagagggtgcgatagaatgtgtagcctggagcaagattacccccagttgactatggaagccctgagaattatgctgcttcctcaatgcttttttcccaaagttagaagtagcaagttgtatagtgagtaataggatttgcattgtgaatggggtcttcctccagtgaggactttactaagtgcagtgtttatttgtagtggggcacagaactgcattcctcatgctttatgacagtatttagggtttactggttttcatgcatgtctctctttgctagaatgagggctccttgaaggtggatactgtccccttttcatctttaactactccacaagttttagcaaagtgtctcaccctttactgtatggttagaaaatctctgaagagttgagttctgttaaaggagagaaaactatttgtatagaagagtgtgggtagaagcctgtttgtttgtttgtttgatgtgagacagggtcttgccacattgcgtaggctggtcttgaactcctaggctcaaataatcctcctgcctcggcctcctaaagtgccgggattacaagtgtgagccactgtgtccagccgaggcctgcatgtttgaatggatcaagaaatgtgattgtttagtgctgagggagggtaggtaggttgcagggaaaggcctggctagggaaaagctcatatgctcctaagtcaagcaacaagaaatgtagaacgtgaaataaagatgaagccattctgagtcatgtgcagaccgtgggaaatatctccctgtatttgacaaaaggggaaatggcagccatagctaattctgaagatgaaaagtgttcctgcctgggttacttgatgaagaatattattagcaatcagcaagtcaagtggaaataatttgttttgttttgttttctccccttctaactattggcatgttggtagaattaacttggctggcaggagaatgaaccgcctgtgccgttgggacacaggagatttctgagctggcagactgcacactccatgtaaaaccatgactctttccaccattcttgtgtacacgtgtgcctgaacattggtgtctgcaaaatccgagacgtctgtttcagagaaaaattgctggaagccactgatttagaattttaataggatttttaaaaaatctgtgcttaaaaaacatgtaatttaatcagtgttgtagcccccctgcccccccaagaatagcctttcttaggtttcttaggttgtcttacgaacactgacagaaatgtgtaggttcagggcacctagagcagatgtggaagttctttcattaaggtagcctgcgtgaatcatccctgtgactcaaagcctgaagcagttttagcctgatctccttggctgcatttttagaatcttagacattccaagctgaaagggattttgggaattatatagtccatctaatctccagaatttacaaatgaaggaactgaagtccaaggggagaagtgaattggcttgcccaaggatatacctgttggcaaagtgaaggctggaacttttgaccttgtacattcaggaattgtggcagagcctttcctgctcgtcttagaatgtaatgtactatagggagcccgcagccatcctctacggtctggctttattgtctcttttctccctattttttagtctccttctaccttttctcagcacacctttcaagtgggatggaagttgaaacccactcagcagagaatatgagaaatacatgtgtaatgacacaaagttaggtgtgttagcattatgtccagcaaaggaggacacatacccaaaggttgggagaagtgggaagaggcctctgaaatatttggccttgtgctgaatgagtcgaaggagggatcagggaagaggtacccgctggattagctgctgccaagtgcccgtggcagctcaggaacttagactctcagcagtctctgttcaggagatgggagggacaaagcgctatcattggtaagaatacagcagttgctcagaaaaaaggactgtccatcatactgcagctgcagagtggccttgggtatatagaaacattgttaatgttctgttgggagcatcttagactgattagcagcagagctgattttcactcccagggatctgggtctctctctttctcggttaatggcaccactgtccacccacccagccatctaagtcacatctgggatcatcctagattctttgttctatttcaactctaatatataatcacaagtttcttccagttttactttcttcttcttcttcttattattattatttggagacgtagtctcgctcttttgcccaggctggagtgcagcagcgtggtcttggatcactgcaacctctgcctccggtgttcaagtgatcctcccacctcagcctcctgaatagctgggattacaggcacataccaccaagcctggctaatttttgtatttttttgtagagacagggttttgtcatgttggccaggctggtctggaactcctgacctctggtgatcttacccaccttggcctcccaaagtgctgggattacaggcgtgagccactgctcccagtcaaccttctaattatttttaagtctgccctctccacgctattattactagtttccagccctagttcaaactcctgtcatctttattctagattattgtgaaacatattaactggccttcctgcctgctgtctttctggcttaagtccatccttacattgatgttcatagtactcttttcaaattatcaagcccttcagtagttcctagtcactagaggataaagattcttagcatatctagaaaactctccctgatcagctctctactgacttctctagattccatcctatttctccacttcctacttatgcttttctcctgcctctgtattggttatctattgctgcataacaaatttttaaatgctataaattctatgacctcccaaaatagtgatataggcgttaagaagaaattatttgggcagatagtgagagtacaggagtcctcggtaaggttttccttttaatgaaaagcagaccccaaatcattttcttttctaacaaagagcagcctgcctataaaattgagctacacacatagacaagtaagctggaagcttgcacaggtgaatgccggcagttgtgccaataggaaaaggctacctgggctaggcatgttcaaaatggcagctccgtcttcccttttcctttccaaccatgtgtacagtagggaacagacagtaatgctggccaagtggaaagcccatttgcttaataaggttagggtgaggtggccagcttccctgcatgctatgtaaatgtcacacctggtccagccaatctgtgggccaatctttgtctatataaatcagacaccacctcctcaagcctgtctataaaatctggtgcactccacggagggccagatttcccattcagatgcccctctcttgcaagagagagaagtgttctcctttctctttcttttgcctactaaacctctgctcctaaactcactccttgtgcgtgtccatgtccttaatcttggcatgagatggcgaaccccaggtatttaccccagacagtgatgccacctcaataggagagacagcagcacatgagggaagtatagagggattcatttaattaggagttaaagtcaaggttggaaactagtttggaggtttgcagtagtccaggcaagtcacaataaagaactggattaggccatgagagtagatttagagaggtgaaggtgaatttgaagaacatctaggagattcagttggtgattgattggctgtgggaatgcagggccagagaaaaatggataaataaagaatacatcctggatttctggctttagtacttgagttgatgggagtatttccaaccaagatgaaaaatagggaagtaaggacaagtttagggaaggagataataagtttagtttttgagttcttcttaactacttttgatttttgtcaatataataaaagtaatgttataattctcatgataaaaaattttagtcttcttctccccacctccccatccttctcttatctctgagacctcctctcatacttttacctgtctgttctagcctttaattccaaatttccaagtaatctgcctaatctgtttcttgatttattggttttagggttacaccttttatttgaggtattttctattgacttattcaacaaggtgaaaattcaccacttttacataccttacctcctgactttcctaccctccaacctgtccaaatggtgatataattttctcttttgccaaatcaatatctaatatttaccttattatgtaaatatgctcactgctgagccaagtagtatactataattgcaatccatgtcttgtacagttttattttcttcatcaacttaaaaatttcctctttggattgttctattttctctatcactcttataacttctgtccaaacttgctgacagaactgtaatatccttattgatatgattttttacaaaaactcatgcggtagtcagttatagatatatttcttccttgaggacatctcatgtggatccccctctatcttactgctccaatatgcagtggttgctctttaaatataactgttattctgtgatttcacttcccctcttcagtcctagttcccctgttagtgggctcccatgtcttcctctttcttggtttacatccttgctttggtggaccacatttgccagtagctttctgagaagtggtatatgagaaacaaacaaacaaaaaaaactggctggttcccaagctgtatatgaggtgaaaaaaattaaattaaaaataaaaatcaaaatctagctgggtgtggtagctcacatctgtaatagcagcactctgggaggctaaggtgggatgattgcttgagcctgcaagctagaagctgaagtgagctgtaattgcagcattgtactgccactgcagcctgggtgacagagtgagaccctatctgtaaaaataataaataaataaaaataaataaataactcttatgtatttctgaatatttatttattctcatgattgatataggctgggcgtggtggcttacacctctaatccaagcactttgggaggctgaggtgggtggatcacgaggtcaggagttcgagaccagcctgatcaacatggtgaaaccccgtctctactaaaaatacaaaaaaattagttaggcatggtggcgtgcacctgtaatcccagctactcaggaggctgaggcaggagaatagctttaacctgggaggtggaggttgcagtgagccaagatcgcgccactgcactccagcctgggcgacagagcaagactccgtctcaaaaaaaaaaaaaatctaatacaattttggcttttgattctttttatgtgataccattctctttctgtcttcttctctggaaagtttctaatagtcacttctgaaatgtgttcttcatcttttcatttcttgatctgggaacttgatggttcctttaaatctgaaaaatcatatctatacctctgcagatattttcgcagtatttctttgataatttcttaccctgatttttttttttttttttttgaggcaaggtctctctctgtcatctaggctggagtgcagtggtgcgatcatggctcactggagccttgacctcctggggcccaagtgatcctcccacttcagctccctaagtagctgggatcacaggtgtgtgccaccatgtctggctaattttttaaaccttttttgtagaaatgaaatttcattatgttgcccaggctggtctcgaactcctgggctggagctatccttctgccttggtctcccaaggttctgggattacaggtatgagccacctgatctcccctgaattttatctgccatctttttctggaactcccattagtcagatattggtcttctggaaccaatcttctaatttccttatcttttttcttcctattttttaaagttctattatctttcaattatattttctgtgagatttctataacttaattgcactgtccttttatcaaattcttaagatttcttaagattatgtttttaattttcagaagcatgttcttgtattttattctgttgtttaatggatgcaatatcttctcttatctccttaaagacattttggtttttggagagttattctgcttcatacattgctatttcttgtgagtttttatttttgtgcagtttcttttggattttctaccaagttggaggctttgctcaaatacccaatggttccttgaagtctatttacatattaagtgtgagaaactaaattgctggttggacactgtgttgaagggatttgtcagcagttcactggctccctgcagttgattggtggattcaacatgcttcattagaggatcctacatgtcattatgtgtaggttctttctctaagagaatgcagttgttgcaaagaagaattcttcagtctcctgcagaggctgaagaatgaaggtatagagtccttactgcctacattctttctgctgagtgttcaaggggctggggtctgtcagtgtgtagaatttctgagttttcagtagggtatctcttccccaactttcactgtttcttatattcccaagtctagagtgtctctactgaaaatgtccaaataatgaatttgctgcagaataaggctttcacctctcttttagactggggagggacttgaggatctaaatgctgttatagactcttgccaattcctccattttcagccccatactttacttttgccttctgcagtaaccagtacttaccatttttgaccctttctgtagttgtatggtttgaattagcttgtttcttatttatattctgccttcattctctgcaaactatctgttcactttccatctaacaacaaaaatttgatctgccccatttactgttatctcttctattttcttgggtattgggatttataactttaaaaaatgtctttactctcattttagagaggtttcatgaggggacagaaataaacaaatgtttctgattcaccacgtttcagcaggattaaatgccattttgacatgttgagtttcatatacccatggggcatcaggtaaaaatgttaggcaggcagttggatggatgaggcagaagcttttgagaggcactctcattttgagtggtgtccacagaaagtgctggttaaagtgatgagaccactctttagtgtgtggaagtgtgataagctgtgggccaaggatagacttctagaagaattttagaagatctatgaaaacacaaattacagaaggcaaggcatcgataaatttgccaaaggggcactgtcagcatgtcagaaaagtcaataaagataaagacagatttttcttttgaatttagaaatatggagattattaatgattttggcaagatgatatgcacagaagtcagaatacattaagaaagaaaacagcgttttttgttttttttttttttgccttcagaaactgctgacagaagcaataatagagggtattcagtggcttatgaagcagatgaaccagcctgtgggctttttctgttgtctgcaccttggatactatacgtagtggattttcaaatacctaatgagggaatgcatgcagtgactttgttgcccttgcattagctgtgtgaagacattttggctggtttgatctgagatgtcatttctcatcctccactttctcttttcagggttggtgtgagcaagccagactgtatggggctttaaattctgggtatgactgatgaagctgatactattaaccatgtctttcttcaattgtatatatgatgaaattttgcaggataatagagacagtggagtataggggttacactagaataagacctaaattccatttttgaggcctctgagggagctcaaaacacagcactttgtctttctttcatgagttctgaaaaaattgagaaataagaaagaagagcaaggcaggaggacagtgaaacatcagcttgattaacgagggaggctgggctggaatggcacttttccttttgggcaaatgggtttcctatgactgatgcctgactgagcagacttgcccagcaatcctcagattcacacagggtttagagagaaaagcaccgtttcatgtggggatggggagtgaggtgagcccaacatgaccagtttatccaaatgtacccataaggtgaacctttctgcctgacaccctacccctacggagggaagaaggcagcagcaaggggccagcagtgttacactgttggacttcctggacactgatagagatatccagagctgggaagaagcagtgccctaaaatacaggttagctttcaatacccagcacgagcctgtacctgatcccccttcgaaccactccgaccatcgctcacctggcccccaccatgggcttccatctgcattgtttcctgttaatggcctttgtagtcactgttctcctgccaggaactctcttcttcctagacactgtctcatgccctcagatctgctcagatgtcacctactcaggggggccttccctgaccacctatctcaaatagtgccactgcttgacccctttcctctctattccgtttatcctgctttgattttcttaaaagctctcgcctatctctcttcctcagttcatgaaggcagatgctgtctgttttattcattgtatgagctaaggatatatttattcagtgaatgagtggatggtccagtcaacttggagtctgttccaggtcagctgctgcctggagtattatcacttgcaaagtggcccagtcagcatgggcctctattgaagtgctacactaactcctttcaagagtggaggtgggccaaggcgcagtggctcatgcctgtaattccagcactttgggaggccaaggcaggtgaatcgcttgagcccaggagctcgagaccagcctggccaacatggcaaaattccatttctacaaaaagtacaaaaattagctgggtgtggtggcatgcaccggtggtcccagctactctggaggatgaggtgggaggatcatttatgcctcaggaggcggaagttgctgtgagccaagattgtgggtgacagagtgagaccgtgtctcaaaaaaacaaaacaaaacaaaaaaacacaaagagtggaggtgaagcttgaatgagacaacatatggaaaagagctgagaaatgtactagaatcatggaagcgagtcctatagagtggttactgctacaaatagtagtcactcttttagaatcagggagaagtttcttgtcacttcagggagtggtggttaaactgatgacattgccacatttactaggattatcctcatataaaatgttctcattcattgttcccaatcttagcctgtatttgccacccggtgtatcctaatgttcttatttgaaaatgctaattatagtaggcaatagaaaggaggcaattctttttttttttatttttgtttatttttattttttgagacggagtctcactctgttgcccaggctggagtgcagtgatgcgatctcggctcactgcaagctccgcctcctgggttcacaccattcaaaaggaggcaattctaaagaagaacagagctacactgacttgagcaaaactaacaaaaatttcttagtggaagacactgactttgccatgagattttaatgtcctaaagagtagagagcttcacttaccccaaaaagtaatttctgaaactgaaagaagtacactagaaatccattatgaagcaatctgtggacctgtgattttcacttctttacagataaatatgcctttcagtcatttgcaatttcagtacctataaattctgcaaatggacaaaacaatccagtttattcagaattccgtttttatcaacagttgcattgaggcagatttcgttatattctgtcgtttatatagtggtatatggaaaatacgtggactttgacatcacctagatatggcttcagattccagctttgcaactcaatagctgagggggcatgagaaaattatttaacctgggactgagtttactcatatggatatgtctcatataaagctctggccttagggcttgtctaagaatagtgtcacagtcaagaaaaggtgtgctgtctgttagtgaacggctatgagatgttctgtaacaagggagcccatttaattgtatttaacccagactttcccaaatgtttttccttataaaatctgttaatatagacagataaaatctgtctatattataaaatctgttaatataatacagaattggtattccataaaggaccctgtgggaaatcctggcttgcataatgccagacatatttgatgtaagaaatcagttttgcttcccttttccagcttagtgttggccagtcagaattttcactggacgcctaccaggcaacttaaagtagaactcttggggttttgtgccttcacaccctccatcccaactccttccatagtcttcctgatctccaatcatggccccactattcatgtattagtttcctagggatgctgtaacaaaacaccaccatctgggtaacttaacagaaatttattgtctcacagttctgaatggtagagtccaaaattaatgtgtcagcaggaccatgctcctcctgaaacctgtaggctacgatcttccctgcctcttctagctgttgatgtttaccagcaatcctgggcttcttggcttgtagatacatcacttagtgtctgcctcttcgtcacatggcattctcctctaaagttccctcctcttattataaggacacgagttatattggatgaaagccctgccctaatccaactccagcataatctcattgtagctaattattaggttggtgtaaagttacttttaattaaaagtagtgtggctcacacctgtaatcccagcactttgggaagccgaggtgggcagttcacaaggtcaggagatcgagaccatcctggccaacatggtgaaaccccacctctactaaaatgcaaaaaattagccaggagtggtagcacacacctgtagccccagctacttgggaggctgaggcaggggaattgcttgaatctgggaggcagaggttgcatgagctgcgatcgtgccactgcactccaccctggcgaccgagcgagactcgtctcaaaaaaaaaaaaagtaatggcaaaaaccacaattacttttgcatcaaccttactacgtctgcaaagaccctattttcaaataaggtcatattctgaggtactaggagatagaacttcaaaatatcttcagctcagcacataacaattcatgcagttactctgggcagaaaacaggtgccatccttgtacttcttttctttcccttagccattatgtctggtctatgagcaaatattcatggatctgccttcacaatgtagctgaccatttctcattacctcccctgctactccttgaccccagcctttgtcatatctcttgggttataacagtggcctcttatgaggtatcatggttccatcctgattctccttaagcctacttgttagatagcaaccagagcaatcatgtcacagtgtaaatcagatgatattcctcccttgctctaaactctccagtggtctcccattatcattagaataaaatgctaacacagatgaaggaagataagactctaggagctctgctttatctgtctctccagcctcattgtgtaccactccctcccctattgactgtgcccgccaacccacagtaagcaccttgtttgcactgcagggcttttgtactgtttcctcaaggctggctccctctcagtctcagatcatctacccagagatgtgtttcccactcattgttagctgaaacacttgcaccccatctggcagagagcagagaaagtttttttcttttttttaattttttttttttttttgagacagagtcttactctgttgcccaggctggagtgcagtggtgcaatctcagctcatgcaacctccacctcctgggttcaagcgattcccctgcctcaacctcatgagtagctgggattacaggcgtgtgccaccatgcctggctaatttttgtatttttaatagagacagggtttcaccgtgttggccaggctgatcttaaactcttgacctcaagtgatctgcctgccttggcctcccaaagtgctgggattacaggcataagccatcatgccgggcccagagagagttttgtcaccactcatgaagcgaagcactcaggaaacaaaaggagagaaacaggaatgagatagctgtccctgggagggaaaggatcaataactaatgggtatccccaaatcagatttacatgagtcacaatccaaacaaatgattttcttctgctaatctgaatttggaaaggaaatccctacctaggagcagagatccaagagagctgatcttggtttaaaaaaaaaaaaaaaaaaaaaaaaaaaaactcttaactttttgttgtttttttattggttgtcccaggatctcatctgcaggttctggaactagtggggtgtcacagccaccccatgttggctgccagaaactgtaaggggagaaaaagaatatcttttcctcatccatcacaaggttcatggctgagcccctataacaaataaaaagaaaaaaaaaaaagattaaatgggaaaagtataaaagttatatttaatgtaagttttcagtgacacagaaaccttcagaaaacgaagccccaaggacccagggaaaaccatgtgtgtttagggacagttgtgcagaagtgtaattggaggacaaaagagtgtgatctaatagtaataatctggggaactcagcgaggcctatttgttcagattcctttcagcctcggtgtgacattccttccctctgggtatagggcaggacccctctggaatgagggtcttatgacctactttcaggggaagtaggtcagagaattctttcatggccagctctcaggagaaaaaggtgggaaaaggtcagagagcagccttcctgcttctgctgttttttcaatttcctgctgtttaaaatactcactgtgccaaggtgccattattttgggttatcatgttgtgagccccgacacctcagttccttgctttaccacttactaactgtgaacctgagcaaatcacttagattctctgaggatcggtatctcgtctataaaatgagatgacaaggtaaggttgtttgtaacccttaccttcctggttagaaataaaaaatataaagcaatcagtacagttttttgtacatagtaagcattcagtaattggtagctattaactggtatcattatcatgatggtgcctttagtcacaggcatggcccttctatttcaaaactgttgaagaacatgttgggataatgtttacattttactttccaccacatgcccacttaaatttcccttctggttggagtgggatttcaaggaaaagctctagactgtggtgtcagattatattattttctcctcttcctgatttttctcattctctccctgccacacacctctagtttccttttcctgcacatccaaggatatggtggcagagacagggatgactaattcgttagagagattagacatcactgtctgatgccagagaggaacctgtgaaaaggagataggcgtgtctcagtgccacttcagcaaaaggttgccctttaccttgcatgccatgactgtgtcctccctgggaaaagagtacttcaagagtgttgtccagggtgtcaacatagtgagactctgtcccttaaataaataaataaataaactcctgggctcaagggatcctcccgccttggcctcccaaagtgccaggattacaggcatgagccaatgtgccgggcaataactattttaattgcagctacaatggttattatatgaaagatatgtatcctttgattggagtaatcgatagtgtaaagtggggaagtggaaacgagtgaaggggagaatataaggctggtttaaatacctgctctttgtttgtttgtcctcatcctgcaggttttgtttttgattcttttttctttggcaaaacacacacctccagtggcattttcaggtttcttttcttgaggtcttgcaaatctgattatgctactggttgatcaggtaggggagaactggccaggattttccctttttgtctcttctgatggtcaggtcgattggaattggagtgtgagctaatggaaaatagcatctagctcattttaccaataatgaagatgagcccagtatgtgcaggtaaatgtttaacaattggcagtctgaaaaaaagaaggcctgatttctggtgtttgctggttactgtggtataaatactcctaccatagttgatttcaagctaccaacaagattactgaacacatagttggaaaaagatgcccagaagcaaatcatcatatgtgtaatctgtctaccacacagatacaaaaaacataactctagatcacagataatagtaaaatgtagtaaaatcattaggaaatgataagttttgagtactttgaacatatgttttaaaatgtaacttcttcaataacagtttaattgttaacggtggctctgttgaacaactgactctcaatatttctgaaaatttaaccatcagctctcttgcgctggcttgagcacatcaggtgggacccagagaagttactgtcttaccaaggtcctcggatgagtcatggcaggacctgggttattacagagttgtttctaaaaaccagactactctagacagatttacttatcaacgtttctttttattcatttgtttatttatttactccatcctttaacaatccataaaagggatttaagactattacaggctgttattatctattgagacagtaagagtcagaatatttgaatatatctggaataaaggtgggagagtaggccgggggcggtggctcacgcctgtaatcccagcactttgggaggccgaggcgggtggatcacctgagatcaggaacctgaggtcagcctggccaacgtggtgaaaccccgcctctactaaaaatacaaaaattagctaggtgtagtggtgggtgcctgtaatcccagctacatggggggctgaggcaagagaatcgcttgaaccgaggaggcggaggttgtagtgagctgagatcgcaccactgcactccagtctgggtgacagagcgagactctgtctcaaaaaaaaaaaaaaaaaaaaaagacgggagagtggaaagcagatgagatttagagccataagtaaattctggctttgagtcttggccttgtcatcttgatcaagtcagttactccttggtaaaagttttctaatctgaagatgaaggaactggaccacatgaacatttaatatcttgtaggtctaaaatatggttccttatttagattcatcaattcaataatatttgcttagtaccaactatatgcactctcattatgaactgtactccaggcagaatgaaattcagatatgataataaatattattataatagcatctcacatttatgcagagccttctgatttgccgaagagaaaatttactttgagtctctgggattctgtggctttaggagatcaggacatatcttaacagaatgttagagaaagaagaagctattctagaagtacaaatagaaccttattcctaggaaacagaagaggtcatacccaggtagtaataaggaataagcactttttctgccatgtctagcagttgcttcactttgtttttttaaaaaagcaacaaaattaccttttttctgagtataaaatttttgtagaaaatttagaaattattaagaagtattaaataaggaaaaaaaccatatatccaatctaatatcctgcttttctttacctaataatattttatcatatttttcaaaacattcttagtagaatcattttaattgctgtatgtataataattttatctttttggtatatagtaacttatctgatgtcttactgttggaaattttatttattgacaatttttattattctaaagaacactgtggataaatagctttgttccatatcaaaaatcatacattggacacatgattttcaactttaatatttaaggtttagtaagacaattttagcaaattatatacttttgacctttagagtctttgattctgttgatattgttttgtatttacccagattttattctgtttctaaacatttattaagaagaacattttgtttgaattcttcaatatgatatgtttgaactggaaatagcaccactgttttcatattatttcaagtaggtatgataaagtgtagggttaacaattttctttttcaactttctgtgggagatatcctctgtctagtataaggtttgttggtttagaaattgctcaataaatgttcaataaataaaaggactcatgctaatttaggataagcaaaaacatatgagagggtgtttaaaaaacccacttctccatttatgataatagctttcattctcataaggagagataacagctaagcacagttcaggaattctgactgttgaatgagaactgtaaaatgaagtatgtcggtgctttaattcacctgaatgggaaaccatgactcagatagttatttgattaaatgttaatgagatctactaaattgacccaattcttacttttatgtattagatttatatcaattaaaacaggaccagttttacctgttttccttttttaacatctttgagtcaacatctgcttacaagggaagtgctgtaactaccctggttatttaaatattaatggcttccattaaagggagctagggattggcagcaggaagattgagaaattagatggcatgattggtttcttgtttctgtccccaggggaaaaaaaaaaaacaaaaacctcttactggaagagcttcttccattatttttttttaatattgcatatatatatatatatatatatatatattttttttttttttttttttttttttttttttctgaaccagttagagagtaagattgttgatttcaggcatcccttgaaagtagctgtgctataaaagcatcagtgtaaacaagttcaagtaatttaaaaaaatgttttcacagtgccatagaggtcattaccctggggcttcttgggaacctaatttcagttcctaaattcattttgttctttattatagtcagtaataggcaaaagcattttttagctccatcctggatttggttggccttatttacattaagtgtggggaattctagtaagttaaccctgagagacatgacaagggttatatattcaatcacattataattataaacctttatcttactggggaaatgtgcctgaaaagcttttaaaatttgctataaccaatattttcatgttatgccaaattgggttgtaataagcatgtcgttaaaagatttttacacgttttgtatttttaagatgttctaatggcttggcattttaaagcactgaacaaaagcaggcattatatttgcataattgtgtatctctttttgcatccagaaatgtgaatgtgtggagtaccctttcatttcatgtatttgatttagaatttacagctaagaacatagatcatgcttaaatagcaggagtgcagagtcatgtaacggccctggtgtgcttgtcataattccctacttagcaaggtcaggattagggtgagacaagagaggcactacctcaggtgtaaaacttaagaaagtgtcaaaaaaaattcaagactagtaatatgttaatgtaatagttaaaaaactgtataatgcagagaaaaattaatgataataaaaatggtcaacattttagatcaagatgagatctgaccctgcatctgtacctccctcgcttctccctagtcctggccttctctactttcatgtccttgcatgagacactcttttgattcaagttttccttacctgaatttggtgacaatagtcctcactttcctggtgacaaggatttttttccttggccaaattttagtcaggcttctgaatctcctgctaggcctgtttgtgcacgtccttgtaaaatccagttttagcaaaggacactagctaagtcgttttaccaagaaccagcaacatcaacatccgatcgcctcaatgtctgaccaggtttctcatcctgcaccatcccccaggtgatgtctgatcaccctggcctgtcttcagtgagaatcctgttaggtttagccagatccaccttaccccaacgcttcctttgagtaattttccatccactgacccccacactgctccttggctataaattcccactggcccgtgctgcatttggagttgagcccaatctctcttccttgctgcaagactgttgactgcaaggtccctgtgcctgtcattatcctgacaaagtctttgtctccatgctttaacaaataccattcagtcgtttttctgtaacactggtggaattaggagattcaaatcatctacaaatacatgggaaagcccactataaatataatttacatattgatgttcaagtaaataattatacagttttatgccattattattataatctcagatgaatattctaagcaaacatcagatctgaagatctttggaaagctttgtgctaatggtttggggcctaatgtctttaatttacttatcagctagcaataaggggaggaacctaagggtagttgtaggaccctcccccctttctttcttccttcctgtttttgtttttgttgttgttgttctttgatacaaactggggctttataagagatagagaacataaccagaaatccattgcttctttgaaatttccctgaaaggtgtgcatggatgcctgaggtctcacctttgcttaagctgtttccacccacccatgatgcctttcccatttctcccacctgtctgagaaccattcaccttttatccatatccaacttggataaggcctttctgtgatctttcggcctgaaatgtgctttcaatcctctgcccttctgtggtggcataatggtttctaccacccatttatggtcagttacagagttcttgttgttctgagtctttatctaatcctccattgaatttactttccaaactgcattttaaaaaatgtcagtggttcactcctataatcccagcactttgggaggctgaggtgggaggattgcttgagctcaggaggtcaaggcaacagtgagacgtgactgtgctactgtactctagcttgagcaacagagcaagactctgtttaaaaaaaaaaaatcagtaattgaaaaattactgacactgtaaatcccttgaagagtctcccattagcctttgaatttaagagtaagcagggattgggtgtgcttatttatggtgctatccaaggtccttgcagagggcctttacacacaatattttttttaagtgaataaatgaatttcttgcatgtaaaagggccaggtaaatatttactcttatgattcatttttggaatgctgtttttatcctagaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggtaagtaagtttaattaaatcagaaaaccactggcatgagttcaacagtttctcttttttttttttttttttttgagacgaagtctcgcctgtcactaggctggaggtcagtggcgcgatctcagctcactgcaacctccgcctcccgggttcaagcaattctcctgcctcagcctcccaagtagctgggattataggcacaagccaccatgcccagataatttttgtatttttagtagagaggggtttcaccatgttggccaggatggtctcgatctcttgacctcgagattcacccacctcggcctcccaaagtgctgggattacagctgtgagccactgcacctggccaatagtttttcttaaaacaagtaacccataggatgcaaaatatatttcagtatttttactcagttgttttatttcaaatatatatatatatattttgtttgtttgtttgtttgtttgtttgagacagagtcttgctctgttgcccaggctggagtgcggtggcgcaatctctgcttactgcaacctctgcctcctgggctcaagtgattctcctgcctcagcctcctgagtagctgggattacaggtgcccaccaccatgcctagctaatttttgtatttttagtagagatggggtttcaccatgttggccaggctagttttgaactcctaacctttggtgatccaccctcctcagccttcaaaagtgctgggattataggcatgagccaccgcacccagcctatgtcaaatattaatgacttgatgtcatatgttgtctgagtttttagctaaaatgagaattagccggggttgaattacctgcatggttgagttgcagcattttatttataagactagtagagtgcctgtcccccagtggtcacttaatgctaatactatccttaaaacttactatgagtcaatcactggttccaagctttctgcatgaacttatttaaacatctcaacatcccggggaggtggacccattttacacatgtgaaaccaaggcagaaagagattgagctactagccagagttcatgcagatatcagctggtgtgtaggcttcatactcagcctcactgcagcctccctgctgtgccccgttatccagcaagtctgggccttagttttctcattaagataagatggagctttaacaacttacccaacttacagagatgttatgaaaatccaatgagataaggcacgtgaaaatcttttgtactctataagttgttctccaaatatgagtgtttgcaattggctttatttagagattgtgggtttttctattgttattaccaataggaaaaaaggtatcacttagtgttatcagaggctaaaatttatgacctgcatctgctcttttttttttttttttttttttttgagacagaatcttgctctgttgccaggctggagtgcagtggtgcagcctcggctcactgcgctctgcacctcctgcgttcaagcgattctcctgcctcagcctcctgagtagctggaactacaggcatgtgctaccacgcccggctaatttttatatttttagtagagatgggattttgccttgttggccaagcttgtctcaaactcctgacctcaagtcatctgcctgccttggcctcccaaagtgctgggattataggcgtgagccactgcccccggccctgtatctgctcttaatgcttctttgcgcttaatcactgtgcgagtaaatgatttcaactttctggacttcagtaggttcctaagctataaaacagtagacaggtagctattctgaggagctgtttgcaaagagcagcagaaaaatggggtagtggctggagggagcactggggtccaggaagggtctttaacagaataggagagaatgtttgtttgctgatggaaatgatgagtggggaattggtttggtttggggaaccattgttggagactgtgtttaagaaggtgagagacagggatctggcacacaggggccccaaggttgtcccttgtcacaggtgggaaggcagagatggtgcctgtgaagctggcaggttggcagatgtgatgggaatgaagaagaacaccggaaattttagacaaatggtcattttaaagatcaaaagcaaatctaaatactctataaagaagtttaaaataaagcaagttttattcgttcaaagtgttctcacagccaataggatgtcattgttttttggttttcgttttacacgaagacattcttgtattttaagggtatgtgtaagtgctgttcatatgtctttttctgaaatacacattggcttcaagtttcaccatctcttttctaaggaaagatgaaaaactttgataatgtatttagtgtattttaaaaaggactgatttttacctcacaagagaagtcttgggaagatggctgccccaccatatgggctgataccattaagatgcttgtgaagaggcaaagtgtcgttaaaccctccaaattggattacatgcacgtatttcagcttccttaacaagtggattctgatggcttagatttctgttcattaacagtaaatcaaagcaaaccatttaatgtagggatgaaaaggagttaagtaattgttataaccaaattctaccaatccacatatgaggaaattgagactgaaatactttatccgagttgcccaacgggatgtgtgcagtagagttgggtagcagagatgggtttaggacccaaatcttctgacttctgctctgtgatttgcctactataatttagttctgtttgtttcagaagcttctaaagtgttcttctaaagtgaccagatgcatacacacaaaacaattaaggaattaggcagtgcatactaaagtactaaagtattacatttaaagtaagtgcactggagattcggaggaggaacctatccctgtcggttggcataatcgagggagaaaatactagagctgtcgtagttgtaaaaataataagtagctaacatttagtcattatatccctagtacctagcatagtacctatacataataggtatgtataaatatgtatggaatttaaatttgggtaccaaccatgtgccaggcattgtgctttacatccattagctcatgtagttctcagagcaaccctaatgaagaatccataagcattgttcccattttacaaatgagaacactgaggcccggagaaatcaaatatcttgcctagggccataaaactagtaagtggcagagcttgaattaaaacctatactggccaaccccagggcccatggtatgaaccactatgctatatgagcagctctgaattaaaccctatactggccaaccccagagcccatgatatgaaccactatgctgtatgaccagctctggacttcagagtgtcgggtaagatttacgtaaatagcgaaaggtctgtgcgtaccaaatgagagaaacagcttaaacaaaggcattaagtgaaagtgaccatggtgtttctgtatcatacatctggtggaaccaagtaaaaagaatacagagaaatccatctgagagactactgacatctctcctgttcttgtctttcttgcctatgagcatttctcagttatgggtattagcagcagccaagaaagattccaagggaggtagttttatcttccaccctcccatgtcaagattggtagatcttcatctgatgattgacaacatttaaaatattaaatctgtgtataatatcacttcctgaagttatgttacacagtcaaattctttgaacagaattttaagtggctgattcaaaatctggtacatctgggtattcaaatgtagccctgacaacataattaaggataattttattcatccgctttgctgaaagttcaggaagctctggacagatggtcagctcactcccctaaatcccttttgtttatcgagtctgtcaaaaccctaggaacgtgagtcttattattgcaatggaacattttcgagataaacagtagctcgcaaaaaaacaagggaaatttttaatttttaaatcctcatttagctggcttagttttatgtaattgtaattgcatgtttactttctctgaagctagaataaatctttactccctgaaacaaaatgaagtaggaggcacattttagcttgtttataaacactgcattttcacactttaaagactattttactggtaggtcctaatttattgttacttatgatctgataatgtctgtccacactggtgataacttgagtgtttgtgaatctggcatgcatgctgattagctggttcaagccctttgttggtcacattccaatgtttttgaaagtgttaatatcacaaacattggttgcagcagtaaaaaacaaggaggaagtaaaatcacttcaaagaaaaccttttcctttttaaaactgttctaaacatttgtattgtgagtcatggtgctggaaagatagaaactcctccatcttgggagtttgttttccacattccattaatagaaggatgcacaggacatttgaaaatataaaaagtcattttagttgatgacattttaaattattttactgggatttagttagtggaaatttaaaatttgaaacagggcaaaactttttttatgggctagagaaaagttctaaatttcttaagatcttttagcaaggtctgccttaggaggtttttgtagaaataagccaatcttggtgccttgtcagtagggcttgttttagttcattcatttattgacttgttcatccattcatttgttaacattcattcattaaaaagtatttattgaatgtcttaggtgtgtaagtcagcatgccgagtcccaaggtatgcaaagttaaataacacaaattccccactttccaacctcctgacctaggagggaaggtctgaaacatactcaagtaaaaggtagtagagaagctactttggcatcctcaggaagggagggatgagtgaacatctgaatcatttgagagcagtctgtggaccctgtgtggtgctggtcttgggagagatagattgattgaatcatcctttcctctgttccattccctccagctcctttctattatatattttctctttttctcattatactttgacctttctcatttttgtgttgtctttctcaaatcctcttcttcccatttacctctctgtggtccacatctcactcatttccaatccacagtttttacttctctactctcctttttttttttgggaggcagggggtggtatctgtttgattttgagaagattaatagttttgctaaaaatatttcaaaagcattttaaaggctgcccagccctggggggtgatctttctctgggctaattaagagtggaagtgaagaaagggagaagaaaaacgacagatggcgggaagagtgggaggggaggagtggcaaaaaccactttccccaaacacctcccttttctttctcataagatcctcacctctctctctttttctctggctttttttctgatggaggagggatagacctcattgggaacagaatgtgaagaccaacagaggttgcattaagcaatcttccctgggagaaccaggctgagccagaaaaaggaaattcttctagacttcacttggagtggccaaaggctaatgataactttcccttccaattgactgaacccatattttatgtgcagtgctaggctaagggttcatatgcatttttgttgtttgatcctcacagaaagcccaggatagcggaatcagtatttatattttgcataaaaggaaagaggctcagagagatggagcaacttgctggggagtcctaatctagttaggattccaaacccaggtctgtcaggctaggaaacccatgctcttctattgtgctagcctaacaggaccctcaaggaccacctgttgagacctttcttttgtccccatgacctcctctgctcagaggtgctccctgttcctagtcagcaggtgcatttcacagacagcaacagtagttctgctccctacctgccagcttctttatatagattttacatgtgggggctcttttaatccaggtggcccacaggcagtacatcttccatagaggagaaactgaagaacagggaggttaaatgcctgtatggtgggtcaccagctggtctataggagcactaggatcagcaaaggaactgtgtggtctagatgagaggttttccttttgagaggcatgcctatatatatgttttttttttgagacagggtctcgctgtgttatccaggctggagtgcagtggcatgatcatggctcactgcagccttgacctcctgggctcaagtgatcctcccacctcagcctcccgagttgctgggactacaagcactgccaccatgctcagctaagaggcatgccactacttcccttcccactccttgccacctgcaccttctgactcactctagttgaaagccctgggggaaggaacaaactctgcagcctgactgctgtgtttaatcccagctctcctctactagctggcaagtcacttaacctctctgtgcttcagctttcttatctgtaaagtgggaatgagaactatacttcccacatcatgtaaagccctggtattctggccttgtaaaataggaactagtggtcccaaaacagcagtgtgctggtaaaagtttagcaaccagcccttgcagtcaggaccctgacttgtagcatctattcccttgagtgttaatattgtcaccttggcttattttatcctgtcaatgtctctgaatgctgagctgggaaaagatgctaacaattagccttccagagcctaagggctccacctaccgtcaaaggcatctttagtcgatggcatgtgaggagtcaagcttcctgacctactagccagtctccaacttaatatggctcagacttacatcgcttttcttgagtgactggttcctactggggacacattctttgtcaccactaaaggattcttcttcacccaaactttcccttttacttcgccaccacattctgctgttttctgttcctttgccactcccttcctgaccactacttcccttcccactccttgccacctgcaccttctgactcactctagttgaaagccctgggggaaggaacaaactctgcagcctgactgctgtgtttaatcccagctctcctctactagctggcaagtcacttaacctctctgtgcttcagctttcttatctgtaaagtgggaatgagaattatacttcccacatcatgtaaagccctggtattctggccttgtaaatgtcagctcctagtagcattctttactcctgggcatccttggctgtctaagcatccccaattactccttccctgtgcctgtcccaatggtgccataagaacgccaggacccctggcccccacaactgccccattgtcctatttggctccccctgagtagccatgaggtcactcccagtctccccactgtccaccactgtccacctttccccaatgtccacagccacccacactcccatatgcctcagcccactcctcttagtagatgtgacaggctttttgccttcatgaaaacaagagcgtgaaggacacaggccttctcggggcgaggccgagagctgcttcaccacattgttactcttgcaccccactgtttcaggtcaggttactttatcctgctcctttccatgtggcccaaggtgatcaccttggtttatgcaaggtgtaatgataggagattttcttttcttctttttaaaagaacttaaaaaaaaccttattacagcttataaaatatatttgggcacccctccccaaaggcttaaaactttcacatatccttggctaaattgtgaacgtggactatgtgggattggccaggggcaggctggaatttgctgaaggaactacctgtcataccagttcccttttagcttatctaatcactccatttcatccagactgagatagatggctcacatttttgttgttattgttttctgtaatccttgggtaaattttttttcccccactaggaagagaattgagtttggtcggccctttcccaggactgaacatgaagagttatgccggcttcctcaccgtgaataagacttacaacagcaacctcttcttctggttcttcccagctcaggtaggtgcccaacagaaagaacaccagtgttcaagacctggcttgccgtttgagggtagaaatgttagcctaccgagctacaggtctttaaaaaaaaatctcatagattttttctaaaaataagatttttgtttttctaaaaataagcaaacctgcatggtgttcctatttatgggcaggaaacaaatgttttctgcgggagtgggaagtgtccaacttctaaatttcttgcagccttatttggagtgttaatactaccaccttcttcctgccacagtcttcttcctatcattttgttgtatttttgttctaaaaatacttagggcagggatgggtcaggggagcccaaggaggataggaagtaaggagattcctgaagtgaacaggtaatgcgtggctaagtatgtttatatctagtcagccatggccttgtatagctgcgctgtctgtggactccttcatgcactcagtacccacttattgagcatattctgttctgtgggggccacagaggagacagaactgaactcagactctatggatctttagaagattgggaggattgccgatctaggaaggcttctggcaggaaaggccatcactttcccaaatctctatagacagaggtgggtatgtttttctacttcaccaatcctatgtagttcacctctagattatgccattcttctgtatgaacaagacatttttagcttagaggtgctgttgcgggtattgctggaagcgctgagaagcaaatcttattccactgcagagtaattttctgttttcatcctccaaattggatttgttttacaggctagagaaagcaaagaaaaagctatccctatggagggtgttatttatattttcatgtgatttgcatatagctgggttgcatctgtagtaactgagtaaattgcttggtccagggtggttttcaagttacgttgtttctcctggtactattgagttatattttcttgacttttctttcctgctctctcaactacatggcctctgacatagttcaccccaaagcagcctgtggtgggatgtggtcaggttggggcatgtaagaaatggtgaaaaattccagatcctttgtcgttgggctcacagtagccgtcagcctgtcgtcttttctggaaggctttcttggcccctagagagggcttcttatttcttcgtcagtgttgtgttgagtgaggcaagtgagatgcctagagcttgcaatgcaaggagacactcaccctgagggtcatacaagtgcaaggtcagcactggagcctgagcaccctccagtgtcttgcttggtgcctcccataggtagagcccaactgggagccaggtggaatcgggtggtctagcccataggggtctgcctaacagggcacagagcgggatggaggagagtgataataggccttcccagtctcttaaactttatgcctttcagaaatattctgtatgtgtgcattttttatatcatatctattgatgtcattgaatgcagtcatttatctgcagtaacttctttatattagttttctcttgctgctataacaaattgccacaaacttaatgtcttaaaacaacgcacattttatttcacaattctgcagattagaagtctgacacaggtctccctgggctgaaatcaaggaccagtagggttgtggtacttctggaggctctaagggagaatctcttttcttgcctcttgcagtgtctagaggctgctcgcattccttggcttatggtcccttcctccagcttcaaagcctgcaaaggcagcctgagtccttctcacagcacataatctccatggtcatgtttccttctctgactcttgtcttctacctctgtcttctaaaaggactcttatgatgacatttgggccacctggataatccaggataatctccctattttaaggccagttgattagcaactttaattccatctgcaacctgaattctcttttgccctctaacctaacatattctaggaattaagacactaacatctttagggagttattattctgtacaaaatggatacttgaacatttgcctagattattgagtctcgatatgttttctctcagggattctcacatgttattgcatacaagaattctctgacttcccccagagattctgacttgtaaattggcagaagccagcaggttgcagaattaccaagtgaaccattctctgtgaaaccactccagcctatgggccactaccctctgcctgaagctcctggctgaaaagtgaccaacacgccttttaccagaaagaaatgcctacagcagccaaacccagacagaggtgatgtgtttcccatgttgagggttgaaatgaggggagtgaagagacctgtgcagcctgtggaggttggcttccctaatccagcttgcggattctctaagaactgttaggactgcttccccatcttctttccactctagtcctcctcccccactctagctggagaactccaattccttactttcccttctgctttgttacttgtttttgacaccagtcagttccttgttaccctctgaatgttgagtcttctttggtaatgatccagatttgtaaaaacaggaactaagggtgagagaagagatcagatggaaacaaagcaaaaacccagtttttttctttctcaggttgcctctgggcaggtgaacagctatgtctagaatgtaggtggtgctttggcaccgtaaacctgttcatggaaaggaatttagtttgcatgctctactggttgccagactgaagtctgaaaacccccttcattaaacaatgactggactgttggtttttgctttttccccttaattaaatgaaaacctagctgtgcatcccctgaccaggttatgttcttttgagtccagtactgtagccataaacacaacctaagatgatcccaggagacacaacgggaaagaatgtctttaagtgtacatggtgttctggtgagagtgatagatgaagcttcgggagaagaggggcagagatgaaaaaacggtacccacagatgggtaccaccatgtggcagccaagatagattgttccaagaacctcttaccaggaagcccacatgcagagccagatatctgaggcttctggctataaattatggagtcacaccagtttgggtgaaggagataaagcaggtgtgacaagaagaagcagtggtcactgagacacatttggcagagatattagttcattgtctgtcatagggaagcagctgatattgtcaccaggggagaaatgacccctttaaaaaactgaaggtagagaaaataagagatccaggaaggatggcacacttgtcatatcctctgagtattttttggggggatgctgtttcttaaattagttttgttttcctgttattgctgtgagactgccctgttattgtatacaaatcagtgcagaataaattccagaacttgaaattggtgtgcagtgggaatacaacctgcaagagaaaggagtaggcattttgcatgggataaaaagtataaggaaactagcagaaatgtagcagttatagctgctggtaattgaacactgactatgtgctaggcactgtgcattttcttatctaatccttacctgaaccccatgaggaaggaattgttatcctcattttatagatgaagagattaaataatcagccccaagttactcaactagaaattggcagaactggaatataaaattaggcctccgatgtggaaatccttgagcttggccgtcatgtgttagatccagagaaaacgagtcatggaaggcacttgagtatagtggccaagactacagtctcttcggtaagtcaggcttggatagaaatcttggcttcgctgcttaagctaaaggtgaccttggggaatttcttagtgtctctgagcactggtttcctcattttaaaatggggaccaaaatacctacttggcaatggttttgagacagaagagataataagggaaagcattagagtggcacctaaaacatagtaactatagttgctattgtcattatttcattatgattacgattattatggttattattacttttaaaattattaacacaaataatgtcaagaactaaaccagtcacaatttgagaggttacagatgacagcaaatagagggaaattgtaaattagaaggacctgaaccccagccatcaaggtggattaattgctaccaggtcaggaaattactaagtgaaattgggatttttttgcactgaagaagataaaaaagacatagagattattactctttaaagtcagcatccttctcattggaaaaaaaatagctagtattggactttgccttatagatgtaggaacatagataattcattggacacatttagccaaaacctgcagatcagttacctcaaatgccatggagccaaaacctggggcatttagagtcaggcctaggccccttcacggaggaccccaccttgatcctcaggccaagaggaaaggcccagattcctggatttgagaatctagtgtctatgaaagatcaggattacactgctgaggcccgtgaggtgctggggcaacctacaggaagggctccctctcaggatcctgcaggctgggccctgctgaatcagatactaggatgatcagatagcacaatcagcagtcaattggagagaaaatgaaccgctctaatgctcctggtccaaaacaaaaggcgttctctctggcagtagaagagcatgtcccagaggtgcctggaagccaacagaacagcccttcctgggggtgaaggcgtggaatcaggccccaccatacttcagcatggtgccatgtacactccctcatctgcacatctgaacttctccagtaacacagttaatgtggaagaggacaggaattcccaaatgtgctactgctcaccagaaatacctggagagctttggaaatatgacagatctcccagctcattgtctagctgcacccagcagagattctgattctgcagatctggagagggcccagggatcagtgtttgtaatgtgctccacagtggtcccagtgcagccagtcaatgggctggaatttgggaaaagagatctagaggtttggatacagggattctaattccaagtctgcgattcccggctgtataacttgggagatggcattcgtattctctgggcctcagttctctcatttagaaataaagatgttaaacctagtggattgctaaggctccatcccagcattacattctgtggttctatagttaagtataaaaatatccagtaactccaaatcaggatgtggattgaatgaaggagcccttgaacgtgtggcctgtgtggtagccagccttcaggctagttcccagtgctcttcattcatcccttggtgtatgtgcccttgggcagtcccctcccatactgaatcaaggctggctttgtgaccaacatgctagcagaaatgatgatgtttgacttccacggctaccttataaagggcaatattacttgtgccttggtctcttgaatctttcagtctgaggaaaggatgccatgttgggagggcactcaaacagccccatggctgagcctctgtggagaggaagtgaggcctccaccctccagtgggtaccaaccttggaagaggttcatctagtaccagtcaatccttctgatgactgcagctctggctgattccttgaccacagtttatgggagaccctgtgccagaactgcccagccagacaccctcaaatttctgacccacaggaatcccgagagatcaaaaattattattgttgtcttaagccattaagttttggagagatgttgtgcggcattagataactaacatagcttcttgtcttgtacttctaggctgtggctgtgagatcttgtgacaactagcatatactccctgcctgggggaaggatgaggacataaggagtggggattactatgcgagctacttttaatttttgtttttttttgcctctcagctccaattctaccctcttccctgttctgccatagtagagctctcagcatttctcctttgcagcaagcacaatattaagctttgtcagtagagggtgctggagagacattgcaggaggaatttgtcttctctttctgtgcctatgtcctgcctttggctttttcttggccccactgcctagtctgtcagcagtgtgttgaggtggggggtggggacatccagtgacactctgccttagctatgcacccagaccaccaagactcttagcaagatgatatccctggctctgtccaggtgatcacctggctgtggccctcccagtatgaacacaatataccctaggccttgccggtgagcaggctccctacagccctgctctctctgcagccctctcactagccttggccatttgcaccccagagggtcgttcccttgtccctcccagtgtggacaccgtgtgctccaggctgtgtgcaacctttcaggcaagcaggctcccagcctcctgagtctctctgtgtccacctgccagtcacagcccacctgttcctatttacccaaggatggttgaccagctttggaccagggtactcagtgaacttctcagctactcagaaggctgcaaccataccttctccaccgaggtctggacagcagccttgggaagggtcccctccctaacttatgggcttgtccatctgtgagcactctccctagcccagggcattctttggaattctctttgtatatgtatgtttagttctctgtaataatgaatacttctaggtattaacatttccttgttccttagtggacataggaagcctacccagcattctggtctttggccaacactgaggatgtggctgtgggagaacaggcccctctggtgtttcatcttcacttttgcccaagggtgtctgtgatacccatggctggctggggccagagtaaacactggaacttgtaacagaattaaaggtgaatgtttccaagtaaaaaaataaattaaataaaaaattaaaatgactctgtggtttttgacttctgattgggccttaactgatgcaggtaccattctaaatctttctccagccctgagacaccaagggctggacatgtggtctggcctaaggaacgagtaatagaaaagcctcgggaggaaaggcagtcagtctttctgtctcagccctattctgtctgagaccacaggattccctcatctgtgcttcattcttctcccttgacagatcaacatgctttgcttctccaggcactcggccaagtatggccaacctttcatttccaagtttacctgtccttgcatcatgtagccagcagagattaactagcacccatggctgccacagtctggatcacgtcttcttccttggtccagtcagctgagactgaaggtgctgggtattagccatgatataaacatggctagcaggctagccatggatgaatggagactcatttcttagagaaggggacatggactggacagatttattaaaatatatctcaaaatgtatctaacacaggtggatacaaatccaccagcagtgcaacaaagatttggagatcacagataattgtcttcttcaaactgactctatttatcttctctttgctacgtacttaatggcatcagagatatagaagaatagagggtgtcagagacaaaataaaaagaaagtagcttaaggtgatgttatagatcaccacccataggtataggtatatttgaacactctgcagaaacttttgcatgcctgatttcctttgtggaaatgaaataacatagagagaaagtaactaacttttgcatcaagaagggaaagtaaggtgtcttctccacacctccctgcatccgcccacttccctattccttataaagtataactttctggcaggaggcacaaagagaatagccataactatctcatgaaggaatgagccaggtagaaaggttaggaaggagaaagttaggattctaatggggtgtaagctggtacaaatcaatgagacaagccaaaacttgatgagagtcaggagcttcggaatgatgcaagaaggcctcaaaacaaaaaaagattttgaggctgggtgcagtggctcatgcctataatcccagtacgttgggaggccaaagcaggtggatcacttgaggtcagaagttcgagaccagcctggccaacatggtgcaaccccgtctctaataaaaatacaaaaattagccaggggctgtggcaggtacctgtaatcccagccactccagaggctgaggcaggagaatcgcttgcactgggaaggtggaggttgcagtgagccaagtcgtgccattgcactccagcctgggtaacaagagtgagactccatctcaaaaacaaaaaacaaaaaagattttgaaaaaattaattttctgtatgatggtgccatggcagcagtcatagtaaaggaagatttggtgagtagtcaacaccaaccacttgaaataaaatttctttgaaaaacatgaatgtctttagcaacttgtgtgtatgtgttgagtgtgtgtgtgtagaattaaaatgttatgtacctatttaacaattctagtcacaaaattaattgctttaaataaaaagctctgccttgattaataccattagtgtagcagctaaagtattagctgaactgggatctgtatggcaaaatgggagtccatttaaacatacttgtgggaatttaaagacatttacttggggtactaatgacttcaattaaggtagaacacattacttaaaccaagcaaatgatcagcctctgcatatagaagtgtgaagagggccttaattaatttactaattgcacttctcatcttaagcagtgccattgatttggatctgttagtggtttagttgctgttttctctaaccaagcgtggcattccttattggagataggaagaaaggggtgctagggatatgtaaccagtcctgaagattggcagatgcctgtctactttaagtgactttccggtccaaaatgttgccctaacacttgttgagattcctaaaatttccaagggtcactccaataaagtcctcttataaaacacaatcatgaggctgggtgtggtggctcatgcctgtaatcccagcactttgggaggccgaggcaggcagatcatgaggttaagagttcgagaccagcctcaccaacatggtgaaaccccatctctactaaaaatacaaaaaaaaaaaaaaatagctgagcatggtggtgcacacctctaatcccagctactcaggaggctgaggcaggataatcacttgaacctgggaggtggaggttgcagtgaactgagatcacgctattgcactccagcatgggcgacagagcaagcctccatctcaaaaaaaaaaaaaaacaaaacaacaattatgtttcttaaaagtactgaaattggcaagtttttagcaccccccccccccccccagtatattaacttactgtttcagtgataggcatatggtctgagcagaaggttatctctattctctctttctctctgatgcaaaggagggcctgggggataagggctgatggaagatgagggtggaaaggaagactcagggcaaaggtgatgctgtccagggagggtatatcaatctggggaacaatagggcagacaggatttagtactagttttgtttcaatgagtttcactttctttgaatgacattccattaagacatggagtagatttttcatcatcattgtgaataagcaatggaatttgctaatgtgagaaattgtgaaattcctttttgtagagattctggcagaatagataacttctctctttctgggccgttccttctggaagaaaccctgaggaaagagtgtccaagttcatgggttggtcaccaggggtcgccagaagaatcgaaagggcttctgaggcaaagccatagttgcttcttgtgctccaataaagggcccaggtttgtgggacccgcgggccgaccctcttctgttgctagggagacttctcacttaagtatttaggattcctttgttctttctttaatatttagaacttttttgtccgttcccttttaatcatcagttcttgctgcaggactttgacctttaagtcattagtagaggttttattttcttcttaaatatgtagtatgagggaattactcatattttagatctcagctcaaatgttaccctaccaccagaggccttctttaagtacttaatctagtgtctctccattcctctttcatatcactcatttatttagttgcttgtttactgtcttcccacaccagcagaaaaatcatcagagctgacacttaaatagatgtgccaggcactgttctcagtgctgtgcatatatcgactctaaaactgcatgaaaaccttaggagacagacattaatagtatccatattttcaatcagaggacgctgaaacacagaggagttaagtaacttgcccaaggtcacagagctacaaaatagcatagctggaattcaaaccttggcattctggctccagaatccatgctcgtaactataaagtattctgcctgctcatgggtaggagttggtctgcatccacagccttagacaatccctgtgagtagttggcgttgtatgttaaatgaattaatacattgtggtaaattcgtagagtgcatactgttgagcaaaataatgatatgtattgatataaagagatcttcacaacatattgttaagtgaataagcatatatagagtatagcctggttctatttttggaaaaaaaacgtgtgtatgtatattgcatatataatagctataggatatgtctatatgtgtatgtgtagaggaggaccatagagaaaaatctggaagggtaaacataagcatctccatgatcatctctaggaagtagaatttgtcggggaagaggggctgttaaaaataccttcactgaagaaaaaaaaaaacctttagttaagaataagtactgtttttataatagaaaaagttttaagaaaaattttaaagctttttttgttttgagacggagtctcgctctgtcgcccaggctggagtgcagtggcgctattttggctcactgcaagctccgcctcccgggttcacgccattcttctgcctcagcctcccaagtaactgggactacaggcgcccgccaccacgcccagctaattttttgtatttagagacggggtttcaccgtgttagcaaggatggtttcgatctcctgacctcgtgatccacccgcctcagcctcccaaagtgctgggattataggcatgagccaccgcgcccagccacattttaaagcttttgaaaaaaataaatgcattaattgtcttgcttcatacactcttgaattacaacttcaatatggtaaatgtttttaaattcctgaattttgtaatgctgtaaatgaactaaagtggtcatttcttcattcggtcttaagtattgcaatgtggttttgttcaggaagtcttttattctttccaaagttgagagttggctaaaggctgcattctcacaattgacagctgaatatatcaccctaaggattgtcacataataacctcatgccattactgtggacataattaatattatactgcatatcatgacatttgatgccatattatattacaaaagtctgcatgctgtgacacaactgactcttggggttttggcattgaacacatatacttttattttccagatctgacttttatgttttattacagataagggtgacattagttcacaggttggttggcccatcaaagtagaaagatgtatgtgtgggcttttctttaaaaacaggcttcttccagggttattgagcctcattcacctcctccaggaaagtaaatcaggagcaaggtcagctgaggctggaggtgtgtacacagatcttgttatttaagcattccaagaatgcagtgtcctgtgcttcaaagttgcataataaagatatttggcactgaggtgtttgacttgactttgtagtgtgggctctcagggtcaggctatttttctgagtccagaggtccggttcattgtgccaggtcacaggaagggacatggaaggccaagggaggatagggtggaggataggggaggacaggctggagaccagaggcctgagatatttagagggcaaactctccatccaccttcagacccttggcgccgcctgcacattagaaccacctgggagcttttgagaaagactgatgaggcctcctccccacagaccaatggaattggaatctctgggatttgggcctaggcagtagtataaaaatactactctccaaaagagaaaagctctccaaaatgttttaatgagcacattgcagcttctgggagttcacatgtagtttaggaaggaagtggggctggatatccgctggaatcagttggactcgcagcatctcacactccctgggaggctgggaagagcaggggctaccttccacccagatcccattgtttttctacctctcatatgtgtaatttgctcctactgctgagtgaatacaagtggaaggcagtactggtgagtggatctgagaggagataaaaatcacttatttaaacaaaacacagctccacaggcaggttggggcagagctggttatttttattcagcacattggagtttacagcatcatttcatgtacatttgctcctcagagccttcaggcaatcctgtgaggcaggcattatggtcatttgacagacgaggaaactgagggccaggatggcacagctgttatgtggccaactggaaccacagcctgtctggctcccaattccacggctcactctgcttccaagcagcagcttaaaaaggctgtcattgattttcattttttctgctttgacttattattattattatttgagacagaatcttgttctgttgcccaggctgaagtgtagtggcatgatctcggctcactgcaacctctgcctcccaggttcaggtgattctcctgcctcagcctctaaagtagctaggattacaggcatctgccaccatgcccagctaatttttgtatttttagtagagatgcggtttcaccatattggccaggctggtctcgaactcctgacctcaggtgatcttgctgcctcggcctcccaaagtgctgggatcataggcatgcgccaccatacccagcctctgctttgacttataaaacaaaaccctcattctgttgacttgttcatagacatttgaacacttgaggcagggggaataactagtaaaactgatcagggaagttgtgggctacaggagcgagaataaaaccaccacacagcccactttcctattctgtcatttacagatagattgtgttcaagccatctacaaattcctcgtgattatctattatagcaatagctaatatttggagaacacatactatacagctgaggtttatgaaaaggaattcatttaatcctcccagcaagcatacagtgtagctactattattgatcttttttcaatttttattttatttattattattattatttttttgagacggagtttcactcttgttgcccaggctggagtgcaatggcgcaatcttggctcaccgcaatgaccgcctcctgggttcaagcgattctcctgccttagcctcccaagtagctggtattacagacacgtgccactaggcccagctaatttttttgtatttttagtagagatggggtttctccatgttggtcaggctggtctcgaactcttgacctctggtgatccgcccgcctcgacctcccaaagtgctgggattacaggcacgagccaccgtgcctggcctattgatcccatttttataggtggggaaactgagatccagagagcttaggcaacttgccaaaagttacacactggtgggtagtaaagcctagatttgaattcaaacagtttggggcaagagcttccatgcttatttgttatataataccgcgctgacccctggagcttcaggctgctcatcagaggcctcagtcggactcttggcttctaccatttctacctgtttccttagtcataataatcatttatatttattgtgcttttatcatacattaggcattgttcgaagggctttaattatgttgcttaatttgttaacactcaagaatgagcccgagaggtggcgcctcataggaggggtgtgccccagctcatggccattcttcccagcacctatcttgtagcaggtccccctgggcccctttccaaagccgtgaaggactctatcaggctcttggtgactgggaaagttcctctgtgccctctgtggccatggttagaactctgctcagctcttcctgcaggtcttggcggtggcatcccagtcaccttctcttgagtcagtcttgccttctgcctcagccttctcccgccatccaggtcaatggaacgcatccactcagaccttccaacaacaccttgatttgtctgtatagccaggccaagtcagaggtggtgggattttattctgggctgaagccaggggatccttgctgactaaccatccaacgagccatgccatcatgcaagggcccactgttaggtcctgctagaagccaagcaggggagccaagtagagctttttcaggtggttctgggggattcgcctggcgactgtgccttcctccctttctaagtctgttctggtgagagggtttcccttgtcatttcccttgtgcacagctctgctgtctggctctgctcctggctggatccttctcagctttcagggctcagggcagcgctcagacctcattgaagccttcgctaatcaccttctccttttcagcctccaatgactcttaaatcacccatatttccttttcacactctccaatcattgtctttaattatttatttatttgagacagagtttcactcttgttgcccaggcttgagtacagtggtgctatctcagctcactgcaacctctgcctccctggttcaagggattcttctgcctcagcctcccaagtagctgggattacaggtacccgccatcacgcccagctaattttttgtatttttagtggagatggggttttgccatgttggtcaggctagtcttgaactcccgaactaaggtgatccacccgccttggcctcccaaagtgctgggattacaggcatgagtcaccgctcccagccttgtctttatttcttacttactgcctatattgcccatgcaattctaagttccaagaggacatgcgttttcttcttcactcagtgttctgtgtacttagctcccggcgctatgcctggcccataatgggtgctcaataaatacacattgaatgaaatagttgaaaaggtctctgtcattgaaggtgatggtattgacactacggccagtagctcattttcaacatcaccgccctgccaatacccttttctagtttatgtctcccacatctcctaaataaatctgtaccttgttcagggttttgtcgttgttatttgcgttggctaaaggcccctggggctgtctgctcctcctcatttttccaccatgttgaatgaagttgtcctggtccctatggacacattctttttttttttttttttttttttttgagacagagtctcgctctgtcacccaggctggagtgcagtggtgcaatcttggctcactgcaacctccgtctccagggtttgagcgagtctcctgtctctgcctcccaagtagctcggattacaggcatgtgccaccacgcctggctaactttttgtatttttagtagagacagggtttcactatgttggccaggctggtcttgaactcctgaccccaggtgatctgcctgcctcggcctcccaaagtgctgggattacaggcgtgagccaccgcgaccagctgtgaacacgttcttagtgagtaaaatcagaaaggcgtttgggctctcagtgcagaagggaaggtgtcactgagaatggattctttgttgtgcctctgttgggaatatgtgtgttaaatggaagagtcccaaattttagtttaaacagctaaaaatatataaccatgccccaggcagtatgctagatgtctggcagcatgcacaagccaagcatctacatttaaggagctttctgtctcttgttgggaaaagacttgactgcatgataagaagacaccagcatatgaggcacagcctcattcaaagaaccaaagatgatcagtactttgctcatagtggagagtggttactgaggtctggggaggttttgtaggatttagtcacagccctgtaacacagagaggatttgggtaagtttgcttgtgtgtgttctgtagccttaagtgagtgttctgtgtggtcactggttttactgtttcctctagatacagccagaagatgccccagtagttctctggctacagggtgggccgggaggttcatccatgtttggactctttgtggaacatgggccttatgttgtcacaagtaacatgacctgtaagtatcccttgcactgtatttcctatagaatctttcatctgagcctcatacctgctccaaaactaatttagagtaaacactgaaccactatgaatagcttaaccgttccagattatcaaaacacaactttctggcaatatccatccgagaaggaggagcctcggggtgagtgtcctgactgggctgctttctcccttgaaatttgggtgaaaagttctaatccgctttcttgcagtctgctgctgactcaagcattctgggtttgcaaaacagttggtatttattactatttgggacagctctttgcagtggactaatgggtggaattatattcttaattactcacatgaactaaacactttatggttcagtcacactcattatctgataacttggaagcaagacgctattcccggtgggggctgaggcggaggaaggataaagaaagagcaacatctggctgtcactaagtttaccttcatctcattttgtttttttttttttttaattttgtttacttcccctgggtcagaatttggagtgtgagccagtttgtgactcagtataaaggcttatgtgccagttttgttgaagtagttctgttcaagagatggagcattaaggatgattgatttaattggacatatggatattattgcagaggtggttggtgggtgttttttcatgaaccagctttgttccaagcttttgctgggttttgtttccaagctttatctcaggtgtagaaacactctgggctgggggaaagtaaaggagaggagtggggagggtaaaggtgcaggtgcctgttccccaccatgagagtgtgcagcactgttagagggtacgccaacagctcatgaggaccgtggggtgtgttgggcttctgaccaccatgaggcctcggtggaatgcttgtccacgactctatctcacccctcttctttgttttcacagtgcgtgacagagacttcccctggaccacaacgctctccatgctttacattgacaatccagtaagtccgggatgaccctgtgagctgtcagtgctggcgtctcctgtcttttattttttcctttttattaagtacatttaaaaaatagatttcgtttttccttttgaaaatagaatttaatctgtaaaattaaaaccattttgagatttagtttttctgttaacatgtataatcatatcggagtttggcaattttccttgctgccttctctcatttcctcattttttttttttctattgagatggagtctcgctctgtcgcccaggctggcagctcactgcaacctccgcctccccggttcaacctggttctcctgcctcagcctcccaagtagctgggattacaggcgtgtgccaccacacctggctgatttttgtatttttagtagagatgggagcgtggggtggggggtgttcaccatgttagccagtctggtctcaaactcctgaccttaggtgatccacctgccttggcctcccaaaatgataggattacaggtgtgagccaccacgcctggcccatttccttatttttaatcctatgagatgtcctgttcactgaattaggtaacccaggaggaggaattcatttcttttcactaacagtttgggttccttatatcacaggttattatatagtgtcagaacttgtaatctttcacaatcgtctaatctttcacatagagttatagatataaaaagtcaaaatgggtctccactttttttttttaatttttatttttttgagatgaatctcactctgtcacccagactggagtgcagttgcaccatctcagctcactgcaacctccacttcccaggttgaagcaattctcctgcctcagcctcctgaatagctgggattacagacttgcgccaccatgcctggctaacttttgtatttttagtagagatgggatttcaccatgttggccaggctggtcttgaactcctgacctcaagtgatccgcccacctcagcctcccaaagtgctgggattataggcatgagctactgctcttggcctccttcacttgttaagacaagcaacatgcttcatctctggacaaaaagtgatactctccttggggaggtcttctgatattggttctattaaggtgcaaaataggagagaaacttagggtcagcttctacagatttggagtatctttgccctcttaactaaaatctttaacttctctcacttttcagatggtccaaaagaacacaaataaaagcggaaaaaaatgtcaacatgctctttcccccaccttgttttgtcagccttccattttcctcatccataactgtgtatttaagtaaaagatgaattaaacatccttgggtgtttggaaaacaaaaacacaaaaatctttataccagatagggagtgcattccttatgcaaattgttgacataaaaatagtagcttcttcttttgaatttgcagttcagtttcttttgaatttgcagttcagttgtctgtgaacttctaggttctaataagaaaatattagtttaaaattagtcttaattatgttaaaactccttacctactgaagatgaaatggcttaatggccatatttcttgcaaataaagacaagaagggggaggaggaggaggaagaagaagaagaggaagacaatgtacaactacctttttcttcagcctaaagagtttctttctttttttttttttttttttttggagacggagtctcgcttggtcacccaggctggaatgcagtggcatgatctcagctcactgcaatctccgcctcctgggctcaggtgattcttatgcctcagcctcctgagtagctgggattacaggtgcccgccatcatgcccggctaattttcgtatttttagtagaaacggggtttcgccaggctggtctcaaactcctgacctcaggtgttccgcccgcctcagcctcccaaagtgctgggattacagaagtgagccactgcgccaaccaagagtttcttcttggcaggacagagccatgcactctccaggtttcagagaggagacaactttggatcttttgatactgtagcaggggatggaaaagatgaatccttcttccttaaatcaacatctggcagggtctccactgaggcacaggacagctcagccactgaccccagggcaaagctctgtgttgctgttttatttgggctttagggggtggagagaataggtggcacctagcatcctcctgggaggagggctaaaggcataggggggcaacggcaaaaatctgaagtctgagcttggcctttggaacaaggtcaccttccagtgtgggacctctctgcaggtccctaaggcatgtgtttctctgtgtttatacctgcgtgtttatttctcctgcaggtgggcacaggcttcagttttactgatgatacccacggatatgcagtcaatgaggacgatgtagcacgggatttatacaggtaaaatgctcctgctttctcttggctttcctaagaccaaacatttttctatctcaataggaaaattattctagtgttggaatttttattgactgagccttatagtccaattcctgaagataatttaaggatattttcacatccacacacacagagcagaatttttcaattaaagattattttttaaacctttcaaccagacatctgaaaggtttctacttgttttccaaatttgtatttaactttgcatttgcagggagacaacatcttttcagatatttgtttgtttctcaggattcttcttttcgtggcttttggatgcaattttttactttttgcttctatttcatgacttttccaggctgaaaacttagcttgttagtctctagtattctctcttcttcttatgaaagttttgttttgcttaaaaaaaaaaaaaaaaggaaaaatgtaaagttgtaagtctggccaaacagtgtccatataatttctcccttttttcactcatattaatcattgctatttttagcatttttaaaaaaaagcaagtgacctttcttatttggtcagatttttccagtctacaaattattactagagaccaagtcctagattctttctggtcactagggcaccgctttatgtattataataatttactaaaagaaccctagtggccagaaggagttaactagctccctaccccacacctccaccaagcactctgttaattactaccaatcctcaaagcgaaagtgcatctaataggagtcagagtttgctgatctctgacaaaagctttccgttttacttttctttctctctgaggcagataggtggccggggggagagaagaaagaactacttccaagcccctttcccaaagatctctccctctgcccacccagaaaagaatatggctgttgtcttctccacttttgtttgtttttcacatgttccatgattcgatcacttctattcagtttctagggggatgcccagggccccacacttctgcttccacatacagtggggtcctagggacatatttgccaagatgctgacggggtgttccccccagcacctcctccccttccctccacagacgtaacggacggcagtcctcctcacaggcttcttcagagccagggccagggctctcttggcactgtgtgctctctttcttcagattagaaacctactccccgcccccacctcccatccctctttggtttaaatccaaacaagctcagtggttaactagcaaacaccctgagggcagaggttctgtattgaagagatgcatcgggccccctctaagacagagcatcactgccaagccgtttctgtctttccttcccctcccccaaagacagttacagcttccagttgcccctccatatggggatgtcgactgctgacatgtggtccatctcctctttcctgacatgtaaagggaacctatttcaaagcatctattgtttatagctgttgtagttctttttgcttcgggctcttagaactggaaaatagctaatcaagggtggtgcagaaaactgatttcagctgtttcctttatagtttacactattcatttccctttgtgaccacattcttctctccagctctccagatgggtgtttggaataagagggtcgcttcaaaacctgcaaatgggctactacaggtttaaagagtggagctttcattttctccctttgaaaaccaactttcttttttcagaaaatctcattctttttgactattaatagtgcatggctgtaaggagacatttaccgttcacagttttgctgcttttgtgtttggaaataaaactttttcacgaacaagatgttaaaatactctcccacttttcttatttggaatatgctatttagtcacaatgcctctctggtttaaaacaaattatgaaatgtattaactttgatttggagtacactagctggtgccaatctccttctgccattgtttaccaattgcctattatgtgccagctgctgttcttggtgctggtgagacagtagtaagcagtcctcaaaccccctgccctcctggtgctcagtctagtggtggacctatagttattttcttagcagccaaatggaagtgctgctatagttttctcctacatgttggtttgcaatgggaaatgatatgtagtgttgctaaacaaagcttcatagcaatgcagctaggaagcaggcttcctatattaaatgagaaaactctgtgtcctgtgccaggtggagaggatcatggctcagccttgctagatgtagagtgaatgcagaagaggctcccttcacgggttccaacagagcagcactgccaggattcctgttgctgagcttgtatcggtccagtgcaaggcagatgagccccaaagtggggcttagcctgtgaggggttttggatttgcccaggaaagaattcaagggtggccaggtgtggtggctcacacctgtaatcccagcactttgggaggccgaggcaggcagatcacctgaggtcaggagttccagaccagcctgaccaacatggagaaaccccatctctactaaaaatagaaaaattagctgggcttggtggtgcatgcctgtaatcccagctacttgggaggctgaggcaggagaatcacttgaacctgggaggcagaggttgtggtgagccgagatcacaccactgcactgcagcctgggcaacaagagcgaaactccatctcaattaaaaaaaaaaaaaaagaattcaatggtgagatggaggtagaagaaaatagctttattgaaggggcagtgttacaactccgtgtctgctcctgcagggctactgcctagtccgagtagcagcttagggcaattttgcagttgtatttaaacccacttttaattacatgcagattaagggttggttcatgcagaattttctagggaatggatggtagcttttgagtctttgggtcattgccatggaaaggggtggtaacgcctgggtgttgccatcacaatggtaaactgacatggcccactgataggcatgtcttatggaaagctgcttccgcccaggccctgtcttagctagtcctcaatttgatccagtgtccaagccctacctttgtagttgagtcccacctcttacctcaagtccactgccagtgactgtaggtacactttgcttggcttttttggcatggaacttttgcttagattatctgaaactcgattatcctgaatgttgcttgtgtttatgattatgcttctgactctattagaactgaccagattccagtgctgtctttgggtctacaatgcatgatcatgtccactcaccttttctgccctgcatccacccaatctctgtttaaaaacttatctgaggaataattttctcctagtcattcttccttgcaatctgtttctctttttggtcctttaaggtacctttctgcgagcagagagcccttaactaaaattctgtttatgagacaagtccttagcacaatgccagcaaggtggccaaatggaatcaccaagaagaagcatgcttcttgtgccatgtagctcttgtacctgaataaatgcatggagtgtgcacttgtgaacacacatgcttatgtattattattattattgagacggagtctcactatgtcgccaggctggagtgcagtggcgtgatctcggctcactgccacctctgcctcccaggttcaagcaattctcctgcctcagcctcctgagtagctgggactacaggcgcccaccaccacacccagataatttttgtatttttagtagaaacggggtttcaccacgttggccagaatggtctcaatctcttgacctcgtgatctgcccgcctcggcctcccacaggtgtgagccaccgcgcccggccacttatgtattatatatatgtttagcagatctgcttctaaaatttgtaatttcatgtgggcttgattctagattctattttctagaaaatgctcaccatgtaataagaagagttcttgactaaaatacagttaaatgagcaaatggcatatgtaaatctaatttactaaatttacttttttcattcttcactctcttttaagaaacaggagtgctaccacgctactaagtgcttgcttaaaaaaaaatagccagttttttggctgtgaaataaaaactgaaattgaaactcgatgataacttcctcaagtggaacttgagctggagaatcctgccattttcgagatagaagtaacctgggagattatctctgaccaagattatcagataaaacacaaaatacccagttaaatttgaatttcaggtaaacaacaaataaaattttaatgtaagtatattccatgcaatatttgggacatacttatactaagccattatttgttatctgaaattcaaaattaagccatgtcttatgttttcatttgctaaatccagcaaccctaatgactctccagcaaatactacaaggaaataagctttaagctaaagccaaaggcttaattgagatttactatgctaaattatctcctgccattccaacaagcaggaagagagaaaaggaagtagattttagcctgaaggttggagagggaagggtggagaatgaatgcctatttttatctgcactctaaagccagcttattgccagcacaaacatagaagctataaaatgcagcttctcagatttagttgctacaaaggccactataaataatgaatacagaaatacaccgaaactctacagtagtgtttcatggtgaatttttatgcagcctttgaaaattaaatatagctaggatcatggtgattgtaatgacccaattttgcctctttgtaacccttgaacttcgccatcctcctgggttttcagagcctccttgcctttcatcttcctggatggttcatggcttttagtctctcagcaggaaactgggccaacaacctcccctagcttcgcaggcactgcagtctgggtcaaaacactcatagagctactgagtttcacaagtttttgttttcctttttttgaaatattttgttcaggtaaagaatcatttaaaaatccactgtcttcttgcttattatgaaatcactccttgagtctgttaaaatctatttcatcactgaagtggctattggcattctttttttttttttttttttttgagacagagtcttactctgttgcccaggctggagtgcaatggcgcaatctcagctcactgcaacctcagcctccctggttgaagtgattcttctgtctcagcctcctgagtagctgggactacaggcgcgcaccaccatgcctggctaatttttgtatttttagtagagatggggtttcactatgttggctaggctggtctcgaactcctgacctcgttatccgcccaccttagcctcccaaagtcctggtattataggcatgagccaccgccctggccggctgttagcattctttagtaaatgtgtttttcttttttttagcccagagcctactgtacatttatttcaatatctgtgaccatttgctgtttttcttttaaattatagtcatcttacagtttttctgttctttggttattaaaatgtggcattcttggagctccatcagaaatgttcagagtcccccacagtgggggttggtaagcaactaagacttcccttacttcaccacaaacccgggctaatgggatcataaagtttgcagaactacctccaagaattgctacgtaacatgtgaaacctgtattatttgctcaaggtgccctcaacagttagatgatccaaactggtatatcagtaatttggaaacatgcccagagtattgatgtccacttgtccaaacttcttattatcacaaagtaagcccacatgtattgtgtaaataaaatgtcctacaggagctcatagcagagtggtatcttatttcaagtgtgaaacctattgccaaagagttagatttgatatcctagcatgaagagatcctgaatcatttttctgattaatttgtgttgttcttgttcttctttttgcagtgcactaattcagtttttccagatatttcctgaatataaaaataatgacttttatgtcactggggaggtaagtagaagtcacgtttccttgtgtgcttcaaacatcaccagaactgacatatattatgagtgtagtttgttcatttaaaatctatatatgtatatacatgtacacatacatatcaatattgattcagcctttattcaaaattctcccaattatcaaaatgcccttcatatatatatatatttttttttagttggagttttgctcttgttgccaagggctggagtgcagtggcgtgatctcggctcactgcaacctgcgcctcctgggttcaagcaattctcctgcctcagcctcctgagtagctgagattacaggcgcctgccaccatgcacggctaatttttgtatttttagtagagatggggtttcaccatgttggccaggctggtcttgaactcctgacctcatgatctgcccgcctcggcctcccaaagtgctgggattacaggcatgagccaccatgcccagccctttcataacattttttaaatcccagggcccaatgcatgctcacatattaccatgggtgcactaggtaggctcagtcatctgccttgtttgttgtcctcatcattcatgatgatgatttgaagagtccaggccaggtgctttgtagaatgtcccattttctgaatttgtctgattttttcctcagtgcttaggttatgtcaaaacatttgagcaagatcattacatagatggtgtgtactttctggtgtgtcacatcaggaggcacatgaagtcagtttgtcccactgttggtgatgctaaactggatcactgcgtcaaggtggtgtctgccagatcttgccattgtgaaggcacctgtttatgtttgtaattaactcataattaaagaccattcaaacactgtttcctcaaaaaatgccatccagtagttttagcatccactgatctctgtctgaatcagttattacactgggggtgataaaatggtgatttttctaatgtatctttctgtggatatcacctggcattcttccatagggaagatttttcccttttcctcctattacttacatttaaaaatagtactgtggattcacagattgttatttctatttgatctgttaaaatttgttttttatttttgatgtttacattgctttaaatttggtcactgggaaccccttcagttggctcctgtgcccttttgaccggtccccattagcctccaagcatgtccttgctttttgacacaaaggtgtgttccagaagcatcttgtacttcttgtactttccctgccctagccttggaatcagtcagttcttcacagaatgctgtttctttttcctggggaatggcatttaaaaagcaagtgctaagcactaagtggcccattgctgctgggatgtcattgcttttagacagtctgtgggcagagctaggaaacaaaatgacttcatactgatacccataattctaattccataccacaaggttctcttctcttttctctgttctgtatttttttaccccttctcccacattgagggctgtggttcctaatggcatcagtgtgtttcctcttttgattgcttttacaatatgcccaatatggtttcagaattactacatgtgtaccattaccaacaagaaacatcaaaattacttttaatattttttgctgcaatgatttttatccttaaattgtatctcactacacacctataatcaaagtactgtgtttaaaagttaaaagaattctattttttaagggagattatgttaaaatttaatacacagttacattcatttgtctatgttggtttcagttttagggtttgcttttttcatcctttttaagattattttaaaaatgtgtaccagccaatcatttgagaacacaggtgcagttctaggtgctaggaacataatggtgaataacactgaaaaacaacaaaaaaatccatgccctacattctagagaggtaggcagtgataactaaaatatgtgctaggtaccaccatcaggcagggacaagtgtcatgaaaggatgcagtagggcaagggctggagagtgaaggaggtgctattttggataagattgtctgacgagataatgagcagaaccctgaatgatgtggtggggtaatttctgcagtatctgtaagaagagctttcctggcagaaggaacaatgaatgcaaagactctccagtggggacaggcttggcaggttcaaggaaaagcacagagctgctgtggtaggagctgagcagaaagaggccagtggatcctgcagggcccggctgcctgtggcagagtttggactttattctaacggtaatgggaaaccattgagggtccagtgttcactgaaagaacatttagaattgaattcaactgagcacagatatattgagtatctgctatgtttgaggcactggacaaatattaggaattcagtgatttatgagatattgactctgccctaaatctgaaggtcgaataattacaatacagatgaaaggcacaattagagaaatattatctctgatccacgagtcttgaaaaaagaaaaaaaaaggaaaaaattagacaagtaactgtaaagactaatagccccaggaaaggtaccagtagctacctcagtgtgggatcctcaggaaaggccaagcagaggaggtgacaattaaaccgggttttgaaggataaataagggtgtgttagttaaggctcttggttgcaagtgacagaaaccctatttaaagcagctttagtgaaacagggcattgattgatttaacgtcaggtgtggctggacctgggtgcccttactttgtcatcaggattctgcctgtcattctttcctgatctatgtacttggctttgtacttttctggtttcattctcaggcaagttcttttcatgtggtactcctgcttctccatccatcccagggcaggtatagcctatccattcaacttccctttcccagtaattccagccctccagattcctgaatctcagatgatccacttggatcccatgcctatcctagaaccaccagctggacccaggtggttggaatatacaaattggccagaatggtgcctgaggcccactccacaccctgggagggtagggaccaggatggggggccctcacactctgaatcataaggcctgagagttggaaatgagtggtctccagaggaagatccaagtgatgatgccagaggaagggctgtaaagatgctggcaagcacatctgcaatgtccaccttcagcgagggaaagagaaaaatggtccgagtttttccatgggaatggcaagtaactggaactagcaacttctctctttcttctctttataagctatttggaagggatgttctgactgattagcatactacactttaggtttttttaagccagttatgcagtcaggacaacttagaacctctcctggtaatttctgcctgttccttgtcttttaaccaatttcagagccaggttagggaagtgaataggaagtgacactcccattatttggcaacaaccctggaaaatgcccattctccacctcccacagaagagtggtctacttcgtgtgtaatgccttgtcttggaaataatgtggtgatgttgttaaccatgatgttgatgttgatacaaaccatgatgtttggcaaaactgccaaatcccagatgaaaaatttgacttggttatttcacatctgccttgtggttttatgcatataatttcctaatgtgtgtagaaaaggacagttttctttttaccttccttgctgccaggatgaatacttttaaggaaacctgtgccttctgagtggtgaaggaagatgtgaggtagagatgccattgtcaggagatatcatcctccccgaactacatgggatacgttcagtctgggggcactgctcttttcagaagaaaaaacactaaataatgatgccttgatggtttattatgaatattagaatattatgaatatttattcagtctagtttgtcccatctgggttgtcttctgttttaaggccatgtggcagaaaagagaagtggaaggcgttctggattaatcatttggagacctgggattcagggctggctttgctcctccctggatgatttcagaaaagtctttcagcctccctgggcctctgcttttcatctaacaatcagatgagttgttaaactagatcacttccagggatattttgctttactagaaagttcaaattcagttatctagactcactctttaagtatctgtatgtaattgcagttttaacgtaatacctacccattttccctctcgctgctgccaccacacaaaaaaaaattgttctagatttttcaagaaagaaaattcctttctcttctaaactcttaattttctcacactcttaggaaagctgaatagtgctgctgagtttgtagagccatcttcaaaaaataaatgcacaaattcagaaatggttttctgcttttcaatgtaaatgcaccagacctaaatatcttcacatttgtgtgctatgaatgagaggagcctgatgctcaaggggtctggagcagctgttcagaaccttgatttggtgtgaagcagtctggaaataataatagtacctactgcatagggttgttttgagcatttaattagataaccctcctcagatattagcatagtgactggctgtggtgagtacccaacacatgatgactattattaccattcatgctgaaaagctgggctaatatattatgactcccaagcatacagcctaatgcctggagacaagagctgaagtgttaatagaagctccgctaactcattgctgggatatggcatttccccctctactctgtgtctattattttgaaatcatttttaaaagcaatagttactttgtctaaaaaaaaatggagcttagcagttgacattagaagttgtgcttgttttttatatggacagcagcaaaatgtgtcaggacccaccccaggctccctgcctcaccgtgtggacgatggtgtggccacaccagagaaagtggcgtgggcctgccctcagtgcaaaggaaaggggagaagctgctttgtcttcttcctcctcctcttcatttctgcccagaacaccaactggaattaattttctctaaaaagagacaaatgtgtctgtaaatcaccctcctcaaggcatgaaaaaaacatacttcaaaaagagaaataagctgtgtttaattcccataattaactttctttataagtgttatcctttctgagccagtagctattagtgagattgcccttgttcttgaggcacggacacatttagcatcctctcaattgtacatgagcccaggtagaagttaaagcaaaacagccctcacgggaaggcaggtaggtgacaggatcagggggaccgcccattgttctctgagcctgtggctttatgtgccgctcaagggaaagagtcagtgcacgtgggaggttgtggcagtggatgggaacgcttccaaactagcagggcatgtggttaaaacagaacatctcttctccatcagcaaaaacgggcagactctctttataaacagttttgcaaccataatttatttgagaacccaatagagacaaaactttgaagctatttaaaaatgaattagggagcttaatgggacactttatcttcatctgcatgggtgaagtccctgttggaagtacagtgtctgacaacctttattgaaatcatcatggcccattgggttaggtggcaagctcccagtatgcgagagccatgtttgtttcttattcaatactaagcacggtgcttaatgaatattatagaatggagttcatgcatggctgcctttagataaaataaaaatattgatatttatttcctgcatcttttcacctacttttttttttttttttttttgagacaaagtgtcactctgatgcctaagctggagtgcagcattgccatctcagctcactgcaccctccaattcccgggttcaggtgattctcctgcctcagcctcccgagtagctgggattacaggcacgtgccaccatgcccgcctaatttttgtatttttagtagagatggggtttcactatgttggacaggctggccttgaactcctgactgggtgatctgcctacctcagtctcccaaagtgctgagattacagatgtaagccactgcgcccagcccctttctttttttaaaatttttattttaggtttgggtgtacatgtgaaggtttgttacatagacaaacacgtgtcataggggtttgttgtacatattattacatcacccaggtattaagctcagtacccaatagtgatcttttctgctcctctcgcctccctttcattgcccttctctccctgtactatgtcccaggccctggggactctcctttggcctccgttgttttccagggccatcttcccacctcagccatcctctcctcagtctattgtgcacagcttctatttctccatgcttcttccatctgtatcatgattgttctgtttctgtcccccattctgacttgttgtcaactcattgttccatagaaaggatctgataaattaaacccaatagggtggactctcaacatgtttgcatttgagtagagagcagagcctacctgatgggtagatatttgtaatagggtaatttcaagcactaacatgcaaacagaagggtggcaaccaaggtggggtgggagagcgattctagaagtaggcttataattattagcattctatgtaagcctgtaccatcatcctgttagcctgggcttgggatcatgtaatttgatggctagaagtgatacttcaagaacatctagttcatgtattttatctgtagattttactagagaatatttattgagaatggactgtatggtagacatcatgctaagcactgttttatgcattacctcgtttaatcctaacagctgccttatgaaataggtgctatgattattcttcccattttacaggtgaggtgaccgaggcttagtgaggttaggtatgccttaccaaggtcacccagccagaaagtggaggagccagcattggaacctaagcagtcagactccagggcctgaagatggtggtgaagaaatgagctagtggtgcagccttgttcaccaaaatgcttgttcaccaaactgggtgctctcaccttgaacttgcactgtctctaggacctgcttcagattcactttgtgtctgaaggggagtcaaacatccccttccatattttatgctgaatctctaaggttattaaccttacacaaacagaaaagaagttctctagcttcttgaatgtctctgtctttctggccaagactgttttaatcataaagacttggctttgatcattaagttttatagagtaagtggaagtttcaagtgatataaggacttgaagtctttggaatgcaattatttctcaaggcttggaacttgctgaattttattagatagcattcaagctgttttaactcttgaacctatgacaaatctctattttcagttatgttcatctgcacttgccaatattttctttttgaattgaaaatggatttgtgactatttaatgattttaatattacaaaaatcagggtttaagctgcaaccgaagaactgaacaagggcatatggaaatgtttgcaagttggatctctggcttttggacagcatatccaaatcaaatcgatacatatgtactgaggttgcacagaaaagaatatgagtaaatcagaagtcattataagctttgttggaaatgaattaccatgctggagcaggcagcatagagacataaatagtacctgattagatgagatgtttaggttgagaatgagaaatgctaagttacatccattatgcagcttcatccttctgaattgtatctacagtgagcaaacaaagattcagtttgttgactgcggcccagtgtgttcagactctttatttaaaagtcaaattaactgtagtctccattttaaacaaaagggtttattcatctcattgagtcacctggcttcacgctggatttctccaaactggcactgaactcagagtaggtgggaaaaggatgcatcttgttcacctatgcctgtcaatgatggctttttcttttttaaggagtatcttctcaatagaaaataagaatatatcatttgggaagcagcatgtatttttgcataagtttatgtgactaaaaattggctatagatcaaaatgtttttgctatatgtctatgcctgtagattttgcaagtttctttttaagcccatattaaaaaagaaatagatactttgataaagtcatattcttgttggaaggctcttttttttaattgcagcagtatggtcttgaaattagatgacgcatggtctggaaatgtctaggaagttatagcgattaccacaacactgaaattccagctttcctcattcattaattttctaaactggccattttaaggccacacttctctcttcagagaaaataatggtactgaggaagtaagattctaccctaggctagatgaagccaaggtaggtcgccctagcctagtcttgccctcatggtgcccattacaccgaggttttcaccaggttttgtggctttcctggggtgttcagtgtgtgtataaagttctctgtgaggcattgaagctgtcttcttccctctggtcttctcccataaatgggtggcagctctattgtagtctgtgcctgggatgagctggagaacaagggaatgatatgactgattccagaagggcagtgcgccttgatgccttctggggatacaaaggagctctcaccagcccagtagtgaattcttcaaagaaggattttttttagttctgtgtagctggggagagtggggttcaagcagggcagggagcttagaatgaccctcagggtcctcagtgtaccattgctgaagttgacaactccctctttccacctgccaggcaaagggtaggaactaaggcctgtggatggtgaaactttgtgtctaagtttagctgtgtctcatttcaaaagccattgctcattatcactgacaaagttctgaattttttcaccatgaaatgtgtacctagaagcaaggcagagaatgagtgtataagtgtatctattttttttttctactaaacttcagagaaatgtagtcaactgagagtagctgaaacaatagtaactgctaccatatgtgaaatttctgtaagaggacattgtttccattttaatattattctctgacactatttgttttcctctggaggagctgattgaagctggactttagctatgaaatctttttcccttccttgaaagtaaccaaatggcaggttacagtaagtaggctgtgaatgttgttgaaacataaaagaaaagagagattcacgcaaaagacacgattacaggttttctctacatccaatttcattgtgtttttacacatctggataattaaccaaacattgcattctctctatttttacaagtacaatgtgctcctcacgggatttccattaggctggaaaaaaaaatcgcaaaccaagattcaaaactactattcagctatgatgttgaggcctttttctctcctgggagaaataaaagattgagagctgaattctgagatccttctgatgtaggaggagaattggaagtttatagcctctttaagctccagcaaatacaagcatgtacaaacacaccctaatacctctggtccttcttgttggaggtgagctcgaaatatggtcaccatgggaaaaattaaccaagtaagagcagtgctggaaatcgcagcttgaagctcctttaattattagaaaggaataataagggcaccctaaaaattctgatgtgttgagtgctaacctagtttgaattctgttagatgtgttatgtttatccggctgagcttctcattcgaaggtcactgccaaatcctaaaataatatgtgttcagttagtttctggccacacttttcctctttctttttaaaattgctttggtattgctctgagcttttatgagaccagggtctgatcccatgttaggttagtgttaattcacagacctcaggggcttcattgaccagctgctgcccacactggcgaacaccatggggaggtcagagaagccacgggaccaagagttctggttgttgttgctgttttcattagaactcagaacaaaagaagcaatagttcataaaattacagaatcactgttataagcctaagggaccatttagttgatttctaatccataaggcagtcacacctaaattcttctcctgaaatatggggttctataaaatatatacaggaaaaggcaaatgaggtaaaataaaacacacttgatttattacctggttgtcttttgaagtacttaatggcggtcagagaatcattaaattgagaaataaatgattcaagaagaataaatgagtctgatcttgccaaaaaaaaaaaaactatctcaacaaggagagtgaaaataactgaaattttattacaatatttcagtgcctgttttccataaaaataattctataattgtcttctctgtgacagcctgagtcactcaaccaatggaatgattaatgaaaaaggcaatgacggatttgtcacactgacacaaagcaaggaagtgtgatagtcattagaaagttaaaaaaaaaaaaaagctaagatcatcactgtgaggttggcagatgtggactgaatattgaagaatttcattttggatatggttatagtactactcatctgttttgtttttcataaatgatcagcttagcaagcttggagtagataaacccaagatgtagttccaccttgggggacctcagacccgtggtatattccaggaccattgactgtcagtgatggcttttttttttttttttttaagaagtatcttctcaatagaaaagatttcgttgactgaaatgcaattagatatgacaaaggggagctgcagagacagccaagccagggtagaattccagccaggcatgtgaatgaaatgcacgggcccttgttttcatcactgtaaaatattggaaaacaatgtttatcttaaattggcttaaagtaggtgaggtagcctggctcatagtaatgctcaaaaactgagtgggtgttccttcttaattccctgcctggatatatcccagatacccagatacacatgatggtcactgggggaaagtgccacaaaaatgcagatgtttcagcctacgtttgtcatgactacctacctagcaacttaaagtacatgcccttccatgtcagaaagggtcaagagagatgttttattaccaggtcttataacaagaaaattggagtgataatatcactggaagataaactttttggcatttgtaccaatttctgataggggaaaagtatttagaagtaatgccagataagtcattcatttatcaagtgtgtttttatttacctattttgtgctaggcaatgtatacattatagaaattctaatctaagaaatcgtaaactttgctctatcatgtgtcagtcatggtttccataatatagttttgaaagaaattgtgacctttatgagggcaagttttgtgctttattcatttttgtgtctcctcaagtatctagtataatgcctgtattagttcattttcacgctgctgtaaaggtactacgagagagagagagagagagcatgggcaggggaaactggctcttttaaaaccatcagctctcgtgagaactccctcactatcatgagaatagcatgggggaaactgcccccatgatccaatcacctcccaccagatcccttcctcaacacataaggattacagttggagatgagatttggttggggacacagaggcaaaccatgtcaatgcctttgacagaagaattgcccaataaactatcattgaataaagactatataacaatacatttttaccagtaaaatggttactcagggaaatgtgcttttttgtcattttacagaaattgtatttgataaatgttcacttattgtcactaacaagagaatgtagcacagttagacaacaaaccaaatttcagacatatgaacacacctttatattacacaaggaagctaaaatgtacttacaagtatgaatggataaattgctttgattcaatactttacctaaataattattattgcacaagagagctgtatcaatgaggagttcttggataaattacataaatgatattgttttatcattgcttggaaggagtttaggttttggagtcggtcagctcaggtgtaattctggctctacaacttaacctctctgagcctcagtgtcctcatcttgaaatgggagtaatgattatcttcagcatatgattatggtgtggataaaataagagctttcaggggttcccagcctttgaactacagacccctggagggccttggagatgctgtgaagggtctgtgaactcacaggtatccacataatgtctctagtctgttttgaacatagatgcattgctctttttcagatgtctgtagattcattttaagattcattcattcaacaactatttattgagcactaacaaatatacgcatcagtcatagtggactcaagtaaacaaaacagacaaatgtccctgtattcacggatcttatattctagtatgggtaggagaataacagtatataagataagtaagtaaaagtttgttggagaatgataagtattaaggaaatacttaggaaagaaaaaatataggacattgagggaatttgccatatgggggcctgtgagaagagcattccaggtggagggaatggctggtccaaaggcctggcagacatgtgcctggtatgtgcaaggaatagcatggaacccaatgggctggaaaggaatgagcgagagggtggcaggggttgagggtagagaagggagcagatcatgtcagcccttatgcctttgcttttgggaagatgggaagtcattaaaggataagggcaaaagaaggaggccaatgaggagtctactgcagtcatccaggccagagatgatgtgatggagaaggggttgtgagaagacattggactctggacagattttgttagaataggtagagctgacaagcttggctgattgacttctgtggaatacgagacaaagagagatataacgaatggcaccaagattgttggcctgagcaggggagaaacagaattaacatgagatgaaagggaggctgcctcagggttggggattgggagctttattttgaacatgtgcagtttaatattagacatacaagtggagatatcaagaaggcaacttttgatggaaagaatgcaaaatgcaaaattatttgaaaaatactgctgagtcaatagtagctcttccagcacagtcttaaagtagaaccgttaccatgtttgttaggggaaatatatctacaaaatattctgaccttgaaaaaggaccttgtgctggaaaagtttggaaatagagatgagttcaagtgaaaattttagtggccaataaatattattttccttttctgcttctcctattcctttagtacatgttgatttcaaaatttgcagcattatcagattttgaaatcttaattttaaacttgagatttttttccctctaatctttgaatagagctttctggtaagagatgcctaacacatggcagaattgtgttctcccaagttattttattttggaaggaaattagaatgttcacttattacatgttcacttgtgattttttgtgcatcgaacctgttcatgtcatgtggtgctatttgagacgacaaaagaattggaagacagaggtttttgctattatggaatctataatgtggggttaagaaacagatggtatacctcatgtggaaagattgctccttcattgttattttaattagcttaagtacatttaattttactagcatccatttgtgattggccatttcaacatctgtccttctcagtcttatgcagggaaatatgtgccagccattgcacacctcatccattccctcaaccctgtgagagaggtgaagatcaacctgaacggaattgctattggagatggatattctgatcccgaatcagtaggtttctccttctgactttctattttgtctcttagggggattaaatgcctttttatcagatggaaggctcctcttagaggtctaacttttgataagggaaacaccagttgactttatgacttaaatctcctaatttttaccaaatgtttcaacgtatcaatttactgtgtcagcttacattggctgtcagtgcaaatgtgtgtgtgtttgtattgtgttgtgttctgttgtgtgtgttgtggggtgtatatgtgtgtgtgcatgtaattatcctacttggctaaccagcacaatattaacaattacaaaggattatttcaccaagcaaatgggcttccttaaggtctctttctctccctttgtcacattgatgtgtgtcttttttgtcctcagattatagggggctatgcagaattcctgtaccaaattggcttgttggatgagaagcaaaaaaagtacttccagaagcagtgccatgaatgcatagaacacatcaggaagcagaactggtttgaggcctttgaagtgagttctgggggccctgtgctgcccttgagcaattaaaaccatctggggagggagggcgggtgagcaggaacaccttggtgctcaggcatttttttgttaagaaggtatatctgttattccattggagatcgggaggcgagttgagtggcctcataatgaagaaaaggactgtctgtgttcctttgaatttactttggctatattttaagcctgagatcatcttggagtgtttatctaactgtgtctttcattaaccgttttgatttctttaaatgctgtggaggccctcaaggcagactctatcatatggaaatcagaagaaaggcaacccaggaagtagaggcatatgcttcaccatctgctctaaaccatgtagaagagttttatatccacaaacagggtttcagctgggagaaatgaccacagtgtgtaacagatgacatgtgacacacgtgtcaggaacaaagattataaagtgtagtaatttgaaactcttacaaagggccattggtatttgtgcatatcctttcattgctcccctaaaattaaacttgagaatcaataattacgttcttcactcttttctttctcagttatttaaaatgtaagaatatactaaatattaggatacaggaagttgggttttttttgtttttttttgctttttttgccaatgcagacagagccatgtgtaaacaatctccctgaggggctttttgccgtatttactatacagccatcatgtttgacatggtagtaaatgaggcaaggtctgaatttcgagggctttaatttgtttgttattagacacatattctgtaacagtatatctaatgtcgttattgttattaaagcagaaatctgatattaagtcttaagggcattgcagatcagccagttcagatcaaaataggagacatgcaaccttggagaaaagggtagaggataatacaaagttatttttcattttacaagtagggtgttgggacactatcagaaatcccccaaggcagtgaccgcccttgccgtgaattctgatagcagctagctgtgcaaatggatggagcaaagggagtcctgagccatcctacagagctccaccaggctctcctttctctgtgtcaggacactaaatgtggctgcaaagtgtggattcagaatttcttatgcaattgtaaacacaaaggaagaggggtctcctggggcacatgtaggatcatgcttccacttgcaatgacagtattttcaaggctttctgctgtggtagtcacagaggggacgaaggagtgaaacttcagtatttagaattaataccaaattttatgtggcatgagaccaatttgcaattgaaacatttgatatgtttttaaagaagcacacaggataaagcaattgtcaagagcaagagcatttgagaggcccatatttagaaaaaaagcagaaagatgactggtacataatgcagcaggctaaacacctacaggattagtgaagctgtagaaaagttcaggtgtgttgtgtattcagagataatgagaacatgacccacgaggtgagaatctctcccaaaccggatacgtcagaaaccggaaccccaagcaggtaaaacgtttgaaggcttggaatgtctttttgaccattggtcccgtatcttgagtgatgaattaaaacaagacctttgctttttcaaggaaaatagataaaatgatacttaggacagtaaacaacttgtggttgaaatgtgtttcagtgactgcaaaggaagactccaacaaatcctgaaacccaggggaatataaatgtcagaatctcaagcctaaaatgataaagcctgtttgacgctctgatcctttaaaatgatttaattaatcaaagagtagtaactcagagctggagagtactctggagataggtcatctactgtccctatgcatttacatgcacacacacacacacacacacacacacacacacacacacacacacacacacacacacatttactggtgagtggagaggatgccgagccccaggggatagcaatgaattgccgaaggatacacaaatagattgtggcaggctgaggactggaattgcttcccccatttccaccacagtatttatcctatggtaattttcaggcattctgtaaaaatcctggatcgtcttagatattctgcaagatgtgaaatgactgatcctctgtccagtattacctccctttccatgatgattttctgaatcacaaagttcttagtttcacaggtcttgaccacccatgttattttttgacaacaactgactttttcttttttttttttttttttttgagacggagtctcgctctcttgcccaggctggagtgcagtggcaagatctcagctcactgcaacctccacctcccaggttcaagccattctcctgcctcagcctcccgagtagctgggattacaggcactcgccaccacgaatggctaatttttcttatttttagtagagacgggttttcaccgtgttggctgggctggtctcaaactccggacctcaagtgatccgcccgcctcggccttccaaagtgctgggattacagctgtgagccaccatgcctggccaacaaatgacttttaactctttctaaaagcaaagttattcttcaaggttgactttatattcccactggtgttgaagataatttctaacaatgagttccaaaaatgatgtgtgcattcagaatgaccctggcctatggtgccccatctgggtgaacaaattagaaaaagacacctcggccgggcgcagtggctcacgcctgtaatcccagcactttgggaggccgaggcgggcggatcacgaggtcaggagatcgagaccacggtgaaaccccgtctctactaaaaatacaaaaaagttagccgggcgtagtggcgggcgcctgtagtcccagctactcgggaggctgaggcaggagaatggcgtgaacccaggaggcggagcttgcagtgagccaagatcgcgccactgcactccagcctgggtgacagagcgagactccatctcaaaaaaaaaaaaaacaaagaaaaaaaaaaagaaaaagacacctcctctgtggtgatgcagtcctgtgggttcaggacggggcaggcagatgcctccattgtgtgaggataagaggtggccacttctccagatgcagccctgagccaggctctccagctcagcgagcagaactttggctggttccctgtccctttgcaccccttagccacaggcatcgcatggagctgcacaaccagatgtggggccctgagcaatggtagcattggtagagaatacttactaccacctccacccacaccgccttctatggtgataacccttttcattcttggcctctagccccatggcaataggaacttgaataagttctttcatgtttgaaaaagaatatgaatacaggccgggggcggtggcttacacctgtaatcccagcactttaggaggccgaggtgggcagatcacaaggtcaggagttcgagaccagcctgatcaacatggtgaaaccccgtctctattaaaaatacacacacacaaaaaaaaattagctgggcgtggtggcaggcgcctttaatctcaggtactcgggaggctgaggcaggagaattgcttgaatccgggaggcagaagttgcagtgagctgagatctcaccactgcactccagcctgagtgacagtgcgagactccatctcaaaaaaaaaaaaaaagaatatgaatataataattagtctattttctcaagcattgaagcatggccagaaggaattggcaagtaggaagcattgcaggctgactgctgggagccagtgtgtgcgtggttgagtgtgcaggctcaggagtcgtggcctaatcatctcatctctgacattattagtgaggtgtcctcggcaagttgcttaaactcatgtgtctcagttttctcacccataaaattagaataataataccttatctgataagagacctaaatttgtacttgatagattgtttttaacatgtgctgacttcatttctttgaattcttttgtaagaactccttacaacttaatatcatcatcaacaacccccctccatgtcttcaacctcttctgtgactattttcttctcttcatcttcttgctttgccagaaacctggctctcccctgatgctgcagtccctgtggtcctcttgagtgggggctgttctctctcttagcttgtctgtatcacttggttcataggtggagtaggtgtcttccttgctcatcatgtgactttcagatcatgttccctgcctcctcctaaagcattgagctttgactctcctgtcctcagacagggcctctgaccacttccaactgtgtctgcctaccaacccctggttactccctctcatttgaatagctgagctccttcctccctgtcactctctgcagcattattcttgtcataattcctggtaactgcaggatccacattgacgatccttttgggacctggtccttggtgcctcagcctcctctttttcaatgatcttgttctcctcctcatcttagctgctgattctcataccctaaaatgctggcagctgatccacaatcacacattcaaacatctttctccaactaccacctcctgtccgaatctcttctgctaatgtactgatcttacagccctgcaacctcactacctttcaatccattgatcctcctgcctctccactatctctaaccccctcaagtctccatttctctaattacctgtcttcaacccagggtcagtcattccatacatttccaagcccaaagctcttttgcatttcttccaactcctttggctgaaccacagccctggctcaatctgcctctctgtcaggctgtgcttgtctccacacagctgacaatggctggaggaaagcatgcaaccatgctgactgctctcccgctcagctggtgactgggttttttaatgtcagcccaaagataacttccaccagctccaggaacctgcatctgcaccatatcctgcgtcttctctccatgtcatctggtgagcagttcatgatccatgttaaggcacccttcccacaaggcttactcccataggcaaggcctttgagcttactgtgtcctctgcctggaaccttccttcccctagatgtctgcatggctctattcctctcatccaatatgtctttactcaaatgccaccttctaagtgaggtcctctgtgacctcctctctacattgtcccatacacacatgcacacacatgacacttcctactcctctttagttttctccttgtcattccctaacatactcaagagtttatcactgtctaccatatgatataatttacttagaaatgcttgttgtcccccaccagaataaaagctccatgggggaggaccattggtctgttttgttgatggccatttctccagtgccatgacagtgtctagcacagagaatatgcacaataagtgggcgctggatgaaacaataaaggaatgaaaaagttgttgaataaatgaaatgacaaatgtctgtacatttttatccacactgatgttttctttctttctttctttctccctctctcccaacctagatactggataaactactagatggcgacttaacaagtgatccttcttacttccagaatgttacaggatgtagtaattactataactttttgcggtgcacggtaatgacattttaaaaaccataataatgtttgcttaaaacttttggcaaaaccgaacttcctttgatttgggaaatattatagatgactttatactagaccaacatgtccaaactgtaccgcgtgatgtggtctactaacccatagaatcttttcctcatcagtgttgtatacgttataatctgaccactgagaatgtgtgatatttcagataactcaaaacaacttctgatgaacatgatttcccccaagtagagcttgttatagaggcacttttgtgaaggacacaggctgggattggagttctgggtctcaggtcccagagcttcaagtctgtttacgagtctcttgaaaatgcccacattctttgttctgtacttaagacgcttggataatcaaaactgccaaagccttaatgaaaatatttgctttgtcttacttttaagatgtttaatgcatttagtatggccctcacttcaagccttctggaatatttctcaaagtattcaagtagtttgtttcataaaagtaggccaaagttgatatcttttgtgtagaattagtcaaacagaaggagccaaagtaggtgtttgaatttgtataatctttgtctaatgcttatgacaatgcattctgtttttaaaattgcctgatttatgaactagtttgtaaataaagtataacgttagtttcagtggaattcgccaatgctgcagttttggatttagattctactaagagaaaaacatgtggtagacaagacagaaacaaaatttgtgatgatacctttttttctttacaacaatatattcacagttagtaaaaattgttgatgaagcacaaagttgtcaaactcaaactttaacagtttttttaatccttgtgtaactgttttttttttaaagcatttactcctttctttcagtataatgattattacagagactttattgcagttttttttttaataagcttcatggacaacttttcttctgtcttgtgtccttcataaagtatcatctcttttcacatttgacatattttcccctttattatagtcaatccaattttgtgtgtgtgtgcggttttttttattttttaattttattattattatactttaagttttagggtacatgtgcacaacgtgcaggtttgttacatatgtatacacatggacacaggatggggaacatcacacaccggggactgttgtggggtgggggtaggggggagggatagcattaggagatatacctgatgctaaatgacgagttaataagtgcagcacaccaacatggcacatgtatacatgtgtgtggttttaataaacagcagaacacagaaaagaaattcttagctttaaatccagcacaccaccaacctggcccttgtgatccatttgaccttctttccaaagagccaccaacaaggagtgaattgattttgataatctcatctcttttgttttctctctctttgcctctagtggggttgctaatgggagtcacagattgcaaaagattagtttctgcaaaggaaaatcctgtatttgcaaattgggtattttaagagtattttaagggtatttcagatttctaattagtaaaaagattccacctaaattatctcaaaacctccgagttaaaatttcaagaatggcgacaagttaatagtcccgtcacgtttctccatgttgtatgttatgagaaattcacagcttttcccaacatactgttcctgccaccaatcatgttccctatgtctttccaatgccccttctgccaggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggtaagagagctacttcagttactattttaggaactttcagattacccagagcagaagtgatttgtaatttgagtcctgccttttttttttttttaacttttatgatgtgtcattagcataaataacagcccctttctttgtttgattccaattcaaagttttatattgttccttttaatttaaccacttttgccgttgtggtgacttatacctgtaatcccagtgctttgggagcctgaggcgggtggatcacctgaggtcaagattttgagaccagcctggccaacatggtgaaaccttctctctactaaaaaatacaaaaactagctggacatggtggcgggtgcctgtaatcccagctacttgggaggttgaggcgtgagaatcacttgaacccgggaggcagaggttgcagtgagccaagatcgcaacattgcactccagcctgggcaacagagcaaaaactctgtctcaaaaaaataaaaataaaataaaataatttaaccactttcccctgattattccttaaaatgaaattccctttggcacacaccacttctcatcctttcttgagaaaggaagagttgcagagccaaaaagatgactggccgtgtgtaagagccagatttctcttatgtgttgctttgttacatgaatcccaatgacgtcagggataaatgaaatcaactggttattctgaaaatgcattttgcctaatggttgtattcattcactttacccaatcacagtgttttgagtctctccttagggtgtgaggttgaaatgatgaatgagaaagggtccctgtttggaagtaggtcaagtcaagccattgtgctgtctggttgaaatgctctgcctttgctgccagtggaggtgccagtggagagtgaggtcacagaaaaggagccctggaggttcaggcaaagaagacatgggccctggaactcccactgggaaggaggacaccaagagcaaatgacatggggaaagtcagcctgtgtattatttctttcctggtactacgctctcagctcctcctctggtcctccagtgctgttagcctttgcccaagggatcgtctctagggcaactccgaaggatgcctgtactgatgactggggagaccaccactgagtgatccacttcctccctatatcctgttttgaatgaacaaaaaacagggcagtcggcagcccataggatttttgtatgaattagaataaaggcatcctctcctcaagatactttatttcgatctttcagaaattgtcctgatatactgccttagttaaaaccagactctttactgccatttgctggcatgctgaatattcatttctacaatgtgtatattaggaatggtgtgtcttaggattgttcagtgcacaatctgcaatactatccaggcagtccctggccaatgcaccctaactagactgtggtttagaatatgccagacctaggaggcccatttctgggtcctgcttctagtacagtgttggacacgtaaccattgttgaaaatagtttaagaccaattatatgccaagtctacaaacccattataaacctgcaaaacttgatgaaatacttactttcttggaaagaaagagtctaactaggtcaggccagcatttcagccatccttgtgtttggttttcttggggacatgtagtggcccttagtgcttgctgcttcaagacttctcagaggacctccagaaggcactgctgtttgtcctctcctctgagctctcagaacgcgttgtctttacccccataggtgtacatggcacactctaacgtgcagactctcagtctgacacccataccaccaccagcctggagcagatgtcaggaatgaatgaatgattagtgctgtatcaaaaatatatctataaacctgtccataatccattaggtgcttattatccacaaatttattaaaccaaaaagaggttagcgttcatgtcttaaagatgatgttctgtaatgtgatgttaaggaatggaacgagtgaatttttttgagaggagagcagataagtttgatatgtgttatttgtgcccttgggagatatattttctcactgtacacactttttttttttttttttgagatagagttttgctcttgttgcccagctgtagtgcaatggtgcgactggctcactgcaacctccacctcctgggttcaagcaattctcctgcctcagcctctcaagtagctgggattataggcatgtgccaccatgcccagctaattttgtatttttaatagagatgagttttctccgtgttggtcagattggtctcaaacttctgacctcaggtgatccgcccacctcggcctcccaaagtgctaggattgcaggcatgaaccaccgcacctggcctcactgtacaaatttaactagaatatgattcctttctcagccatgtgagggtaaggtgggacaaacagcttacctgatgacataaactctccttatgttttgactgataaaggagaatatattgattagaggtgatcctgcattttgatatttaaacttctctgtccctcttgcccatgtatcctaaacttaccactatgaattccaataaaatcaaaatccagtattttctaaacttttcttttcttttttgagacagagtttcactctgttgctcaggctggaatgcagtggcacgatctcggctcactgcaacctccacatcccgggttcaagtgattctcctgcctcagcctcctgagtagctgagattacaggcacatgccaccatgcctggctaattttttttccgtatttttagtagagacagggtttcaccatgttgcccaggctgatttcaaactcctgacctcaggtgatccacccgcctcggcctcccaaagtgctgggattacaggtgtgagccaccgtgtctggcataaacttttcaactctgaatcggttgccagaaaaagaaaagagtttagtggtatagataaaccatatttccataaagaaacagaacaaaatatgccaccaaaaagtggctgctgctaaaacagacagcatgttcactcacgcagctggcaaagcgcttgggatagtgattatctttggcttgtctgttaatgatgttgaacctcagtgttcagaacgggaatcagaacaacctaggttggcttaaaacgttagtaccattaaagtcatatttatgtaagactcggtactaatttgtcatagaaaatagcatgcctgtttctattcataggaactagaggtctttttccagtactgggttcattttggccaatgtggagcatctctgatggttgaaggaagaccttcctgggtttctggaattacgttttcatgtagtttctgtataaaaattagcttctctgtaaactacgttagtttctatgtaagctacgtgaaaacataatccttttcttacagtgatatacaggagatgcatactcaaaagtcattttcctttcagtaatttcagatgtttgggtggtaaattgaaatatcatattggcagtttcaaaaataactagaaagagaaacaatctgttgggctatttgaattctttatgactgaatgaagtcaaaacatgatcaggacttttaggagttagctggttaatagagtatggtggttatgaacatgttcttaagttgcatatcttgagtttgagctctggttacaccagtcactggctatgctcctttgggagaggaaacttaaactctctgcgctttggcttccttgtctataaaacaggaataaaaacagtatttatgtgtgagtttctgtgaggtttaaatgagattatatatgtaaacacacttagaagagtgcctgatggttagaaggtgcttatttatatatatataagctattaccaaaaatgttcaacaaattttgtgaaagtctttaagatcttgctacattcaaaagttatacaagaaaccctggaaaacacaaaaataaaaaagaatggacaggcttccagtttccattccagtgtgtaagaagcttagaagtctccactccattgtaacaacagtaaaaagccaaacaaactgaaatataatcaagaactctttttagatttgttgaaactgaggtcacagggcaaattgctgccctccaaaattagagagagagatgaatatagggagtcaaaacttaacaggagcaaacctgtaagtagaaccctccatggaaacaaatggtgaggaagggaaacctgaacagtaattggtaaattactagaggctccatagggacaagtctgagagtttaaaacaccatgggtggggagaggactcagccaaaggtcacttgtaaatgacctttattatgttgagggacttttcttgtatacccagactgttgagtgtttttatcaagaaaggatgttggattttgttgaatactttttgtgtcaattgagatgatcatgtggttttgtctttcagtctgtgatgtgtcactttgattaacgtacctatgttaaaccagtcttgcatgctaagggtaaatcccacttgatcatgctgtagaatctttttggtgtattgttgaatttggattgctaatattttatcgataatttttgcatgaatgtcagagttacagccttgcagttttcttttttcttatgatatctttgcctggcttaggaatcaagataatacttgccaaaaaatctatgattaatatgctaaggattttaatggaaaaagtagacaacctgcaagaacagatggatattgaaaatagagatatggagattataagaatcaaaaggaactgttagagatcaaaaacactgtaacagagataaagaatgtctttggtgggctcactagtagactggacacagctgagctaagagtagcatgaggatgtaataaataaaagcttccaaaactgaaaagtaaagagaacaaagacttaaaaaaattttttttgaatagccttaactgtgggacaactacaaaagatgtaacatacacataaagggaataccagaacaagaagaaagagaaggaaatggaagcaatatttaaagcaataatgattgcaaactttcccagattaatgtaaaacatcaaagcacagattccagaagctcagaaaacatggagtcagataaatgccaaaacaaaataatcaagaaaaggaggcaagtcatatggaagcttcaaaaaaatcaaagataaagaaaaaaagtctcaaaagaagccaaaggggagaaaaaccttacctatagagaagcaaaggtaagaattacatctaggttctcctcagaaatcatgccaacaagaagagcatggagtgaaatatttaaagtgttgagagaataaaacccaccaacttagaattctgcaccttgcaaaagtattcctcaaaagtgaaagagaaataaagactttctcagacaaacaaaaattgagggaatttgttgctagtagacctgctttgtaagaaatgttaaagtaagttttcaaagagaagataagtgatataggtcagaaactcacatctatataaagagaagaagagcattggataatgattaaatgaagatgacataattatttatgtagaaaatccagaagaatcaacaaaaaagcctcttggaattaataagtgattaatcataacaaggttgcaggatataaggttaatatagaaaagttaatcactttcctatgtactcccaataaacaagtgaaatttgaaattaaaacacaggactatttacattagcacccttcaaaaatgaaatacttagatataaatacaacaaaatatgtataagatctatattaggaaaactgcaaaactctgataaaagacatcaagaacaactaatagttggagaaatattttgtgtacatggatatgaagactcaatattgtcaagatgtcagttcttcccaacttgatccatagattcaatacaatcccaatcaaaatctcagtaacattttgtagataaggataaattgttctaaagtttctaaggagaggcaaaagacacagaataaccaacacaacattgaacaagaggaataaagtcagaagattgacattacccaacttcaagacttaccataaagctacaataattaagatattatttattgtaataattaagtatggcattggcaaaagaataggcaaataggttgatggactagaatagagagcccagaaatatacccacataaatatagtcaaccgatctttgataaaggagcaaaggttatacaatgtagcaaagatagtctttacaacaaatggtgcaggaacaaatggatatatccacatacaaaacaaaataatgaaatagacacagatcttacacccctcacaaaaatgttctctgaatggattgtagacctaaaggtaaaacataaaactataacacttgtaggcattaacttaggagaaaatctaaatgaccttgggtatggtgttgatgtttcagatacaatgctaaaggaacaatccatgaaagaaataattgagaagctggacatcattaaaattaataacttctactttaccaaaaacaatgtcaagtaaatgagaagataagccacagagtgggagaaaatatttgcaaaagacacatccgataatggactgttaaccaaaatatatttttaaaaacccttatagctcaacaataagaaaatgaacaacccaatttagaaatgggaaaaagacctgggcacctcaccagtgaaaatatacagatggtaagtaaacatatgaaaagatgttggctggttgccagtggctcatgtctataatcccagcactccaggaggccaaggcgagaggatcacccaggagtttgaaaccagcttggacaacatagagagaccctgtctctacaaaataaaaataattaattaatttattagctggatgtggtggtgtgcacctgtagtcatggctacctgagaggctgaggtgggaggatcactcgaccccaagagttcaaggttgcagcaagtcatgactgtgccaccgtactctagcctaggcaacagagtgagaccctgtctcaaaaaaaaaaaaaaaaaaagaaaaggaaaagatgttcaacatcatatgtcattagggtattacaaattaaagccatgagataccacttccagacctattggaatagccaaaatccaaaatactgacaacactaaatgcttacaaggatgtggagcaataggaactctcattctggtgggaatgcaaaatgatacagccaccttggaagacagtttgaaaatttcttacaaaatttaatatactcttaccataccattcagcagtcattctctttggtatttacccaaatgaactgtaagcttgtgtccacacaaaaatctgtacagggctatttataacagctttattcataattgccaaaacttggaaacaaccaagatattcttcagtaggtgaatgaataaactagtccagacaatgaaattttattcagtgctaaaaaaaacgagctatcaagccatgaaaagacatgtagaaaacttaaatgcatatttctgagtgaaagaagccaatctgaaaaggctacgtactgtatgatcccaactatgtgacattctctaaaaggcaaaactatggagactgaaaagatcagtggttgccaggagttgggggagggagggatcaataggcagagcacagaggatttttagggcaatgaaactattctgtgtgatacttcaatggtggatacaagatgttatgcatttgtcaaaacccatggaccgcataacaccaacagtgagttctaatgtgaactgtggactttaggtgatttgatgatgtttcagtgtagctttgttagtgtaacaaatacatcgctgtggtgagggatattgatagtggaggaggttgtatgggagagggcataaggggtgcatgggaactctgtactttacactcaattttgctatgaacctaaaactgctctgaaacacaaaatttactaatttattaatttacctttttttaagttaattgtcttcctagtaaaggggatagatgctagtatatttgataatgggtagattcaattcctacatccagcagactggtaaagtagactctgtgaaggaaaatacaactaaaatacaattgaattcaggataaatgacaacaaacataattgtaatgcctttaataaaatgaaagtggatctgaaaacaaaaacaacaccagaaaaacaaaaggcagagaagggaattctgtggagcaagagcaataaggcagggtggccctgagaaccagtgtcctcagtgctgggctggcagctggcagctgggctgtgggcccaagtaaagtgacactgctgacctgagagcccagcaccagggctgggacatgtggagggcccaaactggtcccacagtgctaggaactctggcaactagcagaagcaaatacacttaacttagtggtagggccgggcacggtggctcatgcctgtaatctcagtgctttgggaggctgaggtgggcacatgacctgaggtcaggagttcaagaccagcctggccaacatggtgaaaccccatctctactaaaaaagtaaaaaattagccaggtatggtggcgggcgcctgtaatcccagctacttgggaggctgaagcagaagaattgcttgaacctaggaagcagaggttgcagtgagccgagattgcaccactgcactccagtttgggtgacagagtgagactccctctcaaaataaataaataaataaatgaaaagaaaatagaggtgtttacagtctctcagatttttcaaaaatataaagccattttcaacaaaaatgtaagcttgtaatcaaaagtcacctaacacaaaagtaaacaggctacagcctgtgaataaacagaaacaaatataagagagaaagatagccaaggcactttcagatataggacatatgagagataaaacaactatgtatgaaatatttgaaggcataaaaatggagttacaaaacaagcaataaatgagaaactaataaatatggctaggcaaatttgaaagagaacaaattgtaatcattaaaaatgaatgatacagttgttgaatttaaaactcagtgcatgggttaaagagtagattagacagtgctgaagataaatttaatgaatcagaagatagatctgaagaaattaccaaaatggaacacaggaagaaaagataaaaagtttgaagggagattaagaggcattaagaagagaatactatatgtctaagcagagtcagagagggtaagaacagaaagaatgaaaaaaagccatttttaagaaacagtggctgaaaatttgccatatctgataaaggttatgaatgcacagacacatgtactgaagcacatatacaataagcagtgggagagagaaaataaattcatattttaggtggttttaatgaaattgaataatagcaaaaagcaaagagaatgttttaaaagtcagaaggaaaaggcaggccatctacaaaaggaggacaatcagactgacagacttgtcagtgacagcaatggaaggcataatatcttcaaagtgctaaaatgagataacaatctagaactacatttcaagtaaaatggtagaataaaagtattttcagatttaacaaaaaaattatttcaagtgcatttagaatcaacagattttcactaaaggagcttctaaagaatatatttaggaaaaataaattactccagaattattccaggaagaaaatctgagctacaagaagaaatactaactatagaaattgatagaaataatattttatcaatgttaatgttctggttttgatcattgtacaatggttgtgtaaaatgttaacatttgttaaggctatgtaaagggtatactatttatttaacagattttgtttgttttgttttgttttgttttgtgacaggatcttgctctattacctaggctggagtacagtggtgtggtcatatcttactgtctcaaactcctaggctcaagctctcctccagcctcagtcccccaagtagctgggactataggcatgtgctggctaatgttggcttttctttttcttttttctttcttttttttttttttttgtacaaacagagttttgttctattgcccaggctggtgtcaaactcctggcctcaagcaatcctcccacctcagccttccaaagtgctgggattacaggtgtgagccattgcagccagcctctgtagcagattgactgagatataatttacataccacagaattcactcatttcaaatgtacaagttagtggtttttgcaactgcaattttctctgcagccatcaccactatctaatttctgaacatcttcatcacatctgaaagaaaaaagaaaaaatcccctattcattagcaatgatttccacttcctcttccagcccctggcaaccactaatctactttctgtctgtatggatttgcctattttggatatttcttataaatgaaattgtgcagtatatggccttttgtgactgtttctttcactttgtatgttttcagggttcatacatgttatagcatgttcattctttttactgcaaaataatattcctatgtatggttataccacattctattcatccattcatctattgatggacatttggcatgtttccactttgtgattattgtgaaaaatgttgctatgaatattcatgtacagtgttggtgtgaacatatgttttccattctcttgggtagatagatacctaagagtggaattactgggtcatatgttaactctatatttaacattttgaagttccagtttctccacatccttgtcagcacttgttattgtctgacattttgattctagccatcctagtgatttaaagtgctatctcattgggctttgattggcatttccctaatgatgaacgatgaacatctttctatgtgatttttatttttcatttttatgttttttggagaaatgtgtatccaaatactttgcctattaattgggttgctaattaattgggttatttgttttttattattgaggtgttaagagtttttttgtttgtttgtttgtttgagatggagacttgctctgtcgcccaggctgcagtgcagtggcatgatcctggctcactgcaacctccacctcccgggttcaagcaattctcctgcctcagcctcctgaatagctgggattacaggtgcatgtcaccacacctggctaattttttatatttttagtagagacagggtttcaccgtgtgagccaggatggtctggatgtcctgacctcatgatccgcccgcctcgacctcccaaagtgctgggattacaggcgtgagccaccgtgcccagcctgagagttctttatacattctgaatacaagtcccttatcagatatgattttttttcctattctctgggttgtctttttattttcttgatgttgcccatcaaagtccaaaagttttaattttgataaaatccaatttgtgttttctttcatcatttatgcttttggtttggtttttttttttttttttggaactgaatcttcatttcattttagtcaagttaaaaataggtttaaaaactaatactcgagttggttattggaaaacatccaagtattcacaatttgggtgtgtgaatctacttttttttttctgtctctattttataaaaatttttttccccataggttattggggtacagttagtatttggttacatgagtaagttctttagtggtgatttgtgagattttggtgcacccatcacccaagcagtacacaacacaccctgtttgtagtattttatcccttaccaccctcccatcttcccccaaagtccactgtatcattcttatgcctttgcgtcctcatagcttagttcccacacatcagtgagaacatatgatgtctgattttccgttcctgagttacttcgcttgatagtctccaatctcatccaggtcactgcaaatgccgttaattcattcctttttatggttgagtagtattcatatatatatattcatatatatatttggaatatatatatgtggaatatatatatatatttatatttatatataccacagtttctttatccactcgttggttgatgggcatttgggttggttttggttccacggattttgcagttgcgagttgtgctgctataaacctgtgtgcaagtatctttttcatataatgacttcttttcctctggacagatacccagtagtgggattgctgatcaaatggtagttctacttttagttctttaggaaaccacactgttttccatagtggctatactagtttacattcccaccaacagtgtagaagtgttccctgatcactgcatccacgctaacatctactgttttttgattttttgattatggccatccttgcaggagtgaggtggtatcgcatggtggttttaatttgcatttccataatcattagtgatgttgagcgttttttcatatatttgttggccatttgtatatcttcttttgagaattgtctattcatgtccttagcccactttttgatgggattgtttgttttttacttactgatttgtttgttgtagattctggatattagtcctttgtcagatgtatagattgtgaagattttctcccactctgtgggttgtctgtttactctgcagactgttccttttgccgtgcaaaagctcttttgtttaattaagtcccagctattaatctttgtttttattgcatttgcttttgggttcttggtcactaaatcttgcctaagccaatgtctagaagggtttttccaatgttaccttctagaatttttatagtttcaggttttagatttaagtccttaatcaatcttgagttgatttttatataaggtgagagatgaggatccagtttcattctcctgcatgtggctagccaattatcccagcaccatttgttgaaaagggtgtcctttccccactttatgtttttatttgctttgtcaaagatcaattggctgttagtatttggatttgtttctgggttctctattctgttccatcagtctatgtgcctatttttataccagtaccacgctgttttggtgactgtggccttatagtatagtttgaaatcaggtagtgtgatgcctccagatttgttttttttttttgcttagtctcactttggctttgtgggctttttctgttgttgttccatatgaattttagaattggcttttcgaattctgtgaagaatgatggtggtattttgatgaggattgcattgaatttgtagattgtttttggcaatatggtcattttcacaatgttgattctacccatccataagtatgggatgtgtttctatttgtcttgtttatttgtatttatgatttctttcagcagtgttttgtagttttccttaacattttgaagaactgccaaagtgtttattgcaaagtatctgggccattttacaattccaccaaaatggatgagttccaatttctccaggtcttttgcctccttggttaggtgtattcctaagtattttattttttttttttgcagctatcgtaaaaggggttgagttcttgatttgattctcttgttggtcactgcgtatagaagagctactgatttgtgtacattaatcttgtatccagaagctttgtcgaattattttatcagttctaggagctttctggaggggtcttcagtgttttcaaggtaaactatcataacatcagcaaacagtgacagtttgacttcctctttactgatttggatgccctttatttctttctcttgtctgattgatctggctaggacttccagtactatgttgaagaggagtggtgagaatgggcatccttgtcttgttccagttctcagagggaatgttttcaacttttccctattcagtattatgttggctgttggcttttattacattgaggtatgtcccttgtatgccaattttgctgagagttttaatcataaagggatgctggatttgttgaatgctttttctgcatctgttgagatgatcatgtgatttttgtttttaattctgtttatgtggtgtatcacatttattgatttgtgtatgttaaaccatccctgcatccctggtatgaaacccacttgatcacatgatggattatctttttgatatgttgttggattcagttacctagtattttgttaaggattttagtgtctatgttcatcaggtatatcagtctgtagttttctcttctggttatgtcctttcctggttttggtattagggtgatgctggtttcctagaatggattagggaggtttccctctttctctatgtcgtggaatagtattaaaaggattggtatcaattcttctttgaatgtctggcagaattctgtgtaaatctatctggttctggacttttttttcgttggtaattttttaattaccatttcaatctcgctgcttgttattggtctgttcagggtatctaattcttcctgatttaagctaggaggattgtatttttccaggattttatccatctcttctaggttttctagtttatgtgtgtaaaggtgttcatagtagccttgaatgatcttttatatttcagtggtgttggttgtaatgtctcccgttttgtttcttaatgaggttatttggattttctctcttcttgttaatcttgctaatggtctatcaattttatttatcttttcaaagaaccagctctttgtttcatttatcttttgcattttttcttgtttcaatttcatttatttctgttctgatcttggttattgcctttcttctgctgggtttgggtttgggtttggtttgttcttgtttctctagttccttgaggtttgactttaggatatcagtttgtgctctttcagtctttttgatgtaggcgtttacggctatgaactttcctcttagcaccgcctttgctgtatcccagaggttttgataggttgtgtcattattgtcgttcagcttgaagaacttttaaatttccgtcttgatttcatttttgacccaatgatcaggttatttaatttgcatgtattcacatggtttcgaaggttccttttggagttgatttccagttttatcccactgtggtctgagagagtgcttgatataatttcaattttcttaaatttattgaggctcattttgtggcctgtcgtttggtctatcttggagaaagttccatgtgctgttgaatagaatgtgtattctttggttgttggacgaaatgttctgtatatatctgttttttccaaggtatagtttaaatccattgcttctttgttgcctttctctcttgatgacctgtctagtgctgtcagtggagtattgaaatcccccactattaatgtgttgctctctgtctcatttcttaggtctattagtaattgttttataaatttgggagctccactgttaggtgcatatgtgtttaggcctttgactgttatataatgtccttctttgtctcttttaactgcagttgctttaagtttgttttgtctgatataagaatagctattcctgctcacttttggtgtctctttgcatgaaatgcctttttccacccctttactttatgtgagtccttatgtgttaggtgagtctcctgaaggcagcagatagttggttggtgagttcttatccattttgcagttctgtatcttttaagtggagcatttaggccatttgcattcaatgttactattgagatatgaggtaccattgcattcatcgtgctatttgttgcctgtgtaccttgttttttttgccttttatttttgccttttaaattgtatttttgttttataggtcccgtgtgatttatgctttaaaaaggttctgttttgatgtgtttccaggatttgtttcaagatttagagctccttttagcagttcttgtagtggtggcttggtagttgtgaattctctcagcatctgtttgtctgaaaaagactgaatctttccttcatatatgatgcttagtttcactggatacaaaattcttggctgataattgttttgtttgaggaggctgaagatagggccccaatcccttgtagcttgtgtggtttctgctgagaaatctgctgttaacctgataggttttcctttataggttacctggtacttttgtctcacagctcttaagattctttctttcgtcttaactttggataacctgattggacaatgtgactaggtgatgatctttttgtgataaatttcccaggtgttctttgtgcttcttgtatttggatgtctaggtctctagcaaggccagggaagttttcctcgattattcccccaaatctcttttccaaacttttcgatttgtctactttctcaggaacaccgattattcttaggtttggtcattcaacataatcccagacttcttggaggctttgttcatattttcttattttttaaaaatttatctttgctggactgggttaatttgaagtctttgtcatcaagctctgaatttcttttttctatttgttcagttctattgctgagactttcgagagtattttgcatttctataagtgtgtccaatgtttcccaaagttttgatgttttttctttatgcaatctatttcccttgacttcttgtatcgtgcttaatacatttgactttatttaatcttcccttttccaaccattctgaaactgcatggtttctaatgcaaatggctccctttgcattagaaacacctggggtgctctaacaacacctaatcaggcccactccaccaaagattctgatttagctacctactatagcaaccagcacatagtagtatgcaataaagttggaaagaaggaagggaaggaaaagaaaggatggaatgacggaagacaaatggcttgttcatttgtactataaaccacctttacaataaacatatattcaattataagtgcaaataatccaccacctcaagtaccattgattatatcatgtatattccttagtccttagtcttaatcagcagcattaaaaaaatgcgaatgcactctcatacactgattgtaagatgtatcctcattttaaaaataattaaacatggtgatgaaaggatagggtatctctagaatctaggaaatgcaacccacagtctccaggagctttggctttgaaatctctgctctttggagaggtcccctggtcccgtattccttgtgatatagaatttacattgttattgtttttcttgaagattctgaaaatgttttcaacccccttttctctgtctggttatagttcctgccttgcttaaaaaaaaaatcatttgtgctgtattttcaaagaccgtgtatgagtatgtgtgtgtgtgtgtgtgtgtgtgtgcacgcgcgcacgtgcatgtgtgtgtccttgaatttgaggttgtttgtgtttctaagtggtctggaaggacactgcagttttaagaggaaccatctgcaaatgccaattcttacttgcacttgtgcttttgaaggttaagttgcctttgggtagggcttaatatgctgtatgtaaaagtttacctggtcgggcgcggtggctgacgcctgtaatcccagtactttgggagtccgaggctggcagatcacaaggtcaggagtttgagaccagcctggccaatgtggtgaaacctgtgtctactaaaaatacaaaaaaattagccgggtgtggtggtgcatgcctttaatctcagctacttgggaggttgaggcaggagaagtgcttgaacccgggaggtggaagttgcagtgagccgcgatcacgccactgcactccaacttgggtgacagaacaagactccatctcaaaaaaaaaaaaaaaaaggttcatctagtcaggaaatggtaaatataaagttacatttccctgtcacttatcattctacagctcattaaatttcacctaattgcatcttcagaattcaggatgttagtgtttcttagcttcactaccagactgaaatcttaacacccaggtcattagagttctatttacttatcccaggctatcaaaagatcttcctttaggaatggcgagttcctgagtaataaatgtgacttagaagtttgaaaggtaaatattccagcaaatctaactcattttgttagtcattctaattgcttgtggcattttccatcataacattttttgatggcaaaatgttgatggtaatcatggccaggaaactagatttgataaatgtctagcatatcaagaaaaatttaacacttaaatgatactaattcttcaactgttagttggactttaagcttctgtcaaaccatgatgggaaaagtctgactgtgttgactgtgagctgtatgtgatttccccctagccctttgaagacaatgaagagaatgccagtatcatttcacgaaaacttctgggaggaggaagtagctcccagtgaagcatgacttctgcagagaaggaagctaactctaggacatttattttatgtaactatagtctatagataagcaactgccacattataggcagataaaaatagtgtacattcgaaaaccaatttatactgcagagttccttgtgagttcattttatctgtatccgttataatccaaatgcaagagtagcattactttttttaatgaggcatacttctgggcttttttgatttttaagcatttcagagaataaagggaaaagagaatacctataaattatgaaattgatttcgattcacctaaacttgccatgctttcgacatcttctcttgttcatactttatgttagatgaaatgttcacatgataacccgtgtgtgtttgtattttctcttcattctttcattaagccatttaataatatattcttccccatgagatggtttaagttgtttttcttggtgcacaccaccatcatgtcataaaggctttattttgttgttgtttgaaagtgtctcatgcttaaaacattagaaagtacacttgtgattgtggctacaggaaatgtagaatttcatctagagttacttaaacatggcatggtgagagtggttcagagagaaagataataaatgacaataccatttgctatgcagattccagagatctaaaacccagtaagctaagaaatgtatatttaaattcagttgctatgaaacccaactggtatgaaacacaggcgattacatccgttgactttactttgaaaagacaaatcgagaaagggtggagagagtattcttttctggatacaattagtagtatctgttgtgcaataaatgtcacatgctgtagtggctactccatctttattccttatgtcatagtataataggagatgtaaaaagtcgacgtagatgttttaaaagactgggccactgggaatcactgggaatccaaagcagtgtgtgcccaccaccatctaataaagtgtgagaggatatacgaaaggtttaattttttaatttaaaacaaaaggaaataaaataagctttgctgactctttttattattatttttttgagacagagtctcactctgtcacccaggttggagtgcagtggcataatctcagctcactgcaacctccacctcccgggttcaagtgattctcatgcctcagcctcccaagtacctaggattaccggtgcctgccaccatacctggttaatttttgtatttttagtaaagatgggattttgccatgttgaccaggctggtcttgaactcctcacttcaggtcttgaactcctgcctcggcctcccaaactgctgggactagagggatgagccaccatgcccagcctcatgtataatgtacagattggtcctagggggctgatttggtctgtatgtcacggtcacacatcagatggtctagagccagaatggaaagccaatgcttttgtctttgtttttccatcatcatcatcatcatcatcatgatttgagtctgtttgccatacagtctgactccaggccccatgctctttccactccagtttcctcttctttcgtgtgagagtggatgacttaattctgtggcagttgaccctggtctgttatcaaaaagagaaagccacgttgtcacacttcccactgccgacagaagccccagtcatatgttctgggctcttcctagggctttttcgttggatttgcctggtctatgttgtagaagttgtctaaccacccacactcctgccatgagtcaatctgtgccatctacttgcttatgactgttattattatcattgttcccaagtcttgtcattgggtaatgatcaacgcagcagcacaaaagcagaaactttttgctctgggcagaagctcctgatgccctccttcttgatttctggctttcccctctactcttttcactctgaagattcttgtctgtttcttcagcctcctgacagtccccatatttgttacagtgatttgcacattccttctaagcctgtttgacattctctggaaagaaaagggaaaaggatgctttagtctcccaacaggggagagttgtgtttttggaagaaaaacaacaccaaaaaacctaattgcaaggtaatggggtggctttgatgaatagaaccattgagagcatggggcagaaagtcttgcacctgactgataccaggttttcctgtctagataaaaacataaagaacacagagcacagactttaaaaaaaaaaaaggtaaagaaaagtaagctgtgtaaccaggcacttgccttcttttatgaggagatcaacctggttggaaaccttccactaactttgctatctaccagggagggggtgtggggattgataacaacaggtgggaattagactcctggcagtagcttttctggttctttggatgtgtgcctactactgtcgctctcagtcctcttctcagagaaaggcaaagtaacctttattcaaactggaattttctcaagctggaaggcaagtttgttatgggaggagagaatgccaatgggtcagccagaatccaaggagggctgcactttgcggaatgctctgctccctgaccacactagggcctccccgtccactgtccatatccgttttgagagcttctgagcatctctaggttaatgctttttgcaggctgtttagcatttctcctgtgatgaggctgtcctgctctctgctggcattcgggaccactttagctgggaaggatcatttccttcccattagtgaaagggagcacagctttcctgttttattttttccctttcttcataatccttaatgtattcactcaattactagtggtactattattttttgttttttcttttgttgttttgttttgttttagagacagggtctcactgttgcccaggctagagtgcagtgtcataatcatagctcactgcaacctcaacctcctgggttcaaaagaccctctcacctcagcctcccaagtagctgggactacaggagcatgctgctgtgcttggctgatttttttaacttttttgtagagagaggatattgctgtgttgcccagactggtctcaaactcctggcctcaagtgatcctcctacctcagcttcccacagtgctaggattaaaggtgtgagccatggcacctggcccattactattatattttgaacttaagtgacagtagtaatgttggggagcagagagctggcagggcaagccaatagcaagcaggttttcccatagttcctgtctgctcccctgtaatgatagctattatgggagtatctgctgctcctcctccacatggacatagtttccaatttccttaatccagcttcatgaaccgcagaccgctcctccgagagtggctgtccttggaagttacttacttctgttacttcgcagctattgacagagaggaccaattttctttccagtatataccaaacccaaggtatagcagtgctgtccaatagaaatataatgcaagggagatatgtgcatttaaattttctagaaggcacatgaaaactataaaagaaacaggtgaaatcaattttaacaatatattgtccttaacactatatatatataatgtcatcatattaattttaattgatactaagaaattattgaaatattttacattcttttctttgtactgagtcttcagaatcctgtgtgtatcttagatgcacataacaattttgactagccacattttaagtgcttataatacactttattgaagaatgtaggtcgataccatagatttaactgtctataaattaaagcatttttttctttgctcttgcagggccgtttcttattggttgggttgtatgcaaatgtgtgtttgttaattaaatatatttaatgatgtggagaaagaaagaaattggctccttgacccacctcctagtagggtaataactttgtcaagcacattgcagtctttggagatgacccttaggtgtgaccttgaagctgaccttctgacaggcaggggtacattcctcctctggagagatttgtctgtgggagtgggtgagcttgctcctgggacagtcagtttattaaaattcagttattgggccaggcgcggtggctcatgcctgtaatcccagcactttgggaggccaaggcgggtggatcacttgaggtccggtgttcaagaccagcctgggaaacatggtgaaaccttgtctctaccaaaaaatacaaaaattagccaggtgtaaacccgggaggcagaagtcgcagtgagccgagatcgcaccactgcactccagcctgggtgacagagcaagaccctgtctcaaaaaaaaaaaaaaaaaaaaaaatccagttattgatcatggtcagaggagattcttgagaggcaaggggatcagaaagcagccatgagagcagaccctgaaacaagaagcagagtaaaggactgactagaaggggccccaggacttttatattcaagcaagaggacaagaattattctggatcattcttaaaagtcgtttaagtgtgctgttctaggtagggagcttttttccaaagatcattgcatcagaatgatggctttctggatccttttcaagttggctttgttgttccccactaaaagcagcaaaataatttagagttaaggtgcaagaaagcaggaataattttttttggccaaaagacattatttatataatcgctggacactgactcaaacttgctgttccacttccattcttctttattcatcttgacaaaaccagctggtagggggatgggaggcacatggggctgtttattctaagttcacttactctcttgtcttcccttttccttaaaacgtgaaagcaaaatatgtctctttttaagaacaacttggttgcagaaatgactactgtttcattcaatttttctaccagtcttcttcaagcaggccttggggactcaggcctcctgagtattacatccctaagactctgcacaattaccaggaagaagtatggccaacagtgagagtgatggacagctgaggtcaacgcattatccatggacagataacaagtctgcccccagtcagggacatttcttaaatgttatactcctcagctgaattaaagttttcttctgcagctgagcttttgggaaacccatgggaattattgtttgttgagctggataatagtgaaattaattcttttctgcttagggggaaggcactggtgggacatgctaattgcttcagtccaaaagaactcctggccacattagagtttgtaatagaagaatgataagtaaagcagccagaagaggaagtttggagggctgatttgcaggagtttcattgatttagcatctgtagggaaaattcccttaaaaaagaattttttttttggattagtgaacaggagaacattcaaaactaagacagatagaggccaactgggaatgctgtgcagcctggaatagcttaggctgctgttcaatcatttccccaaacaggaaaccacagaatgttagagattaaggtcactagatcattgggaaaaaagcataactttgtctgcaaagtattatgatatattgtaaatggaccagaatataagcataaatctttcgtctaaaaatgcaacaacaaaaatccatccttctcacaaaagcacaatttgctttcctgttgtgctgagataccaaagcctccttctctggtatttctgtaattttcctaataagtaagagctgtaagcagggaataaagagaaaagttttgtgttctctgtcagtaacatgtgtgctttttttttttaaccacaacaaaaaatggttaaagtttagaacagtaagtggacctcacatgatttattttcagtcttagcctttcatgctagcaacaatgaaaataaactaaaatgcacacttatatacatttctgtctctaatctctcaggctgtattaaaagcacagagttcttttttcacctctgattatcatcatggcactgcctgacttaaattttaagtgaaaatctgtgcttatagagtgtggaatctttctaggtgtctgtaaacgtactcttctgcaggtatctttggctaaaatggttgctttatatctgccttaaattatttacccctcagaggcatactctatttaaaataagggttaattctcatctgattctgttcattaggtctttactaggagaaggttttcttgctgagatagttaaactcatgaataaactgctgatttatgtgcatctagaacctgaaattcaatttatgatttgaattgttaaaaggactagcattttagaaaggtttaagtgaaactgacttttcttggcccctcttctaaggaaaacttaaagaatgaaagcataaatttccctttccttttctgagtattcactgctttgaaaagttaaaaaaaaatctgaagcatttgaaagacaggggtcacagctttccatacctgttcccatggtacttagtccttagtctctccataaacgtgtctgttgaataggcagagatctcatatgagtaaactaaaaaacaaacaaaacacactacatacacaagtgagcatgccctcttctccaactcagacaaaaggccacttcccttccatttcagatggagggaacacttaaccacctgcaaatccaggaaggaagtgaaataaatggatagtgttggattgagacctactgatcttttttacccatgacagaggtatggatacagagaatatttttctcttctaagaaaaacagtagcataagcattgaataaatgacaaccaccctgtgcctgtgtgtgtgaggataccagggcaggggtgggggtgtgcctcagggttacagctccgcaaagtgttagctcattgtggctgagaggaaatacaggcccagcctggtcagatctccgaatatttaaatgctgactgtcttagttcaggctgctgtaacatagtaacatagactaagggcttaaaaacaagaaaaaattgtttcttacagttctggaagctggaaatctgagatgagattaccagcatgatcagttctggtgaggatctcctgggttgcagactactgacctctttttgtatcctcacatggtggaaagagtaatagagagctctctgaggtctcttttgtaggggcactaattccattcatgagggctctgctcttatcccctaatcaccctccaaaggccccatctcctaacaccatcactttggctgttaggttttccacatttgagttttgggaggatacaaacatttggtccataacactggcatctaaatggaaaaacagttacaacaacaccatttggactaaccaaatacatctgcatgctgaatgcaagcctcacacagccaacttaagacctctgcactccagtataggaatttattttttagtttatctttgataaagagcaataaaaacattggtaaaacctgctcttcaagttataggaaatctttaggtttggtatcctatttgccctcctgacagctgtgggatgtagctatttccactatttagaggagaaaattaaagctcagagtgagtagatgacatatccaagatcactcagtgagcacaggtcttgcggggctgaggcagggccagaggtcaagacttctgtctgaaagtgtcggctacttttataagcttctgctgttagttctgtccagtcagtggcgtgcctggtgcagttatttatggagttctaactcctccatcctaagtcacaattctaatccataggtaacatttcatttggaaattgttgtaccgttgtgtactttatcatgcttcacatgcatcatgtttcataaatactcccgattcatatgtgcttttcttttcttttcttttttttttttttttttttgagatggagtctcactctgtcacccaggctggagtgcagtggtgcgatcgcagctcactgcaagctccgcctcccaggttcactccattctcctgcctcagcctcccaagtagctgggactacaggcgcccaccaccatgcccggctaattttttttttttgtatttattttagtagagacggggtttcaccgtgttagccaggatggtctccatctcctgaccttgtgatccgcccacctcggcctcccaaagtgctgggattataggtgtgagccaccacgcctggccacttttcttatacccattgtgcagatgaagaaactgagctctagatgggctaactcaattaagataatactgccagttagtggcaggggtcagattcaaacccagccatagagtttatgcacataactataaacatatatccttaatgtcaaagagtcacactttaggtttgccacttgcttgtggaattacaaatatagaataaagcacctgttcaatgtgttcttatggaggttagtgaccttagacagtagtgaggcaatgtggaagagcacttagaagcacacagtttgggctcaggtcgatctgaacttgaatttcagtcacctgttgggggatcatggtacactgacttacctccttacacctctgcctccttgtgcctaaaatgggataaataacacctgccttctgagaatgctgtaaaatgcttagcacagttcctggaacataataagaaaaacaacaagagagtcttattattactcaaaaacttccttttaaaagccatagtctttaccacacttttctagcatttaagtgtgggggaattccatgtgattttgaattccaggcttcagaattagaagttcctttaaaagagtaatacatgaatttatggctctaactttcaagaaaagactgagatgcagtggccaatgcatgcaaaattagtagtcaagggtgtgttattatttcgagagcttgaatatatatagagttcaggtttatcctggctggatttcttcctacagtcggcctttttctgaaagagtgagattgacaaccaagtatttgacacagaaagaccatccctatattctgaaggtttatttagaagaagtgctgtgtcgagtctctccaatcattatcagatgatcaacttgcttgagaaggaggaggacctaatactcactgacctcttattctgtgtcaggcactgtgctgggaactttgtgtacatggtctcattagttctcgttacaattctgtatagttcgtcgcatcctcatgtccagaaaaggggctgaagctcttggaagttcacccacatgtctacgagttccagttatggtgtgttggcatgcactgcactggtccgaaggtgtatgagtttggatttcatggtttcagtgacagaaataactctgcttacttgaagcatgaatggaattgattggaagacaggataggtcttagaattcatggaaaaactgaagaagtggggtgaagaaagaacagcagattggggaaaattctagggatctaggaagcaaaactaatgagtagacttatcaatgaactctgtgtcctctgcccatgattccaattccagggaaagagcatttgagtgcctttacttaggtaatgtgcttatcctttgccagaggaggcaggacactgtgattgacaactcccaccagggctgtatccactgaaggtgtgggtgacccacaaagtacagtttccaggagaagggagagtggacctgggcatgcaaaagcagcagatggtcactatacagcaccacatgaaaccattaaagagcagaatccataccctgtaattgtccatcggttttatggggtaccaggcactgtgcaaggcctggggatgtagcacgcactcgggagctcctgtttttaaggcactgctggtatttcacagcggtttagcaaggccactccccaccaactgtgagtaatgccctcacacacatcctgtccatagagccaaagtgagaggtgactaagagatgtcaccagggccagacaaacagagcaagattgtttctgaaccggagatgtgaactgtgtctcatatgcaactaactctcagtttccagcagcttttggtagcactaaatggttagctgcagggagtcaataaatgcttgttggtttgaaggaactttagctcttttcttaaggaaaaattttaggtagaagggtggaagtcgggatctaggactcattctgttgcctcacagtatcacagtttccataacagtaaagtggaggcggacagtggaacacttctgttcctgaccttgtgaagcagtacaagaataaagctctatgcacatgaaagcaggttgaaaagcaagaaagaattaataataataaagatgcttttctcatctctgccttttgacaaagaggaagaaaaagatgcttgtggtccaagtcaccaaatgccgtctcttggaaaggcttgaattctggaatgagtttttaaagactgtctatgaattaaaattaagctttttacctagttgtcatgaaaaaaaaaatgagagctggtatggtagtatttgaattcttacaaattatttctccaaaagactcatcttttgccaaactgaggtatccaacctcatagcattattgttcttttttttttttttttccattataaaagcattctaggctgggtgcagtggctcatgcctgtaatcccagcactttaaggaggcaggtagatcacttgagcccagaagtttgagagcagccttggcaacatggtgataccctgtctctaccaaaaatacgaaaaatagccagtctcataacctggtctctaaattaattaattaattaaactttttaaagaattattttgtaaaaaacgatgagaacacatggacacatggggggaacaacacatactggggcctgtcaggagggtgcagggggagggaggtaatggatgctgggcttaatacctaggtgatgagatgatctgtacagcaaaccaccatggcacacattgacctatgtaacaaacctgcacatatacccctgaacttaaaagttgaagaaaaataaatcaataaataaaaagcattctatggccaggtgcggtggatcatacctgtaatcccagcattttgggaaggaagctgaggtgggcagattgcttgagcccaggagttcaagaccagcctgggcaacatggcgaaaccccgtctctacaaaatatacaaaaaaattagctgggtgtagtggcatgcacctgtagtcccagctactcgggaggctgagatgggaggatggcttgagtccagcagttggaggttgcagtgagccaagattgtgccattgcactccagcttaggggaacatagtgagactgtctcttaaaaaaaatttaaaaaaaggattgtaaccacatttgccaaaaacaaaacaaaacagaaacctagaagatagccaatctaaaataaatcaaccatagctcaaataactgtattttgatttgttctttccccaggtttgaagcatttttaaatatgtgataattagagtacaaacaagtgaagtctcagtttttcattgatttttttcataagataagcatttttctgtgacattgcataaccatcagtttcactaagctaagcagccagccctctaaggagtaaaagaagtctctaaaagcagtggctttgctcccttaccagaggcctacagctgaccagaaaggaaagtgaggaaatgcatgttcagggcactgcctagtacgtcgctggagaccaactccaaccagctctttccttgttccttgttttgttccaatcactattgacaagggaagtgtagctaaaagctgcattcatctctgtctcctcccttctgtctttagaccttgttgcttaaaataccagcaagccttaggggtaagtttgctccagagtgtcccagttttagcactgcatgtcttgctgggcaactcctgtccagggcaaactgggacagttggtcaccctaccgggggagaagtgggatgagtgtgtagacatatttggccaacctgtccttgtcagagctaagttcctccctggaacttttctatcaggatgtgggtagccagcgtgtgcccttgggcttcaggaccacccctatgccgtgcccacctgcttctcatgctcagccactgggtcctaggctatctcatccactcacccagcctagaggcacctaactgggatattcctataggggctcatgagagtaaatgtgacatttaggtgcaaataagagctctggaattcttatatttaatgctggcctgcctttgaaatcacttctcatgatcgttattctgatttcttttttgttgcatttgacttatgtgcccttcagaaatacaaaatggtttccttgctttgcaaaggaaggatttccatttgtacccaaaagtagaccttctacacattgcctgtgcgagattgtgcaattcagctctttgctgtttcttggtccagagagttggtgctcttgttatgataagtcttgactaacaagataagtcttgactaacaactcagggatggtcctcattccatgtcagttcaacatgtaatataatgctgtacatataaatgtgtttttgctgtaacatggggactttgctattgtcccttaaggatgaaaaaaacatcacattgatttcaaaatatagtaatgattgtcagtaaagaaagctgtgggagacacatgagagatgcaagctgcctgtagtggccatggagagtaaaattaaatggatgcactatgaatttgctgattgatcagcatcttttacactgaattctagaagaagaatcactttatgcttgatgatctttgctaatcagctataatcaggtcttcgtagaatggtgaagtaattaagtcttgttcactggtactaatcatatataattgtttccatactgttggccaaaacaactataggaggttttgcagaggccatgagtactcaaggtctttgaggtaatttctctatataaacaatgcaaatattttattactggagttcagttgaatttttttaacaggctttaaatctatcaggattttcctgtgggtttcttcttaggagagtgggggtggtgatggtgactgagtaacatgaaaggccccgtgttcctgcagtgggggcccagggctctttcatcttagtctgactgctgtcccactgctgcttgaggatttggagtgtgtaaaagtcctgggctttttaattatgtttgagccttttaagaacccgcaccgtaaagggaaagacggaaacttatgcagtgaaatattttatatccaatttgaggattcaaccaaaggtctccactcgggccaaatcagagccttcaaatagatcaaaagtagcatggagttgaggccgacctctttgttggaggtggagtggcaatactttatgataattaatatgttagttgcataaaagtagcgtaagagtagaaaaaaaggagagtatattactcagatttccaccatctaaatattaacatttttcaaactttgtattccatatatgtgaatatgtacattgatttttatagttatagttgtgatatacattatacttgactttctgctttcatacttaacattatgtgataagtatttcccacattgcatcatggttcaatgaaacattttaaatggtcttataatatcctatagaattcttatactgttgtgcatttacctactcaattataggacttctggattgtgtttgagtttttcattataagactcaatgaatatatataattttttaaaatttctttggacctgttttcctagaatatattctacaagttgaaattactgggacaaggaatttcaacatttttaagtttgggggcagaaaattggctactgattttctgaaaagaagagccattttatactgtccccattagttctacaactttatcagaattgggaattatctgaattattttttcaagcaaattgaaaattgctttaggattaatgaaaagagttacctcagtgttgtttttcctatgataaacatcagtttgacacatacaaaaaattgtattctaggaagaaagaacattcctcactgttgacaagcagctatcatatttttaaaaaggaagttttgcaagtggcatggcaggcatagttgcttccaataagaaacaaatttgaggcacctgaatctctctgtctgctgctgcaaaaaaattatacttgctactgaaatcaatgtaggagaggagagcaatatggattagcaatacccaagagaaagctcagcttgccagcgactgcactgcctgaagttgaagttaatgaaatgcaggcttcatgaaaatcctagggggtagtattccttagttccactaaaatgtaaccacagtcttccttcttaacatagccataagtccaagtaaaacctgtatatatgtatcactgagtaatacaacacaaatgtttttgcaaccaagagaggcctttatgcagattactatgaagaattcagtggtagagacaaggcttgagtttatttcggattgttattctttatggctaactagaagaaaatctcagagagattcatgtctctttttctctctcactggctcactatttatacctagctcgattcatgagcttcacctcctgaatcttgcatttgctgatggcttgatttcatttcaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaggaagatgcttgggagcaggcaggttgtgggaatgggagagcgggattgaaaataaagcctgaatagcaatgagacatggccgaccttaagcaaagccatacaacagccagtgtgtgtcttctgtggccctactttccacagagaagagtggtctgagttcagacatacataggactaaatataaaaccagacaaaagtttaggcattgttcaagaggtaaggagacaattcattaaaaagacagtgctcagtccaaagaggcaaatcattaatgagagaattgcagtctatttggggagagaacttggcaaattataaaggaagtttcaacacaatctcctctggcaaatgtatgatcacatttttatattacatgtggagcctcaggacaaaatctctctagctgacaccctagtgcaacttccactgcggggtcagatgttactctcatcatcttcctttcttgcaatgtcctcttcaagtgttggaatcatggttatactggcctcataaaataagttgggaagtgtttcctctttctgttgttggaaacggtatctttaagtgttaggagaattcactggtgaagccatctgggcttggagatttgtttgagggaagggttttgttgttgttgtcgatatgtaagtgtacatctttatagaatacatgtaatattttgatacatgtatttaatgttaatgaccaaatcagggtatttaggatatccatcacctcaaacatgtatcatttcattatattgggaacatttcaaatctcttctagccattttgaaatatacaatatatcgttcttaactatagtcaccctactgtgctattgaacactagaatttattccttctatctaactgtctgcaccccttaaccaatctctcttcgtcttcccacccatccccacttcccagcctctggtaactatcattctattctctacctccatgaaattaactttttacgctcccacatgtgagtgagaacatacgatatttgtctttctttgcctggcttatttcctttaacataacgacctccagttccatccatgtcactgcaagtgataggatttcattcttttttatggcttagtaatattccattgtgtgtatatgccacatttttaaaatccattcatctgttgatggacacttagggtgattccatgtcatggctattgtgaatagtactatgataaacatggcgtgcagatattcctttaatatactgatttcttttcctttagaaaaatatcaagtagtggaattgctgcagcatatggtaattctatttgtagttttttttagaaacctccatattgttttctataatggctgtactaatttacattcctaccaatagtgtatgagttcattttctctgcatcctcatcagcatctgttattttttgtctttttggtaatagccattataactccaatgagatgatacctcattgtggttttaatttgcgtttccctgatgattagtgatgctgagatttttccatatacctgttgggcacctgtatgtcttcttttgagaaatgtctattaagatccttttctcacttttttttttttttttttgagatggagtcttgctctgttgcccaggctggagtgccgtggcaggatctctcggctcactgcaagctccaccacaccggttcgcgccattctcctgcctcagccttccgagtagctgggactacaggcgcctgccaccacacccggctaagtttttctatttttagtagagatggggtttcaccgtgttagccaggatggtctcgatctcctgacctcgtgatctgccccaccttggcctccccaggtgctgggattacaggcttgagccaccacgcctggcccttttctcactttttaatggtattatttatggtttgtgctcttcagttgcttgagttgcttgtatattctggatattagtctttggtcagatggatagttggcagatattttctcctattctacaggttgtctcttcactctattgattgttccctttgctgtgaagaaactttttagtttaatatagacccatttgtctgtttatggttttatcacctatgcttttggggtcttagccataaaagctttacctacaccagtgtcctaaagtgtttcccctgttttcttctagtggttttatcattttgagtcttatgtttaagtctttaatccattttgagcttattttacatggatatggtgagagataggggtttcgtttttgagcttattctatgtgtatatggtgagagataggggtttagtttcattcttctgcatatggatcccagtttacccagcaccattcattgaagagggtgtcctttccccagtgtatgttcttgtcagctttgtcagagattatttggctataaatatgtggatttatttctgggtttactattctgtgccattggtctatgtgcctgtttttgtactaataccttgctgttttggttgttattgctttgtagtatattttgaaatcaggtagtgtgatgcctccagctttgttctttttgctcagtattgctttcactatttggggtctttttatttctgtgacaaatgccattggtattttaatagttatgcattgaacctgtagattgctttattcagtatgatcattttaacaatattaatttttccaatccatgagcatgagatgtcttccatttgtttgtgtcctcttcaacttcttacatcagcattttatagttttccttgtagagatctttcacctccttgattaaatctattttaaggttatttatttcttttgtagctattgtaaatgggattgctttcttgatttcttttttagctagttcattattagtatatagaaatgctagtgagttttgtatgttgattttgtatcctacaactttactgaattcatttatcagttctaaaattgttttggtggagtctttagttttttctgtataaaagatcgtgtcagctgcaaagagaaacagtttgacttgctctttttcagtatgaatgccttttgtttctttttcttacccagttgctctggctaggacttctggtactatgttgaataggagtggtgaaaggggacattcttgtcttgttccaattcttagaggaaatgctttcagcttttccctattcagtatgatgatgtttgttgtatatggcctttattacgttatggtatgttccttctatgcctgatttgttgacagtttttatcatgaagggatgttggattttatcagatgtttttcttaatctattgagatgaacttacagtttttgtctttcattctgttgatgtgatgtatcatgtttattgatttgcatatgttgaaccatccttgcatttctgggataaattccacttgattatggtgtattatctttttgatgtgttgttggattctgtttgctagtattttgttgaggatgtttacatctatattcattagggagattggcctgtagttttcttcttgtgtgtgtccttgtctggttttcgtatcaggatgatagccttgtagaatgaattagaaagaattgcctcctctttaattttaaagaattagtttgagaagagtttgtgttagctctttcatataagtttggtagaatttggcagaaaagtcatccagtctagactttcctttgttgggagaatttttattactgattcaatctcattattctttattggtctgttcaagttttctatatcttcctggttcaatcttggtaggctgtatatgtccaggaatttatccattcccctaggttttccagtttgttaggctaaagttgtccataatagtctctgatgatccttcgtatttgtgtggtatcgattgtaatgtctccttttccatttctgattttatttatttgggttttctctctttttttcttgattagtatagcctagtctagtttattgattttatttatcttttttaaaaacaggcttttttatttcattgatcctttgtatttctttttagtttctattccatttagttctgctctgattgttattattcctttgttctaattttgggtttagaacaaaagataatgggtttggtttgttcttgcttttctagttttttaaagatgcatctttaggttgtatatttaaacactttctacttttttgatgtaggtatttattactataaacttccatcttagcactacttttgctgtatcctataggttttggtattttgcgtttccattttcatttgtttcaagaaatgtttaaattttcttcttgatttcttaattgattcaatggtcattcaggagcatgtttttaattttcatgtgtttatacagtttccaaagttttccttggtattgatttctagtttaattccattgtagtcttagaatatacttgatatgattctgattattttacatttgttgagatttgtttaatggcataacaagtgatctgtcctagagaatgtttcctgtgctgatgagaaaaaaatgcattatgtagcagttggataacatgttctgtaaatgtctgttagttccattttgtctaaagtgcagtttaaatctgacgtttctttcttatttttctgtctaaatgatggccaattctgagactgtttgttgaagtcctcgactatgattgtattggagcctatctctccctttagatccaatactatttgctttatatatttgggtgctccagtgttggctgcatatatttaatataattgggatggttatatcctcttgctaaattgaaaacttttttttacaatttttatcttgaaatctgttttatctaagtacagctactccttctcacttttggtttctgtttacatggaatataattgtttattcctttactttcagtctgtatgtgtctttgcagctgatgtgagtttcttgcaggtagctgatatggtttggatgtttgtcccctccaagtctcaagctgaaatgtgattcccaatattggagatggggtctgatgggaggtgattgtgtgatggggaagattcctcatgaatggctttgcaccaatcccttggtgataagtgagttttcactcagttcatgtgagacctggtatttaacagagtctgggacctcctccatctctgtctcttgttcctgctcttgtcatgtgaaacacatgcacccactttgccttctgccataattgtaagcttcctgaagccctcatcagaagctgagcaaatgttggtgccatacttgtatagcctacagaattgtaagccaattaaacctctttcctttataaattacccagcctcaggtatgtttttattatgatgcagaatggcctaacgcagtagcatatagttagatcatattttatttttatccgttcagccggtttatgtcttttatgtggggaatttaatccatttacattcaaagttattactgataggtgagaacttatttctgccattttgttcattgttttctggttgttttatatatcctttgttccgttcttcctcttttattgcttatcattgtggtttgatggttttctgtagtggtaacatttgaatcttttctctttctcatttatgagaagccagtgagtttatactttcatgttttcttgatggtaggtatcgtcttttcacttccagttataggactgccttaagcatttcttgtagggccagtccaatggtaatgaatgtcctcagtttttgcttgtctgggaaagactttctttttccttcttttttgaaggatggctttgtgggtatagtaatcttggttgtcagttttgttctttcagcactttgaatataccatctcattttctcgtggcttataagtttctgctgagaaaactgttagtctgatggggattcccttatatgtgccttgacaattttctcttgctaattttagaattctttctttgtctttgacttttgacagtataactataatatgccctggagaagacatttttggattgaatccatttggagatttttgagcttcctgttctagatgcctatatctcttgcaagactttggaagtttggggctataatgtcattaagtaagctttctatgcctttgcttacctcttcttcttctggaacacccaaaatgtgaatatttggttgcctgctttatggtgttccatatgtcatgtaggctttctttgttctttattaaactttatatatatgtacttttttgtctgagttatttcaaaagacatttcttctacttcaaaaagtattctgcttgatctctattattgaagctcttgattatatttttttgtttcattcattgaattcttcagttacaggatttctgattggttcttctttatgtatcagtctctttgatgaatttctcattctgattatgaactgtttttctgatttccttctattatttatctgtgttatcttgtatctcgctaagcttctttaataacactattatgaaatctttaccagatatgtcatagatttatttttcattgaaatctgtcactagggaattattgtttttttacacatatcacatttccttgctttttcatgtttgtttgtttttacattgatatctgtgaatctggtgtaacagtcccttcttctgattttttgaattgacttttgtaggaaagatgttttccaatagatgtgtctgtagggttggttgtgtagggcactttggttttgattttgggtgggcacagtaatgtagtcttcagatgacttcttcagctataatcagtgtcagtggtatcttcgagttcctcagtgggttaggctgtggtttttagtagacactgtagtgaggttttgctatggattgggacaccaggtgggccagttctttggcaccagtatgctgtttcttgggttcccaggtggcatacatggaaactggtagaagcaggtctgagtgggctgatccttgggccttcatattatttggctgagtccctacccaaatctcatcctgagttgtagctcccataatccccacatgtcatggaagggacccggtgggaggtaattgaatcatgggagcaggtctttcctgtgctattctcgtgatagtgagtaagtcttgtgagatctgatggttttataaaaggagttcctccacacaagctctcttgcctgctgccctataagatgggcctttgcttctcctttgccttccatcatgtttgtgagcccccctgccacagccatgtggaactgtgagcccattaaacctctttcctttataaattacccagtctcaggtatgtctttattagcagcatgagaacagactaatacaggcttccaggtgacttgctaaagtgctggcagtggcagcagtaggccaggctggcaagtggatcactgaactcctgggcagtgtgcatggcatcaccaatggcgatagcagtagtgggcactagcactgatggcagcaaacttggtgggccagtcccccagccccaaggtggtacatatacaggtgactgctcgtggaggtgatggcaacaggctgggagtggacatcctcaggtccctggaaggaatgcatgggctccagcattggcgggaaaggtgtattgatctctaggcctctggataatgtgcatatgcactggcaggctggggaggcctgtccttagcacccccaggtgtggatgtgcagggcaggcatattcccaggcctctggacaatgcccacaggcactggtgagggtggggccaggtgagctggagctgtcctcaggcccctcaatggtgtgtgcatacaaaggctgtggcaggcagggctgatcaattcccaggcccccagacaacatgcacaggcactggcaacctgtgcgggcccattgtcagctccatagaaggcatgtatgcatgccagtggcagtgggtggggtaggtcaatccctagactcctggataatgttcatgggcacaggtgaaggcagtgcagaggcaggcctatgcttaggcctctagatggcatatgtgggtgatgcgtgtggcagtgtgtgtggttgatcaatccccaggccctcaaatggcacactaggatgccagttgtagtagcaatgggtatctttaggcactttgatgatgtatgtgggcaccagtggcagtgggggtggtaggtcggcctcctggttcccagatgatgcgtgtgggcactggtggtggtggcagacaggcagacctgtttttaggtctcctggtggcaagcagaccgggttgatctccaggaccttggatggtgtccttgggccaagaggcaggctagatgggcctgtcctcaggtccttggacagtgcctgggtgagccagttcccaggccctgttaagatatgtgcaggtgtgcagccaccctgctgctggggggtaaggatttgctgtcagtggcaacagccccaggcaggcagctctcaggctctggagagtacatgctttggctccctttgtccctagggcagcctccccagtgtgtttcactacccattccttggggcgtaagacattgcatgagctaaagttttggggacgcatctgcactgctggctccagccagtatcgtgatgctgtaaacctttgagtagatgtaggggggtgtctgcaggggttcagggatgtagatatgtagtgggtattgggccccaaaggtgtgatgtagtctggtgggggccggcctctcaaaatggcaccatgccgtagctgcttgaatctcaggggatgtgtgggacccagtgtgaacatcttctgtagaacaatgtcattacatggactccaggcatctctttatactagtctcagggcttgtgagggctgaggggctctcctgtggctaaaattataggagtctgtggtgggaatatggactgctgactgctgggaatctctcatttaccttttacccacagtgggagtttcccctggctctgagttgatcttggctgggttagctgcttcacttccctttccttctatgcctcagaagttcccagtcactttcctgctgaattccattgttttctttagatgttctatttgacatctaattatctatttgccattctggtccttcttcgtgaaggaggtgacagccaggtgcgtcaggcagccatcttgaagcccctccaacggagggttttcaattgcagattcaatttctaaagtagatatgggattacttaccttttctgtttcttcatgtgtcagttttcataggctgtaattttttttcaggaatttgtctatttcatccaaaatttcagattcattgacataaagttgctttataacatcatctttttttttttcttgagacagaatcccactctgtctgccagtcatgatcttggctcactacaacctccgccttctaggacatgaggtcatatctcagcctcccaagtagctgggactacaggcatgtaccaccacacctggctaatttatttgtatttttagtagatacagggtttcaccttgttggccaggctgttctcgaactcctgacctcaagtgatccacccaccttggcctcccaaagtgctgggattacaggtatgagccaccacgctcggcctgtaacatcatcttaatatgatttaatgtttcttaagatctctggtgtttttagtaattagcacctctcttgcctgaggtttaacaattttattcttttcaaagaaccaatttttatctttatttttcttgattatatttttgctttctcttttattaatttgtgctttatccttattatcttcctgctattcttttcattgtgtgtgactattgtttttttaaaaacaacatgaatttttagcctttatttctaaaatatgcatccaatgggagaaataaattcctgttgtttaagccatccactatggtatccttataggactgttgagagggtttggataagttaataagcttagagcaattcctggctcatagtaaattttgctatttttatttttattattattaccctggattgcttacaagagtacatataacgaagaaaaaattataaatagtaatagtcaggattcaggaaaatatgtttattgaaagtcaacatataagggaaagttggaatattaatattcaggccattaagggcatatttgaatgttgagctgccagggagtggtggacatgttacctccccccatctgctacactactttgtgataaacatctcaccaggcacacacacgatctcctcaagattatttgatggctgcctccaccacctgttattttatatcccctgaaccagccttgtgaaatgctcccaggcctggcatcccacatgtgtcctgcttggctctttgcataaaacgtccagcttgggaggccagattgctgcttcagggcgacaagtcccacagaggtggtaaaaggaattggccgccagtcagaaactggtggcaaatatcacactcaacccgctgactcttcttgtgaatgcaaaacacatttagagatgaaatggtactcctctggctgccaaaaaaacaagtaacaaaagaagcaaggcccacatatgtttgtgatagtgagtgttttaccacgcagcaagggatctgcattttgtataggtgattttaaaatgttggcaaagatccttcccccttagtgcctcagcgttggtttggggtggtttgtggagatgagggttatgaggagggaaaagcactcccgtgtgaacaaaggcattctctgtgaggtttatctaagaatactgtccaagtgtcaagcgtctgataatgaagaaaacggaccttagccatggacttgcttttcagcattagacacacaaaacagaagcatgggtatgtgtctgccaaaaaagcaacctcattctctgccaaacactacagctcttaatttaaaaaattgaaaccaaagtagacttgtctctggatggttacctaaaatgtccacttaaagaaatgacagctctcctaggggagcagtacggtaccgagagagggagcaattttccctgtgtattcacatcaagccatgcccagagaaatcaaacacagctcccaccagccttcagagatccgatgaagagcaagtgcttcttgttcctccttgttggctctgacctagaaggtaataagtttttggtattggtgccattttaaggattggacactgccctgttatataatccgagcagcagactttctgagcgtctgtcaaatttagaagttgtctgtcaaatgcaaggtctggactaacttatttctaagatatcacctaacaaagatccaaaatatctatatttcattaatgcccagaggggctcagccagcaatgcaatgtggaatagtgtagtgtctttcagcaaatgtcataatgctctctatgcttacatagatatgtaaatatatatatatatatatttatacctatctctatataccatatacctatctctagccactgagatagaaatatacacaaaatgtaaatctcaggctacgtgataaccaaagtcatgggtagcctctgcactggcattgaccataaacccttacaagtgttatctctgggtcccagaagttgagtcctctttctccttgtctgttgacaacccatggccattgctctcaaggccacccttttgggatctttctgtgcctttctccaaatatcaaagttgctgttcattatctgagttgatattgtcactgcatttgaaatgtaggacattttattcttaacatgccagccctaaggaagttttgactccacattaagaaatttaaaactttggccgggcagggttgctgacgcctgtaatccaagcactttgggaggctaaggtgggtggatcacttgaggccaggagttcgagaccagcctggccaacatggtgaaacttcatctctactaaaaatacaaaaattagccaggcatggtggcacacgcctgtaatcccagctactcgggagtcagaggcatgagaatcgcttgaacttgggaggcagaggttgcggtgagctgagatcgcgccactgcactccagattgggcaacagagtgagaccctgtctcaaaaaaaaaaaaaaaaaagattaaaaattttaatcggaataataaccatactgagaaattgctttaagatttttttttttagaataaatgtcattaagctgaatgtcctggagaaagaaaacacttctgtttttttcatcgttattttattgaaaatatctttattgacacaaattatttttcatataaatattgaaaaaatgttgagtcattgagcagttttcatttttaccgaatcttactgggtgtagcttctataatcatgagttttgcatgatctccaacaggctgattttcctgattgcaatttgagcccttactatttttattttatgttttcactgtcaatatcaattccattttcttccaaaactacaagatggattatctcggctaggttgtatttaatggctggaatgaattttaggtctcattttccagggaagggaaactgaaacccagaggttaagtgacttccctgaagtatcctacccatttcatgtctgagctgaggttagagtcttggcttacagcccagagattctctacttcacaagcatatccactactggaataatggaatcacagcagtatgctggtacagttaaaattggagcctatatgcatgcctaccataattaaagcagggccgagaaataatgtatttcacatctagtgttagctctgaatccacacccaaggtgaccacctcctatagacagagagaagattggggttttttgtttcattttgttttgttttttgagagggagtcctgctgtgttgcccaggctggaatgcagtggcatgatcttggcttactgcaacctccacctcccaggtgcaagtgattctcctgtctcagcctcccaagtagctgggattacagacacacaccatcatgcccagctaattttatatttttagtggagatggggtttcaccgtgttggccaggctggtctcaaactcctgacctcaagtgatccgcctgcctcggcctcccaaagtgctgggattacaggcgtgagccaccacgcccagccgattgggttttttacaaaggcactaagatttggtggtgaggccaggttcatataatgtcaagaaaagttatggctttatcggggaacttgtgatattaaaagaatgcatgctgaaattggccaaaatgagcagagagaatatggtgggcagtgtcatggataagagaatatggggcagggcacagggcagagtgcatagtctggctcatagcctgcagcttggagagtgagaggtgggagagaaaccagaatgggaacatcaggcctggatagtagacaaggagtgtgtgttccattgtttaagcagtggggagccatcagaggtttgaaagcacattttaaaagctgttctttgggaagtttataatggtaactttaggatgaattcagggtgaggaaactctagaaataggaagtcatataaggagctttattggaagaagattctccatctatttaatacgtccaccttcttgatattggtttggaagtcctgaaatagaggtcgtggggaataaggtttggaatgcccaagctgtgaggactgattccctgtttgagagatggtgttcactgtgtgtccccaccaacttaagatcactgcatgctggcgtccctggcacttcctcaatggccctagtaggcatcctcagccccctaaagcacaagccctgcaccaagacttgcaccttgaccttgacctgggtttagtatatggagccctcaggcccgtggtctgccacactgtgctcaggggcttctcccaaaatgtcctggtttccaacaggaatcagaccttcagctagaggttacatctagggaaaccaaagggaaggagcacgccaccctgaagcttgactgttctggaaagccctcaccaattggagggggtctatgacatgagaagaaggtggagttagacaaacctggtttaaactttcattttgccgcttgctagctgtgggctggttactggtcctggaaactttttttttttttttgatatggagtctcactctgtcatccaggctggagtgcagtggcatgatcttggctcactgtaacctccacctcctgggttcaagcgattctcctgcctcagcctcccaagtagctgggattacaggtccccaccaccacatctggctgatttttgtgtttttagtagagacagggtttcaccatattggccaagctggtctcgaactcgtgacctcaggtgatccaccagccttcgcctcccaaagttctggaattacaggcatgagccaccatgctggaaactcttgagtgagaacagttacttcataggggtgatgggaaggtcaaaagagatgataaggatggcgaccgatgattccgcatctgtgagctctcaggccacggtctaccacacacttttttaatccacaattttgtggaatcacagtagctatcctataaactatgtcatgttatttactaactcataactgaagaaacagaagcttcacctgaaaaacttgcttaaggctttgaacagtaatagtatctgagatttgaaaattcaaattctgacctttccaccaccccacagtgtctttaagtacctgtgaggggagtgcagtggggaaggatgaactgtagccggatctaggctacatgccccgctgtattagtctgttcttgtactgctataaggaaatacctgagacagggtaatttctaagaaaagaggtttaattggctcacagttctgcaggctgtacgggaagcatgacggcatctccttctgaagaggcctcagggagtttcacttatggcagagggcaaagctggagcagatgagagctagccggggagatgccacacacctttaaacctttagatgacaagatctcgtgagaactcactcagtattgccaggacagcaccaaggtagacatggtggggaaagcaccattcatgagaaatctgccccatgatccaatcacctcccaccaggccccacctccaaattggggattaccattagacaagcaatttgggtggggacacagatccaaaccataccactgcccttggggtatgtggtgatggtggcaaggcggtggtgtggtggtggtggacagaatatttggcagcacatgctaaccaccatagaatacttgttccctaaatgaaagaagagttcttaaaaggaggaggatggaggaggcatggttcatctgcagaaagcagtaacgaccacagcttcctaattgtgcttttctaaaactcacattaacttttgtttgtttcttgactacacacaactagaatgtggaggaaagaatgactctagtccttcgagtggacgatcaggctaggatttgaacattttcacagatagtccacagaaggaatgacagacagctagccacctgcctttctcggaattactgctgacaattcattttttgtgtgttttattaagaattttaaacagcttaggaagcattatgaattgtttctgaaggaacagttccagaagggtcttcagcaggtccttgataacattgacatggtcagaggaagcaacaagcaaaaaaatgtcacttttgcatttgactagatgagagggaaagagaagttttcaaaaacatattgaatggaggaaaataactgttaaataggcttaaggcaatgataatcaaatatagttaattccctggaaaaatgttttagctttggctgggcatggtggctcacaactgtaatctcaacactttgggaggttgaggtgggaggatcgcttgagcccaggagttcaagactagcctgggtgggcaagatagtaagactctgtccctacaaaaaaaaaaattaaaagaattaaccaggtgtggtggtgcaggcctgtagtcccagctacttgggaagctgagatgggaggatcacttgagcccaggaggtcgaggcgcagtgagctatgttcacgccactgcaccccagcctgggcgtcagagtaagaccctgtctcaaacaaaacaaaacaaaacaaaacaaaaagctttggctttgttaaggaaatcggcaaacagagtcttcatctcccccaccagcagtcgccttctacaatgatggatgtcctctttcacgggttctttgtctctatcttccagacaggggcaaagttcctctgtccacttatggaaatctgactgtgggcagaaaaccagaacacagtaatcaaaccacaccccacctcccagccagagagcttctctgaagtcacaggttaggtcctccaaaagcaggcactgaggcaaagtttggggtgcaaatagtttgttagagaccaacacctgtggaaggaagggtataggagcaagactggaccaagggagaaataaaactgtgatacaggccagacaaaccaggcagggaactcttgggagcatattttctatcagagtgtcccacactgggccaaaatagtgaggccttttatgcccagctcattgactcaccaaatttgggctgccccaggaaggtcatcatcttgggaaaggcagctctttgcagctgaggcagaccccgaaggagctgacagctgggggctgtctgctgaatgcactccctgcagtggagcagcaagtacatccttgaagagaggtccagtggggtgcatctctatgtctaccacaaaggccacccagataatgtacttgctagctctcatggatttgggggcagggagttgggagcagcgggagctggtggtttgcctaatatgggaacttggtctttctttgtttgcatgacataaaattttgactaagctctcagtgtaattatgtcttatatctgccttagaaagatggatcaggccttggtttttaactcatatcaagattccaagataggcaagatggatctttcaggaaaaggattaaagaatcatcagaaaatatttccctttttcagttatttatcatggaataataaatcactccaaaacttagtggcttcaaacaatttattatttctcacaaatatgtggattgagtgagctcagctgggtgggtctgattcagatggggtaggctgaggtcacatgtgcagctgcattcagctgggagtttggctaaagctgggacatccaagatgatctcctctcctccagtgctctctccataccacctctaatcatgtagtgtcctggcctggacttttccacaatacagcaggctggtgttccaaatggaaaagcagaagatgccagtccttttaaggcctgtactcaaaagtcccagaacattatttccatttcattctctcctggtcaatgcaaaacacagagcaaagcagattccttttggtgggaagaatggcaaagaatctggagccatttttaatctcctcctttgccctaaaccaatgtgtctcaacctttgcagatacagatttccacacctgctctgtagataccctgattttattggtctggggtggaacctgggcattggtattgaagcttcaaagaggtttctaatatgtagccagtttgggaaccctaaactatgatgtcttttgtccctctattgataatgacatggcttccatctggcaggaacccccatgtggcatatgtttggagaaactttcattctgattcctgaagtatgttctaaatccatttttacttacaagctaaccagaaatttgagaacacagttttactctttacaaatcagccattgacctgaagcattgtctctgtcttccagtcagtagtatcaactggtatggcactggttctctgaaatcatcagccaaaaccttaatctaaattgtagacttcagtccctgccatgcactgcaggtttacaagtggtctttgttctttttaattattgatagatcactggcaatttagacttgtaagaaaactcttttatttgtttaaaagcattagtttccttttcccagcagttttgtgctgtactgaaacaacgtgttcctggtgtgcagtgctcttagatagtagtgtgtctgtgttgcctttcaacaaagaaaaaactaccaagcactgtctgctttaaacatcatccagagtgatggtttgcagcaaagatgtccactagccacagtgaattttttttctggataatagattcatacaattccatgtcaaagcaaagaaaaaaaaagtgccacattttagactgtgaagtcttattataagtaagctcagtatttccattagttactcattaggctatttaataaggattcttaacctggagtaagggtctgtggttaggattcaaggagttgtcagtgaacttggaagggaaaaaactgcatctttattttctctaacctctaactgaaatagcatttcctttcattatgaattgtgaaatttcacatttccttccattataaatgtaggcaacaaatcacagtggcacagcagtacctttgacttttgtcaccaatagaaagcaaagacattctcataccaaataccacatacactgttatagatatgttgaaaaccttttatccttatcactaaaattaaaattatagtagttttcagaccctctggtttctcctactgaatgtgctaatatacaagtatgtatgtgctatctcacaatttttttttactgttttgatgatttcagtggagtgtttcatttgcaatcctagcaaagcctaggatttgattttaattcactgtatattatctatgtatatgtgtggatgcatatgcactctgtattaattatgtatgtatttattttaaggcagggacttgccctgtcacctaggctgaagtgctgtagcaccatcatggctcactttagccttgaactcccaggctcaacaaatcctcccacctcagcatcccaggtatctgggaccataggcacatgataccacacctgactaatttttgtattttcttgtagagatggggtcttgccatgctgttcagcctggtttcaaactcctgagctcaagtgatcctcttgccttggcctcccaaagtcctaggattatcggcatgagccgccatgcccagccagcatgcatttagaaacattattgtgagaaggtagtccacaggctgcaccagacagtcataggagactgtagcacagaaacagattaagaacccatgcattaggctatttgaattgttgaaaataatttatagattctccccagcccaaatcacctatcacctttggtgataccagacagattttatgagctaaactatcaagtaggcttgaattttgtttctagttgattacactggcaattctaactacttttgttaccatattcaagtgacattatagtatagggattaagagaatggatactgtgttagacttggaatagatccctgctctaccatgtaccagctgtatgaccttgggcaagttacttaacctctccaagaaccccctcacctgtgaaatggggataatattatcacccaccactctcacaggagggttcattattaggatgaattgagataatgcttataaattacttgaccctctctctacctggcacctaataagcataaaataaatgttggtttctattgccattagggagctctcttagcattaatctattttcacagggcaagaacctcttgctctgttcatagagtccttaagagacattttgtattaaagtttcagatgatgaaatgagttcaatattgtctgtcagataggcctgaaactaccacagctgtatccagttttaacttgactttaacaaagagactgtcttgtcaaaaggtagtagtagcagagagggatggggcggtgttggacattttgctatatgacagcctaataggaaataaaagtggctgaattgagtaatgagttgtttctaaagcattgagtcccttctagtttaacaataatttgaaacatccctgttgacaacaaatgaggtgcatccagcctttttttttttctttttctcctgtttgtactgagcttctaacatatggaagacaggaaatataggagcttacatttagagagtaaaaaactatcaaaacaaaacaaaaaaaaaatttggcaacttattgctcttctgctgtccagcatggagatgtgggtatttatttttgttcctaatatttatttttttatacagcaaccagagtcccaaggtttagattctggcaccggctctgtcatcttagagctgcttgccagagggggacttcccacttttgactttgtttcagttcaattgcttctccaggccttccccacatactgtttttcagacatggggccaatctcatcatctctgtgtaggggagaagaaaaaagcacagcagagaacatgttaaatttcctaaagattcatttttgcaaggatggcagcatcagcaggtggtttttcttttcttcttttaaatttaaaattgaatacataccaaagaatatttaccatgctgtctaagataaaacagtgataaatgaacacttttgtactcaccagctggtttaaaaaatacgacattgcccttcctaattacccctggaggtagactactgtcctgaattttgcttttaccatcccctttcttttttctttgttaatagttttactgcagacatacgtatccatatataatattttacttttcatgtttaattttatagaaaagaaattattctgtatgtattttgcaaaaacatacttttgctattcaacgctgtatgtgagattcacccatgttgatatgctcaattgtgtcttattctttttcattgctgcatagtatttcatcatatacgtgttattcacccattccactgccgatggacatttgggttgttttcagtattttgcttctacagatagtgctgctatggacatttttgcacatatctccttgtgtctgtgtcagcctcactagataatgttaaactgttttccaaattgattattcttgccggtaaagtataagagttctgattattccatgatctcagcaaacacttggacttgcctctagttctttcacctgagcttattaaattaaaggaaggcttactgtcctttctcacgtctaaaagtcatggtttgtattctctttccatagctgtctcctgtctttttttttttttttttttttaatgccatcaaattgaaggactctggcatacacacacacagcgaaggcagagtggacatttcacatccaagtccgggtggttatgtaggttcatttttcttctgggtgtcctgtgctgaggttggctagcaaaatatccagctcaaaaaaaaaatcagaaagttattcccttagcaccttttcaattcaactctgccaacagtggctcagtaagaagcagcaagtaaataaaatcaacagatttcagcttatgccttgggctcgccagcaatccccagaccacagggagaaaatgaatctttttctcacaaaattcctctcactcccatcacttttccattgaaacaacaaggcagagaagttactttattgacttgctttcctgtgagtcttaccagaaaatgaagaataatagtaattggcaaatactacccacccagttccttagctagcacttctcacatctgctttatgatatccttgctggcctgattttattcatttcctagtgctcggcatagaaaccacaagaactagcaaaaaagaaaaacactgcatttatataaaccaataaaactagtgagcattttgtggacattaaaagaaacatgagggctatcccacattataaatttcaaaatgcaagtttttgccttgtggtattttaaaagttttaagatgctattcaggaacactctcaataactgttttaaattgttgtcgtttaaacgttttttccttttccaatatcccacttgcctagtcttaactagtctccttcctcaccaatctgcccttctgtgctttttccaaaatgcaagtttaactgtggttgttttccttgtttaaaaccactcactaactctgatacctgcaggataaagtcctaactctacctggattaatgaaaagatttgatctggcctctgtttcctttcccaaccttaactcttaccctctccctcctttgcaattaaaatgttgaaaaacaaaataccatatcatcccccaaacatgcacccagaaattcacatgggattccctcctcttgccttgtgaggccctttgtactcctctgacacacctggaaaactcccatttgcctttcattcttggcaatcttggtatgcttgatctttccccacattacctccttcttggcaactctctccatctacgtacatctcctattgtatgtactacactggggtttcacacttcaactctttaattgccttcctcctctactcgatgctaagttccttgaggacaggaataatttattttaaaaatattcatttatttttgtagcataccccttagcacagttcttggcactgagtaaatgttcagtgaattaaaatcaaatcggcctctacctcattcccatgcccctctcctttgcctctgactgtgtgtgtgtgtgtgtgtgtgttttaatactacatctctcaaggagtgtcatgattgttcaccagttgtacacaccaaagtgtcttggaggaaacagagtagacatgctgagataatgaacagttcaaaacaattcccttcaaactaaagactacactgtttatgtcagctaaagactatttcctttctgtgttgcatgggagaaaaaatgagaaatattctgggacacaaatttataaaaggagttgtagaaatttcattacctcagtgctgactagagcatcctctcctttaaaaataattgaattcctggtttttgtttttttcccttctcttaaaaaccacacagcttgcttcctgaagacaaaggaaataataaacaatagcaactcccaatttgactctgattatttgccaaaagtcttcttagttcatgtggttctatttcattagagaggaccgattagcataagaagaatgcttctaaattaagctacccaaatatgcacttagttagtactctgggagctaatttattgtattatttaaaatataaattggctagcaaatctatttattgaggtgtaacagctaggcaacaatgcgtaactttctcttggctgttgagtggtttttaatcatctattgaaatttaacagagagccatttcattaaatggaaagcggataaatactgagaagtctgtattttagagtattatccacacatggagaatgatatttgaggaacaaagagggaattgggatttgctttttaaacagtaactttttgttgttttaatttgaagtgtaaccaaagactcacaaaatcacttgtggggatgttaaagcaagaaataaacaaataaggcggaagatggagtagggtagagaaatagagggatggaaaaaattgtgttaagatagtgctacgttgtcaattagactaatgcagtatttttgccttgtacagttttggggttggcagtaaaaactatgtaccttgttttattttaacaaatggcatcatgaaaatatcatgctatttggcatgctgtgtattctaaattcccagaacctagagacatttaggggttctggggttcccttaggctgtgagtcgagaacatagttgaatccagataccctgtctggtctggagttctcctaaacagatcagctctggagcatctcatggtgctctgatataaatggaagagtcttgtagatgttgtagcatggtcttgaaattctatcattgtcacttatactagaactcagtgagggtaggcagaaatggaaacaagtgacaggcctttctcacctttctgcaaatttttgaaatctggctcatctgatttccagagccaaggtttcaaagaagttttagaccttgtaatttacgataggtggatgttccttaggttcacgttggaaagaagaagaatgtcagaatgtttcctctttccccaggacagccaaaatgtcagagaaccaggagtctgagggtaaactgaagagagagggcactgatttgtagtatttgccaatttccatagtgtaaatactctcacgcagccaatttcaagctaccaacttcacaccactaaacatggagttgggcagcaatgtgcacagttggttctcctgatccagtgagggagtgcccacacactgctgctagaactatcttgcattgctgtctgcaggaagtaaatctttagcaggttagccggctcttgtttccatggtacacagaagatgatgagtcaggatctaagtccttgcagcactcctggcgagagcatttactgctataacctctgccccttcctcccccactcttattctctcttccaaaagaaaactacaaatgtagatcataaagctagatattgagtaagtataaataatgaactggattgtgctttttatcctcttgtggatatcaagtataaaaactggacagggaaggagagaatgaggatgggaaatcttgattactttttaattgcatcaaatcctgtgtggtaaagtgggttcctaaaaggggaaaaagacagaacagttttttgccattctgctacgacaagtaaggtcttgctttcctggcatttctgtgtaggaagaagagggtgtttggcattgcatgtggtgaaaggggagagagggtggagggaaagaatgggatggatcatggcattggcagggataaaactcactgtagacacagttaagttgagtgcagtgacagaggtttgctttcacattcaagctgcttcattaatttcattggggccttttccaaggaaagggaggattcataaaagggaaatcaaagaagcctggaaaagaaacatttccccttctgaagactgtattataatccttttttctgaaaaagtacagtaatgaatgttatatttattagtgctgtaatttctcctcttcacttcttaaagggaaaaaaatactctgtttgtcataaaaactctgataatagtagtagagtgaccactggttgagtccttattatctttgtaatacactggcacatggtacaaacttaagacatatttgtaatgggccaggcgcgatgggtaatctcagcactttgggaggccgaggcaggaggatcccttgagcccaggagtttgagaccagcctggggaacatggtgaaaccccgtttctactgaaaatacaaaaaaaattagctggatgtagtggcgtatgcctgtaatcccagctactcgggaggctgaggcacaagaatcacttgaactcagcaagcagaggctgcagggagccaagatcacatcactgcactccagcctgggccacagagtgagaccctgtctcaaaaaaaaaaaaagaaaagaaaagaaaaaaaagacatatttgtagaccagatgccctgcatcattttataagtattgtctctgaatccttacaaaaagttattcatagagtaagcaaccattccagattgcctgacccttttttacttttagcactcaaagccctatgttcccagaaacctcttggtcctaggcacagtgcgacaagtggtcacccaaattcttatccccattttacaaatgagaaaatagagatagttaagtcattatgccaaagtcacagaactgggctcaaaccctgagctaccaaatcccaagtccgtgctcttaaccatcaggccaaatggcttcctattatcctgtactctgcttttagattttcattaactatactgcccaaggaaagagaaagcttcaacttcaataattcatcccaaccttgctgaaattaacacagaaattcttggagttaatacagagaaaattttccatgactttttttttaatagacacgttcaaagcacgtctaactgatctggtgaaataaggctaacagatttgagtgaaaggtcttcacctctcaggtgttcattctgtatctctctaaaaggaaggaacgtatcacaagatttcttctcatttgagtaccctgattgtcagaagtctgtttctcatatcatgcagtaatgccccttccacttactctcatccttttattcaatctattatttggaagtcatactgccctccccttttaccactattaacttgataatagtagattattttatctatcctttatgtttatgtagagattatgacatatatcctgatttaagaaagtcagctttgagtcaatacatttaccattgtccagatataaaagtgtaccttacaacaggggcccccaatccctcggtcacagactggtaactgtttgtggccttttaggaagcaggccacacagcaggaggtgagtgcaggcaagcattactgtctgagctccgcctcctgtcaaatcagtggcagcattagattcttataggaggggaaccctattgtgaactgcgcatgtgagggatctagttgtgcgcttctcatgagaatctaatgcctgatgatctgaagtggaacagtgtcatccccaaaccatcccccactccccaacactgtgcatggaaaaaccgtctcccacaaaattggtccctggtgtcagaaaggttggggactgctgccttacaacactttaactcactttacaccctttttgtgcaagtactgtcttttgaaaaacttctacatagttcaaactccagaagacattattaattattgatactccttacttgtgttcacatatgtaaattctcagttgctgttcattctcctctgcattttcatgtttccattacggataattttccttctgtctgaagaacagtctttcgtacttcttttagtgcaggtctgctgacaaaaaccttttccaattttttgtttccttgaaaatatctttacaaggtcttcatttctatacaagttctaggttggcagatattttatttaagaactttcaagatattatttcactgtcttccagctttcattgtttctgttgaatagtcagttttcttgctgctttgaaggtactgaaagtactgtttccttttctgtgacagcttttaagattttctctgtctttgcttttagcaaaatgctattctctctgtgtgtgtgtgtgtgtgtgtgtgtgtgtgtgtgcacatacacatactatagtgtaatatactattactaatatactattatgtgtactatgatgtggttagtttgctttgtgtttattctatctaggattcatagagcttctcaaaactggcttggtaacttttgtcaattttggaaatttttcagtcagtatctctgaatgttactatttgtttcttttgccccatttcttccttatcattttatcctaaaattccagttaaacataagttaaatgtttcatggtttcatgtcgtcttcttcttctttttttttttttttgaattttcatacctttattctccatgcttcagtctggatatcctctactgacctaacttccagttcatatagtgtttcttctgcatgcctaatctattgctaaaacatcgatcgagttcttaatttcaatgaacaatgaatgagtaactttttagttaaagaacttccatttgattctcttgtatatattctaattatcttgtgaattatttttctatacctaacatcttgcatattttgttcacagttactttaaaatgtgtacctggtaactctaatatctggatcatttgtggtctctgttatctttttttctccttaaattttagtcattgctcttgttctttgtcatgcctattaaattttattaaatgttgaagaaaatgtacaaaaaatatatgaagaaaaatgttatttttcttccaaaaggatttaattttttctagaaggcatacagagtagaggcatatcaccttgataaagtttgggattgagacgattgattcagtgcttgatttcaaggtttgtgaggactaacctgtttctggtttgttattacttccaaggcattgtctttcacggatctgatggaaagcctgcagtgcttaccagtgctgtccctccttgacaggcttgcaactccaattttttgttgttgttgtttcttttggggttttctttgtttttgttttttggtctctcaagcaccgtaagactaatgagcttttcattctcttatctgccgcttttgacttggcgtcttggtcagagaagcttaaaaattggtgaatttcccaaagggaaaagcagcacaaaatgttaggctcacttccttgtgattcccttttctctacgatcatggcctctctcaaggcttggttgctctctgatacctttaaacagcttattttctttttaattcagcttctattgttttctgtggaataagattggtttggtacatgctattgtgtcacagtcagaagtggaagtcctaaattacaaacagtattgttgcaactgattaagatggtgtacataggaagccccttggggatgttgtaaaggagcaccaaaagttttaactgctctagaatatgtaccattatgatggctacatgtgggtctcctgaagcacctagaagctccttttctcattctattcaataaccatttgctacaccagaggtgtacagtgggagacctcaagaatcgtttccctgagtgctgttgaagcaactcccagccttgatctctgctgttttttcattctttcgaaagtgacttattgcattctttgttaggaagtgtctgctaacaagctttggcttgttttttattctcgttcccaagtaccttttcaatatatttttatttgaatgctatttacgttatttctacttatagttagtgtctgaaagcaaactaaaagataagatttagtaaatgtggaatggcataaaagtagtgaaaagaacttacatgtaaatcagaaaccacaacaagcagattctcttgagggtatgcatctttctatactggaaagcagaaacaataaaccaatcctacatattctgcctgccaaacttgcagctcccatgtggctcttttctctttcctggtgagtagcaccacctttgcaaatctgcccatgtcagaagcctgaaatggggaggatttgttggggatgggtagagaaagtctcacttaacctttatatcggattaatcactgattttattggttccatcttactaccctcttctccttccccttctccccatccctcccatgagcccacatcctctcacctgatttggtagtctcctaatttgcctccttgtaccagtatgactcccttccaaattagccttctccttagacattaagtcatttttctacaatgcaaacataagcatgtcactaccctacttaaaaccctctaggatatatccagaataggcaagtctatagagacagaaagcagattaatggttgccaggggctgatggggagagggggagtgggaagtgattactgatgtatatgggtttcctttggggtggtgaaaatattctgcaacaagatagtgtgaatatactaaatgctaccgaatcatacgctttaaaatggttaaagtggtaattttatgttaagtgtattttaccacagttgcttttaaagcccgataggataaggtccactcatcccagcatgtcacttggggcatcacatggtcccactagcgtttgcctgttcatctgtctcttctgtttccctctattcctgcatgaatgggacgacatacagactgctgcatgcgcccgcagcttcacggcccctgcatttccacacagaatttcctttgtctgcggtgatccctctgctgcacgtgcccacagtttcatgcccctgcatttccatgcctcctgcatttccacgcctcctgcatttccacacacagtttcctctgtctgcggtgatccctccacccccaccccacccacccaccactctccgtccagtgatctccttcaagacccccaagaagcttcccctgacacatctacatcaacaagcccactgtgaacttccctctcttttctgtcatctaaacaggcacaactgggaaacctttactggcaggtctttgtttctagttccagggagaattatattgttttctaaaaaataaagtggaatgaagctttaaagtgtttgtataaccctgttgaaattcatgacacatttgtgaccccctggaacatctggaacacatgaagttagaggctgcagctctagtgtggaggcacccaaaatagacagttctattcagggagccctgagattaatcttgtcacatttaaatacgtaattacagccctgacacattttgttactcacctctaaaagctgccaagtggtctgttatctttgatttgtgaatggtgagtggcttgattataaacaagagtggtttatttttccacactcaaaaatatatttatttttgaagttaatatcagtaaaatgctgtatgtgaatctgcttaagaatatgctttgtttgggaattttgtggcatgtgaaacaactttgtcccttaacaagctttctcttcccgcaatattaatgacacaatttacaatgccattagggtcattacacatggcagctcagaaattggaccagggtcaggtaggtcactgagaggaagagtaagaacacctgaccccttcagcgctccttcaccacttgataattatggacagggaaggtgtgtgtgagtgcgcatgtgcgtgagtaaataccaggagagcggatacccaggaagtgaggtcatgagtaggtattaaacaaatttctacttgtattcatgagtaggtgttaatcaaattaccttgatgtaaacagagaattccctggtttgccacagagtagaaaaaaattctcaacagtggttttcaacaagcagttggaacaacagcatcagcattgctttggaattgttagatatgcaaattcttaggccctgccctggaccttccgaattggaaagtctggaggtgatgcctcacgatctcttttaatgagctcaggtatttttatgcacgttcaaatttgagagtcattgttttgttttttcgtttgtttttgaggtggagtctcactctgtcgcccaggctggagtgcagtggtgccatcttagctcactgcaacctctgcctcccaggttcaagtgattctcctgcttcagcctccccagtagttgggattacaggcgtgcatcaccatgcctggctaatttttttttttttaatttttagtagaggcagggtttcgccatgttggccaggctctttcaaactcctgacctcaaatgatccgcccacctcagcctcccaaagtgttgggattacaggcatgagccactgcacccagccaagaaccattgttttaaacaaccttttttaaaccaaggttttttatgaaaatgtaggaacaccatgttctagggtagtttaggttcatataagcatatatacatatatattcatttatatttagagatgggatctccttttgttgcccaggctggagtgcagtggctcagtcagctcactgtagcctcaaactcctgcaatcaagcgatcctcctgatctcaagcaatcctcctgatataggcattttgattctggattttcaatatagataagtgttggaagaataacgaaaatgaccaatatttactgaagaccatcccaggccgggcactgtgctaagtattccagggacattattccactaactcctcacacaactcacaactaccccacgaggtaatacttgtttcccaattgtaaagtaaaggaacctgaggctcagtgaggttaagttccttgcccaaggtcacacaacgtgcagtgcctcttgccatgctcctgcactctgacttctgagcccaggctgtgaagcactgtgctatcctttgtttgtcctttgttagctgcagcactggttctgggggcaggatgacctttagctcttgggtattcaatttattggtgttccggaccattgctgccaaactcatttccagttgaagcagctgggttttgtcacacatatgactttgttaagtgtcctcagctgagctgaagctgcacagaaatcactcatcagattcctgccagggccaaagatatggatgaaaatctgcaggaagaaatgtctagcctgggattgcggggcggcaaaagtttccctctggagtcctatgaaggggttcttgtcacacatgtttactttcagtttgtgataaaaagtgggcatgctgggtttccagttgcaagcttctacacaaatggtagatgggtttcacagtcattgcagtgaggcacaaatgaccattgatcaactgcagcaaaacacaaaagtttcacatttgcatgtgaaagagttaagtctggtcccacatctgcaaatgggatctgcctccctcactgtaatatgtgaaatacaaaaatacagaaaattatgtttatatctgcaataatttttttcatcaataaacctcagagggctattgagaggtgaataaaaatgttccgtgactaagctgcaaatttcagttcaaagataaggaatgattgagtagagggtttgattaaaaacaccacaccggtgtttgcatcagaagtcagggttctagctagttatctcacttaacaattgtgtgacttggacaagccactgaataattccaaatagctcagtcatctcaatgctcatgtgaatggtgctccctgtagttgttcagtgcacagcttgtatagctgcgagctgcaaggtaaatatcatctaatagtgttaatcctacttactgcacgtcaaggttgtaagatggagggtgttgggatataggggcagattttcaatataataaatgtactatccaaatatactttttctgcctcagtttccttcagattgagacaagtagaagaacccagcctcttaggaagggccttgtgaaggtgacctttaattgctgatcgtgattctgcagctagaagttactgaaagtgatgtcctttttgcatacgtttattcacttcatgcactggtacctcctgtccattctccacatatggaacgagacatctcaggccaggctgacctctcctgcatgtaacttcccaacactcagtgtcagtccttgcccttttggcactgaatcatgacagcttcccgtttccctctacttggaatattagctgacgctagaggcttaacgagtacagagaccagtccccttttgctgattggatctcatcattagagatgttttaggaatgctttatatcacccaacaagggcttgggttacgtaggtgtctgcatttgtcagaactggtgagtctacacttaagactagcgcatttcattgtatcttaacttgactcaaaagaagaaaatctgtaaacacatgttgaactctgatgaataatgtgatgctgaagtgtgtgggggaagtgcactacatgcccattttactttgagatgtgtcaaaaatataagatggattagtggatgggtgtgggatgcatagaggcacccttatgtgagaaagcaagtaaagtgaaagttcatgactcaaaatcgtcactatatgaattgttttcgaatttgctatgttttaaaatgttttataatccaatattaggaaaaaaaagaatgttctaactctatgctgctcaaaacatgactttctttcatttcaagtgtcaagttttttgttttgttttttttttttttgttttttggtttttttttttaagagatggggtctcattctgtcaaccaggctggagtgcagtgcatgtggcatgatcctagctcactgcagactccaactcctgggttcaggtcatcttcctgcctcagtcaaggatgtttttggttttttaatttttttgagaaccaaaatttccccttcattactgataaaggctaaaatggaaggtatggctcagtgtgagggacaattgggctggctaactgaagggtggaattaagtagacaatccaccccattgcaggcagacctcacataccccagaagtagtgggctggaggtgggcctcaccaggtaacacttgcagtgcagcactctcaactgcggggagcaggcagatcactctctagaggaaaaagacaaggaataattttcaatttttacactcatgagaaaagaatacaactttgcgtaaaattaactaagctttaaaacttttctaccttaacatgcctgttacaaaagccatcaacagccagataggcagcttgtccaaaggcatgcattgggagaatatgttctgtatttcatgtgagttttaaatagagtttaatctgaatgaaaactttccatgtatttagaatatccatttctctaaatttccgttcttttactttttctttttaaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaagtgagcttttgtttttggggggagatgtttactacaaaattaacatgagtacatgagtaagaattacattatttaacttaaaggatgaaaggtatggatgatgtgacactgagacaagatgtataaatgaaattttagggtcttgaataggaagttttaatttcttctaagagtaagtgaaaagtgcagttgtaacaaacaaagctgtaacatctttttctgccaataacagaagtttggcatgccgtgaaggtgtttggaaatattattggataagaatagctcaattatcccaaataaatggatgaagctataatagttttggggaaaagattctcaaatgtataaagtcttagaacaaaagaattctttgaaataaaaatattatatataaaagt

SEQ ID NO: 36973 - DNA, 235821 bp, Homo sapiens
caggggcgggctgcggggaggggcggcgccacctcgcgctccgccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtaggtcagtttctcgcggctgtccacgcctggagttcgaggccggttcccgcgctgacgggttcccgccgggctgcgctcgggaggtctgtccgcgcctggttgggggtgggcgctcccgtcccgggcgtctcagaggatggtcgggtcgtggcgcggcgacgcagggctgcagccgagctcggcttcccggcggccgctggctgctccagcgctgcaggaagttaggcgttaaaagtaacaagatgttggcgtttgttgcacttcccactcgggtgccacgaccatgctggtgccgcatgcatcccctaccagatcttcagctgcgtgccttctcggtactttcgtgtgtccatgtgactttttaatttcctcctaacaagaggaggattgatgcacaatggaagtcacgcattgttcatgtgaccgtttcccaatgtaccgcgtggtcggttctacaagcatgaacgaatatccaagggagattctgaaactgaatgagagcgcagctgcacaatagactttaacaattcacttatcccgctgccctaatgattggcaggaggcattgaaaagggttattctgatttagtattagttttcagttcaagttgtcgtttttaggcagacggtattgtgaaatggaactgtgggcagtgtgatattcttagcttaaataaggttgcttgaatgttgcaaatgtggctattaggtgtctgtgaatagttaataatataattaaatcagctttaaaatcggtgatgtgttttccctgaaaacttcagtctttgccctgtaataggtgcattctggatttggagtttggaacctcctcacctctttactcagcatctgggaaataatttgcagattcgttttgaggggtagaagtatttgcagtctaaccccgatacaatgaattttttgcagcagtttgataggtataaattctgaaccacccccctccctccccaccccaagctggaattgtgaagatttcttaattacagcatagtaacaaaatccaccttttaattccctaattctaaaccactaggtgggctttgtctacagtttatagggggaaaagaggagaaaactgtcagtaacattcctttcttaaaatttaactattctttttcatttctcccaggcagtgtaactcttctccagcattgagcaacggatagtcaaaataggagttaactgccaaagtttgagtagattaatctgaaacatttgttatcttagtattttgtgaaggttgtttatgaaaatgatacttgctaaatatctcgttgtgaatcagcagaaacttatggtgggtggctaattcttctctctggaggctgctcatttttgcatgtattattgtagccgactttgattcagagcagtcaggtatgatttctctgtctctttttttttttttttaaattgagacagagtctcgctctgttgcctaggctggagtgcagtggcgcgatctcaggctcactgcaacctctgcctcccgggttgaagcaattctccggtctcagcctcccaagtagctgggattacaagcacatgccaccatgcccggctaatttttgtatttttagtagagacgaggtttcaccatgttgttcaggctggtctcgaactcctgaccttatgatccgcctgcctcggcctcccaaagtgctgggatttacaggtgtgagccacagatattatttctataaaagtattcctggccgggtgccatggctcacgcctgtaatcccagcactttgggaggccgaggcgggcggatcacttgaggtcaggagttcgagagcagcctggccaaaatgatgaaaccctgtctctactaaaaatacaaaaattagccgggcgtggtagtgggcgcctgtaattccagccacttgggaggctgaggctggagaatcccttgaacccaggaggcggagatggtaagtgaatggagatcgtgctgttgcactgcagcctgggcgacaagagcgaaactccgtctcacaaaaaaaagaaaaaaaaaaattctccccatcatttcctcaaaacaaggggaaatgatactgttttagaaccgacaattaggttgaagaatacagccagtcttttttgagtaataacatggcacaatgccggttaaatattaatacattacaaattttctccttgtggctttattttactcagagatacatctgtatatctgatcataatatttttaagtggaactgtgtcagtttcttacctcttgacattactggaagctgagcttttatacatcatatgttttcattgagaaaagtagtaggcagaaagtagaaatcagccaaatgaataacttagtggagaagagagaatatgatatcaagtgcgtgtgagaaacttgatatccttcagaaccttgtcagttcttccaagctgagtctgaactttggcaatcagagcttttttgatgacctagcaagttctctgaatttcctagaaagaggacaggttttagcactgcagtcaccagcttatactaacaattcatgaagtttaagaaaagacactgtcaggtaatctgtatagtgtatgtatatttatgattgtggtgtcatataagtatcttatgtgatgttcttggtctctagaaatgtttttcctcacgtggcctctgccactaattctgtgttggtactgtcagtattaagggggctgtgtgaggtgggctagtataagaaatagttttaatgctattactaggaagataaactaggtcgctcactttacttttatttatcagcctgcaagtaggaaattactgtatagtgaaagcagtctttaactgtacaatttcgtatcatgtgacaatggaaagtaaccacatgtttttactttgtgtttaaagtttttctttaaagaggtatttctgtgatgcataaatggtcagtattattatacatgagtttaattgagtttgaaagataattttcaaatgtgaaataattgaaatgggaaaattttaatgcatttttctaaaatttagggaattttgtcattaaaaggtaacaatcagcctccttgctaggatttttattactaaacttgatttgttaaatttgtagggttctctgctcttcatacctgctctgttttgaaacagtagtaaatagttttcagaatctgtcaaattgaagttcaaatcaggggtgcatctaggaattagtgcttaattgttaaagcagctaaaattatagcaccaaagttattttaaacaacttcattaagcaaagctatgaagcttatttaatttttactaattttaagaaacattaaaatttccaaccgaatatgggtaagataaatacctggtgatatggttggttttttattatgtccgtatggtatccaagttggtgtgggtatggaatggatatgaataagagaaggtaatgtaaatttatcaaatataaagtaaataataatttggtataaacattttatgatttcaatgctttataaaccattagatgacacataattgtggccaattctccatcatttctcctgtgggagatgaatgctttttattagggcacaaaaacttattgaggaagttagagaaaaagtttcactgaattaaaaattaagtgattaaaattttgtcttataacttaaaacgatacaggttagtgcttcccaaaataggctttataatttgctcctgttttccttaaattgccatgttttaggtattcttttcagttaataaataaagctttttaaaatgaggcactcaaaacataattcagattcaaattcctcagtgcttacacaggaacactaatgagaatcaatggcatttaacttttgcagctgaattgaattttataaaatacatagcaatgccaggtgcagtggctcacacctgtaatcccagcactttgggaggccgagatgggcggatcacgaggtcaggagatggagaccatcctggctaacacagtgaaaccccggctctactaaaaactacaaaaaattagccaggcgtggtggcgggcagctgtagtcccagctacttgggaggctgaggcaggagaatggtgtgaacccgggaagaggagcttgcagtgagcggagatcgtgccactgcactccagcctaggcgacagagcgagactccgtctcaaaaaaaataaaaataaaaataaataaataaaaataaaatacgttgcattatttcaccccttctacattctggctgtgactctactgttaatacttggcaagtaactttgcctttgggcttttcagttgcttcagctctagaatcagagtgttagattaatgaattcgtttaccaatgttcagtttctaaaacaagcaaaaaatgcatttgtttatgtcatcacaaatgtcagttttctgtatacataatatgtgtatctatgcacatgtgtgcataatgtatacacatgtacatacatgtaggtatatgattgcatcagagaaattactgattgctagcaactaatcatagttagagcaaataagtattttttttttgccattgccatgtttttatgtagttactttaatctttaataccttgctggtattaaaagaatataacgtcaggagaaaacacaccattaagcagctaactacaggctgggcgaggtggctcatgcctgtaattccagcacgttggaaggcaaggcaggataattccttaaggccaggagttcgagaccagcctgggcaatgtagccagaccacatctctataaaagatacaaaaattagctgggtatggtggcgtgcacctgtggtcccagctactcaggaggccaagatgggaggattgcttgagtccaggagtttgaggctgcagtgagccacgattgtgccactgcactccatcctgggcaattgactgagaccctgtttcaaaaaagcagctaactactttggagcgcagggctaagcacggtactggtttttatgtttttaagatttagtttataggatgtgtttgttcatagacatttaatttttctcattcaaatttctagcatacaatgtattttaaatattaatgtaacattcataaaatcagtatctgagaatttaaaaactaatcgcaacatatatttttaataatttttgaatagtctccctttgtctttattagagtatagggccgggtgtggtggctcacgcctgtaatctcagcactatgggaggccgaggtgggcagatcacctgaagtcaggagtttgagaccagcctgaccaacatggagaaaccccatctctactaaaaatataaaatagccaggcatggtggcacatgcttgtaatccctgctactcgggaggctgaggcaggagaatcacttgaacccgggaggcggaggttgcggtgaaccgagatggcgccattgcactccagcatgggaaacaagtgaaactccatctcaaaaataaaaagagtacaaatgctggctggatgcagtggctcacgcctgtaatcccagcactttgggaggctgaggtggacagatcgcttgaacctaggagtttgagaccagcctgggcaacacgatgaaaccctgactctacaaaaaatacgaaaattagctgggcatggtggcgtgtgcctgtagtcccagctacttgggaggctgaggtgggaggatcacttgagcccaggaggtgaaggttgcagtgagctgagattgtgccactgcactccagccttagtgacagaccctgtctcaaaaaaaaagaaaaagtacaaatgccatttggcaattgtgccagtcgtattttagatgcttcctgattttttgtgtgtgataaaatgtacataacatcaaatttgcccttttaggtttttttgttgttgtcgtttgtttgtttgttttttaaaaaagagtttcattctgtggcccagagctggagtgcagtggcatggtcttagctcactgcagccttgaactcccgggctcaagtagtcctcctgcttcagcctcccaagtagctggatctataggtgcgcaccatgacatttggtaattaattttttttttttttttgtagagactggggtcttgctgtgttgcccagactggtcttaaactcctggtctcaggctatcctcctgcctcagcctcccaaagcagtggggattacaggcatgagccatcacacctggcctgttttagccattgttaagtgtattattcagtggcattgcatacattcacattgtagtacagctatcaccactgtccatccccatgaccttttcctccatcccaaactgaaactctgttcctgttaaacattactccctatttcttcctcccttctccgagccaccggcaaccaccattctatgttttgtctgtatgactttgactattttagctgtctcatctaagtggaatcataccatatttgtccttttgtgagtgatttatttcacttagcatgatgtattccaggttcgtccatgttctagcatgtgtcagaatttccttcctcaatcgattgagacagagtcttgctttgtcgcccaggctgtagtgcaaagtggtgggatctcggctcactgcaacccctgcctcccgggctcaagccattcttgtgcttcagtctccccagtagctgggactacaggcacgcaccgccacaccaggctaatttttgtgtttttagtagagacggggtttcaccatgttggccaggctggtctcgagctcctgaccttaggtgatccgcccacctcaacttcccaaagtgccgcgattacagccgtgagccactgcacctggccaaaaagttacctgaatctgctgaaatttggagagcaagagcatggaaaatgagaaacacaatatttgggatttcaattttttttaatttaatgacttttttttttttttttttttttttttttgagacggagtcgcactctgttgcccaggctgaagtagagtagcacgatcttggctcactgcaacctctgcctcccaggttgaagtgattctcctgcctcagcctccccagtagctggaattacaggcatgtgccaccatgcccagctaatttttgtatttttaatagaggtggggtttccgtggtctgttggccaggctggtctcgaattcctgacctcaagtgatcgcctgccttggcctcccaaagtcttgggattataggcatgagccaccacgcccatccttccttttaaaggctaaattatattcccttgtatatgtcacgttttgtttttccattcatctgtcaatggacgtttaggttacttctcctatgaacatgggaatacaaatatctgtttgattccttgcttttagttcttttgggtatatacccagaagtagaattgctggatcataggtaattatgtgtttaatttttttgaggaacccccatacttctctgatgttttaagatttacagttgcatgttgttatatgtatgactaggtgaattgagcctggatgtctgagattttaacttttctaatacctttaagaactctattcctgaaaagggcacattgttaaatattttcagtttctggcactcaggtgaattggctcttattgttgaattttattatctttgatttctgtaggaatttttatcttggttctatagattttattttattttattttatttttttgagacagagtctcactctgtcacccaggctggactgcagtggtgcgatctcgggtcactgccaactctgcctcctgggttcaagtgattcttgtacctcagcctccccagtagctgggattacaggcatgcaccaccatacctggctaagttttgtattttttagtaaagatggggtttcgctatgttggccagggtggtctcaaacttctggcctcaagtgatctgccctccctggcctcccaaaatgttgggagtacaggcgtgagccaccgcacctggccaattctgtatatattaagctggaattttaaagaaaagtagcaagcagttcaaatgataaaataatagactccaaccaaatttaacaagtcatcgcccttggagttgttaagttttaaaatctttgtcaatatttcagaactgttggggccatagaacttatctactatattaagtggggattcagtggcatagactatcaagtatggtcaccagtttaagtaattttatgatatttataaggcaacaaaatataaattttctttcctcaaaagaatttaaaaattagaagtctaactttccctagtggaccttggaggagagaaaacataaggcaaaaatggtctcttatctcctgatttttgaagctcaaaatgttttccatctaattatttcctggaaaacattctcatggccatgaaaatctcattaatctaaaaacagagcttggaattgcgtgaatgtgagaagagcagctgaaaagtggtcttgaaaaataccatgtgcgctgatagaaatggctgcaatccattgtgaccagctgcatttgggaatgcttatcttcttcttttggcttaaacatcagagacaaagcgcttttctggaataagctctcatgatttggaagaatgtttttaaaaaatctgttcaacatatgaatttagatgattccttaaaaaatcaatcttgaagtttcttctaaatgtaccttttagtcagaaattaatggaaattaaatagtttacgaattaaagatgcatcaaattaagaaagtagttatcaacctcaatctgtgggggggtgttttaaacaatttctcccttttttgttatttttggtttttttttttttttttttttgagacagagtctcactcttgtcgcccagactgaagtgcagtggcgcgatcttggctcactgcagcctccacctcctgggttcaagcgattctcctgcttcagcttcctgagtagctgggattacaggtgcccatcaccacgcctggctaatttttgtacttttagtagagacggagtttcgccatgttgtccaagctgctctcgaactcctgacctcaggtgatccgcccgccttggcctcccaaaatgctgggattacagacaggtgtgagccactgggtctggcagtacaaatttttaaaaatgtgtttcccatggcttattagaaaaaaaaaactgttaattttatgtcactagatgtaccttttgtaaggcattgcctgtagacctccctacagggagactggattactttgttttcaaaggactaagtcctcatccatccgcccatccatccatccggttaactaatatttggttgcctactgtgttctaggcaccttgctagggatataataggggaacagaatagacacgaggcacttgttctcatcgagtttacagtctagggacagcaaaataaatgaccacactgatacccgtagactcatgtattgtggcaggttgccatgaggacttatcaaggagctctaggtgatattggagatggagagagcaagtcagaccactctccagaaatgtggatagtagtttatttgtacacttgtcttccttataacatttaaaagttctcctagtgtaaggcctggttttattcattagtggcatcggagtttagaacaatgcctagaatgtggtaagccttcaagtcattggctatcgattcatccccttgtgtggtattagaattagggaaggcgatgcaggcctggtggcaacagggaaactgcagcttctggtggctgtcatgttggacacctgatggtgggataactacctgaatgttcacctaagggttaaggtttcagatactcatgggcattctagatattcaagtctacatagacagcagtggactttcagtccacatttagtggatggttcttagatgagaaaagaaattgtgggctgggtgcagtggcgcatgcctgtaatcccagtgctttgagaggccaagatagagaatcacttaagcccaggagtttgagatcagccagggcaacaaagcgagtccccatctctttaaaaaaaattgtgatgaatggctttattccttggtttgaaacattttattagtagtttctttctttgtagtgtagctgaaaggaatataaagatcattttattataatgatctaattagtattgctgtcatttttaggaggttttctcaatttttaaattacagatatttctggagttgtgctattgtgcctgggtgttagagccaccgggaaagtattttgctataaaaaaatatttttgggctgggcatggtggctcatgcctgtaatcctagcactttgggagaccaaggcaggtggatcgcttgagcccaggattcaagaccagcatgggcaacatggggaaaccctgcctctacaaaaaaatacaaaaattagctgggcatggtggtgtgtgcacctgtagtctcagctactcgggagactgagttgagaggatcacctgagcctgggaggtcaaggctgcagtgagctgattgtgccactgcactccagcagtgcaggaaatatctatatatgtatttcaaaaatacatatttcagaaatatatatatttcaaaaatatatatttttcaaatatatttcaaatagatatctatttgaaataaatatatttcaaaaaagtatatatatgtttttgacatagggtctcactctgtcacacaggccggagtgcaatggtgtaatcatggctcactgtagctttgacctccctggcttaagcaatctttccacctcggcttcctgagtaactgactacaggcgcatgccaccacgcccagctaatttttgtatttttgtaaagatggggtcttgataggttgcccaggctggtctcaaactcctgggctcaagcgatccacctggcttggcctcccaaagtgctgggattacaaacatgagccaccatgcccggcctgtacttcatttttattaactcatttccaagaggaggtaagagaaggtgccagtctcctccccacccctgccattcctttctaaagttataaaagattataagggaaaagcagtgaaaatgcttgttagcattttggaatttatcctctaggtattgcttgtttggttaagtctaaagtttcatagtcagaaaatctttagagtgtggttgggctgcacaactaaactagttctgatgcatgtaatgtcaattgctttgaacatgtagtgtcagattgcttggaatatgtagtattaattgctttgaacgtgagagaatgtccaaattgctttaagaatatgatttagtcaaatgcctgtcttaaaactgatatctgtgggctttaggcacaaggcaacgtgagttgttgatttttccttttcttggtgaaatttaactggctctgttcctttctctttcttaaaaacaataaaacaatctctatgactgtattgaccccgtgacccattttttttctctcctaccatcctgtcttataggaagagtcctctctcctcctcaggcacctacaaatctgtcccttttcttattctggaaattggcagtcatcagataggagctctccccctggctccctgccccttaaccatcctcatcatgatccttgccgtctttcctgcccgccagccttggtgcagtgctttcttgggcttcagggccatccttctcttgggcttctcttcttcctcagctcctcagcaccaaggtttgcctctcttcctggctcttgccttacaatctttaaacatgcccaggtgtctaatatcctaaaagtgaagctgttactttctcttcagaaggaagttgctttaaaggagtctggtgcagtctcctttttatcccccattcactcctctgtttaccaaaacctatgtttttgcctgtctgaattccactggagatactcttggagctcgtcagtggccttcttctatttgccaaagcagctggtgttttcaggccttgtctttcttgccctttctttcgtacccatcccattccctgaaacacattcctcccttggtttcagctgctgccaccctcttctgtgtcccctctccactcttggtcgttttttgccagctcctcttccctggcctcctttgccttaaataaatgttgcttttctcccattgagggttctcatttattccattgattttaatgaccacttatatgatgataactcccactatttaaattattttattatttatttatttttagagacaggatctccttctgttacccaggttggaatatagtggtgcaattatagctcacagcagcctcgaactcctgggctcaggcagtcttcctgcctcagccccctatgtagctggtatttaaattctaacctacaggccgggtgcggtggctcatgcctgtaatcccagcactttgggaggccggggcgggcggatcatgaggtcaggagatagagaccatcctggctaacacagtgaaaccctgtctctactaaaaatacaaaaaattagccgggtgtggtggcgggcgcctgtagtcccagctacttgggaggctgaggcaggagaatggcgtgaacccgggaggcggagcttgcagtgagtcgagattgtgccactgcactccagcctggccaacagagcaagactccatctcaaaaaaaaaaaaaaattctaacctataactgctttcttgtacttaaactgttattgattaactactttctttttctttcttttttcttttttttttttccgagacagtttcactcttgtcgccgaggctggggtgcaatggcgcgttctcggctcactgcaacctctgcctgcctcccaggttcaagcgattctcctgcctcagcctctcaagtagctgggattacaggggcccaccaccacgcttggctaatttttgtatttttagtagagacggggtttcaccatgttggccacgctggtccggaactcctgacctcaggtgatccgcccatcttggcctcgcaaagtgctgggatgacaggcatgagccacccgcccccggcccttttgtttgtttgtttctgagacaggatctcgctctgtcacccaggctggagtgctgtggcatgatctcagctcactgtaacctcccgggttcaagtgattcttgtgcctcagcctcccaagtcgctgggactacaggcatgtgccaccacccgtggctaatttttgtatttttagtagagacagggtttccccatgttggccaggctggcctccaactcctgacctcaactgatctgcccaccttggcctcccaaagtgccgggattacaggtgtgagataccacgcccagtctgctagtttcttattgaacatcttcatctctgtttcccacaggaatctcaaattcaccacaaccaaatagagtcacatcttcactcatgttgtttattttctatcccatatattggttaatctccctgttatgtatctggtgtccaaggaattttgttcacccctgtgatcttggtgaacttcttattcaagtaccagtttacatttttctttctctgtatctaatcactaatgttggcagagagctagccactccccttctcctctgtgcagccactgttctgtgtacattgctgtacttgacacatgttgttgtggttgtcgtttgcatgtttgccctgttctggagggcagggaccatcttatccatcatggtacctccagtgcctataacagcccctattatcagtagatactcaagaaacatttgttgagtcaattttagtttcaatcccagcatttatgagtaactattatggtttatatattataatggactgtttaagtagataatagatttctttatttattcattttttgagacggagtcttgccctgtcaccaggctggagtgcagtggcacgatctcagctcattgcaacctccgcctcctaggttcaagcaattctcttgcctcagcctcccgagtagctgggactacaggtgagtcaccatgtccagctcatttttgtatttttagtagagatggagtttcaccatgttgggcaggatcaagttgatcttttgaccttgtgatccgcctgtgttgacctcccaaagtgctgggattacaggcgtgagccaaggcacccggcccaatagatttatttttatccttttcatatttattgtacagaacttgagaatttttttaatctttttttctgtaagcccaatatagtaagaatccaaggaaaatgttataaaaaacttcttgtatgttttgaagatacttcaaacattttttgattcattctttaaaggcatgaaaagaatattaaaccttttgtgtaatatgccagcaagtctagaccatcactccttgtttaatgtacatgattgaaaatatatttaaaaatcccctgtgataaatgccttattaattagacatgaagcttttttgtttttatctttaataacttaacattttccagttataaaatgcctttatagtgtaggaaatttggaaaatacaaataaccaaagaagacatttaaaaccattcataatttcaccacaggagtaaccactgttgacatcctgatatcttttccctctgtttctctgccgatatttagcaaatatatatagagcttaatctatataagtaccatctgtcctaacaatatattgcaatttcatagttttataaattatttaaacatttttttctttttctttcatttactattttttttgaaacagggtctcactctcacccaggctaaagtgcagtggcgtgatctcagctcactgcagtctcaacttcctgagctcaggtgatccttccacctcagcctctcaggtagcggagactacaggcgcgcaccaccatgcctggcttaatttttgtatttttgtagagatggggttttaccatgttgcccaggctggtcttgatctcctggactggagatccacccacctcggcctcccaaagtgctgagccgttgcccccagcttcttctataatatatttttattaaaaaaaatttttttgagacggagtctctgttacacaggctggagtgcagtggcatgatcttggctaactgcagcctcgacctcctgggcttaagtgatcctcctacctcagcctctccaatggctgggactacaggctcacaccactatgcccagcaaatttttttttttttttttttttgagacggagtctcactctgttgcccaggctagagtgcggtggcacaatctcagctcactgcaagctctgcctcctgggttcacgcccttctcctgcctcagactcctgagtagctgggactacaggcgcctgccaccacgcctggctaaattttttttttttttttttttttagtagagacgttttcaccatgttggccaggatggtctcgaactcctgacctcgtgatccacttgccttggcctcccaaagtgctgggattacaggcatgagccactgcgcccagcctcatgcctagctgattttttgtatttttatagatatagggtctcaccatgttgccaggctgggtcttctgtaatatttttaatggtttcatagtattaggtgaatgaacctttattgacggatctttaattttttgttctttctttctttctttttttgaggtggagtctccctctgttgcccagtctggagtgcagtggtgtgatctctactcactgcaacctctgcctcccgggttcaagcgattctcctgcctcagcctcctgagtagctggttttacaggcgcccaccaccacgcctgcctaatttttgtatttttagtagagatggagtttttttgccatgttggccaggctgggctcgaactcctgacctcaagtgatctgccctcctcggcctcccaaagtgctgggattacaagagtgagcaactgtgcctggtcctgattttttttctttataaataatgctacaatgaatataaatattgctaacattttaaaaatattagatattttaacaggtgaatgaatgcagaggggattaatataaaagctgattagcaaactgaagaaagggcattacaatcactgttagatgaagttcccccagaaatttactctgaaaataagattctgagtcatgacagagattctttacttggccaaactttaatcagacttctgaaccttctgttaggtccatctgtgcacttccttgtaaaatccggttttagcaagaaccctccacccttgatatctgatcaggttcctcatcttccaccatcccccaggtggtgtctgaccaccctggcctgtcttcagcaacaaccctgttagtttggtttacccagaatcccctttgcccctgatgtttcctctgagtacttttccacccactgaccctgaccctactccttggctataatcccacttgtccttgctgtattcagagttgagctcaagctctcttccccactgcaggactctcttgcagtggtccttgtaactaccacgggggtcctgaataaagtctttcctttcatgctttaacgagtatcactgaataattttttctttaaacagcctgagcctgggtttggcttcctgcagagtttataagagctttttactttttcttttttcttttcttttttttttttttttgagatggaattttgctcttattgcccgggctggagtgaagtggcacaatctcagctcactgcaacctccgcctcctgggttcaagtgattctcctgccttggcctcccaagtagctgggattacaggcatgtgccaccatgcctggctaatttttttgcatttagtagagacggggtttcaccatgttgatcagactggtctcgaactcctgacctcaggtgatagacccgcctcagtctcccaaagtgttgggattacaggcgtgagccaccgctcccagcctgtaagagctctttcaaagggaagctactgagcgaggccttgtgcgagcactggaaacaggccttagccaggctggtggcttggtagggctatagaagggaccagatgtgggatcctggatccaggaatttgttgggggattaggctgctcttcactttctgcctctgagctcacaggtatttctgaggtgtgggtgaaaggagaacacttctgaggggtggaattaggaccctcagctggacatgcagcaaaacatccttagcgtgtgggccagataaaccaaatatggataagagctaggccaggcccacagctagatatcaggggtttcccctcactctggggattcctttgctagttttctgtttctaatgtctttgctaatgtcttcctcttccttggttttttaattttggtgagctacacccctggtggcttcctgagaagtgttgcatgggaaataaatttacatactggtatattttaaaatgtccttattctactcctacttttgattggctggttatagaattggggattggaaataattttcctccagaacttttaggtattgctttgttgtcttttggatgcttatgttgtgatagagaagtcaaaatcattctgattcctgctcttttgtttattacctgatatcttttgttaccaaagttctaaaatttcatgatgatgtgctttcataggttctattttgtctgtagatcagaaatcttccagaattgttgggctctcattaggcctttcaatgctgtaagacttccttaaattcttttttttaagacggtgtcttgctctgtttcccaggctggagtgcagtggcgtgatctcagctcactgcaacctctgcctcccaggttcaagcgattctcctgcctcagcctcccgatatagctgggactacaggcctcccctaccacacctggctaaattttttttttttatttttagtagagatgaggtttcaccgtattaggctggtctcaaactcctggcctcaagtgatcctaccacctcggcctgccaaataaattctttattttctctgtctctctgttttctttttttagaacttcgtttcaatgtttgacctcctggaccaattctcttaacattcttttttttttttttgagaccaagtctcactctgtcacccaggctggagtgcagtggcatgatctcagcttactgcaacctccacctcccaggttcaagtgattctcctgcctcagcctcctgagtagatggggttacaggtgtgcaccagcagacccaactaatttttgtgtttttagtagagttggggtttcaccatgttgtccaggctggtcttgaactcctgggctcaagtggtccacccgcctcggcctctcaaagtgctggaattacaggcatgagccactgtgcctggccaacattcatcttttatctcccattttcttaacattttattttctaggagatattctcaacttattttccaactcttttattgaagttttaatttttgctatttttatttccaaagttctttttctcaagctttatttttttttaatagcatcttgtttttgttacaggacagaatgtcatttattatctaaggatattagttattattttttaacattttctttgataccttgttttctctaggttgcttttcttccctgtttggttttggtctttgtctttcatgtttaagagtggggagctagaaagttgattgaaaactgagagagtgggtgggccctgttgactgctaacttcattgtaaggtttgcctggcttgaccacttgctgggacctcctggtgtctctcttgtactttagggaatataaccagctaagtctcatagagggtaaagcctggcttgcctgcataagaaatgccgattagggcaagagggctggagacaagctgtttgctctgctctgttttgaaaccatgccttcaaaacccatccagtcaccagcctatacagcccatctcttttagcctcactggaagatgtatttaaccagtcccctgttgatgacatggagtggtttctaacttttccactattacaaataatgtaatctttataagcatggtttcaaaataatcttgtataagatgacagcaaaagtgaggggaaaaataaacattgaaataaaaatcttgtgtaaatgtttttgcaggatagatttctagaaatagagttgcctagacaaagtaaatggtatatatgaattttgaagtttatttgatattgccaaattgctgatctccacctgtaatgtatgaaaggttgtatgcatttatattcattttagcagtctacaggagtgctatttcctgcccatgccagcattgtttcttgtctttttttatttttgctaattcaatgggcatgaaaaatatcacttgtgtttgaatgatttttatttatttgattattagtaagaatgacatacttctgggaattgctatttgtaatatttgctcattttgacataaatgcttgaaatttggttgtaattttctatatttggtttggggcttgataagaaaatgtgacagaaaaaataaatttgtttacatatagccacttcagggcatttatctataatgagtttctattcagaatgattctttgcacagttttgaatgtgttagtttacatgttagtcttacactattcctatatgaatggtcatataggaaataaagtcatactttgactttatctctaattttgttttttccttttatgtctaatttttaatgtaataactatttgcataatactatgtatttgacagaatgctttcacatacataatcttacaacaaacagcttatgcggttggttgtattctgcagatgaggaaactaaggccttaagaagttaagagacttgcccaagtgtctcctgtactgcttcaataataataggaagggcaaggggtctcaggctcaagttctcaccctgcaacggatttattcagttgttgtgtctgtcttatcagctgcaaaatgaggattctttcccctttctgtattagcaggtgatatctaaaagctaattatgttcttaaataatagcaatgttattattttcttaatttagaaatgaacacagaagcggagcaacagcttctccatcacgccagaaatggcaatgctgaagaagtaagacaactattagagaccatggcgaggaatgaagtgattgctgacattaattgcaaaggtaaactttgaatggattttgtagctttctcttatgagtctgcactactcttagcatttatttaatgctaacctttcttatctatcatgtaattaatctctatctctcatgctaggaagaaccccacagattggaggaaatgtctctcctagccccctctgagtcagagaaagtgacataagaattttaaattcttaaaattgttatggatcccaaatattacaagccacaagggtggctctagcccacaggatacatcctattgagaggtgacagcgtgctggcagtcctcacagacctcgctcgctttcgggcctcctctgcctgggctcccactttggcggcacttgaggagcccttcagcccatcgctgcactgtgggagcccctttctgtgctggccaaggctggagccggctccctcggcttgcagggaggtgtggaaggagaggcgctagcgggaaccagggctgcgcgcggcgtttgcgggccggctggagttccgtgtgggcgtgggcgtgggcttggtgggccccgcactgggagcagccggccggccctgtcggcccctggcaatgaggagcttagcacccgggccagcggctgcggagggtgtactgggtcccccagcagtgccagcccaccggcgctgcgctggatctctcaccgggccttagctgccttcctgcggggcagggctcaggacctgcagtcggccatgcttcagcctcccaccccctccatgggctcctgtgcggcccaagcctcctcgatgagcactgccccctgctccacagcgcccagtcccatccaccacccaagggctgaggagtgcgggcgcatggtgcaggactggcaggcagctccacctgcagccccagtgcgggatccactgggtgaagccagctgggctcctgagtctggtggggaggtggagaacctttatgtctagcccagggattgtaaatacaccaatcggcactctgtatctagctcaaggtttataaacacaccaatcagcaccctgcgtctagttcagggtttgtgaatgcaccaatcaatactctgtatctagctactctggtggggccttggagaacctttgtgtccacactctgtatctagctaacctggtgaggatgtggagaacctttgtgtctaactcagggattgtaaaggtaccaatcagcaccctgtcaaaacagaccactcggctctaccagtcagcaggatgtgggtggggccagacaagagaataacagcaggctgccggagccagcagtggcaactcgctggagtccccttccacactgtggaagctttgttcttttgctcttcgcaataaatcttgctactgctcactctttgggtccacactgcttttatgagctgtaacactcactgcgaaggtctgcagcttcactcctgaagccagggagaccacgagcccaccgggaggaacaaacaactccagacgcgccgccttaagagctgtaacactcaccgcgagggtccgcggcttcattcttgaagtcagtgagaccaagaacccaccaattccagatacactatgataatttttttttcttcttgaagacattgcagttgacccagcaggtctgagtgtttactgtgtgtcttggagataatgatgaagagacacatgggatccctgcccttattgagcttagtctagtagattaacagatcagactagtctgcattacaaaataggtaccaggatctggaagtgcaggtgtcatgggagaggtgtgaaactggaacttgaaggatttgcttcttggaggagacgattctaagatgaaatgtgaaagagtaggagttaaccaggtgacgatagagaagaaaaaatggttcaaggaagaagaaacaacatagcagccaagtcataatatgccatgtgtagcaaagtggccaatacatcacaaccttgcatcaaatgtgcagagaaataaaacgtgttctcaaaatggctctggtattgtaataaacctcttcatgttctgggaggtatggggagagtaaacgttagtctttgggtacttctgtcttttttttttttttttttttttttttttgagacagggttttgttctgttgcccaggctggagtgcagtggcatgctcacagttcatggcagcctcagacttctgggctcaagcctttgtcccacctcagcctccagagtagttgggactacaagcacatgccaccacgcctggctaatttttgtatttcttgtagaaacgggatcttgctgtgttccccaggctggtcttgaactcctggtctcaagcgatcctctcatctcagcctcccaaagtgttgggattacaggtgtgatccattgcatctagccatactttttttagtagcctttttgataaagtcttgatctcccttcccctgtgtttcctctagcttggtgtttgagtgtagaggtgagacttgctgtgtgttcgtgtggtggagaggcaggttttcctcgaatctatgacttggctttgggtcctcagccacccttgtcttcctggtgctccttaagcattggaagctgacgtgaaactcaggtagaaagtcaaactcaggtctctcagtgtgtcgtgtggcataggtaaggctccttggctgtatcaggagactctcatgttggcttgtgttaccctctgtcacatcttcatctggcacctggcctaggcttgctggttcaatgcagacacactcctgttcccttcttgggagagtggcatgtgggagccaatgacatgggggaacctagagcagctctggttagccaaaatgcagccttccctcaggacaccttactgagtctgctttgatgtggcatctggcaggggagtgctaagatgggcgatctagggggggtcttttcctgcatcccggaagcagcttgcctgttctctatgtctcctcaatgtatcccactttccgagtttaagatccagagccacgtgtctcagcttttgtctttttttcttccacagttcctcagtcccagaaagggctggcttcaggtggatattttattctttttgctacttcctcctcctgtaccagggcagcaaacctcatgacctcaccctcagtggggaagaaatagcatctttgcaatagggaagaaactgtgatctgaggatctgggttgtctagaaactgaggtggtaaaaggaattttaaaatatctttgttatggagaatgatctgaggaaaaaatatttaaaaaataaaaaaatgtataaaatttccccccattcttcagcaaagactggctctttatctttacctcaggattctattttgaatgccaaaacatttgatcatcctcagtgacccttttctgtctccccttcccacctccacccatgtttgcctcaggctaattaggagaaagtcatctacttggaaatgtaaagctgagaaatatgttaatatttttttcaattttcacctcattatacctgtcagtcagactttatcttaagggcagtttgaagggttgatgcagaaggtgacatagtcagatgatatgcagttcttaagggagtggggaggggtgggcaagaccaggcgtgaatagtgtttccatgtggggggttccttcccggcatttcttggttttctttcctttctttcctgtttttccaaataatgacaaattgggaaaatggtataaattactataattctcctgcaagaattaaaggttaacagtcaacatagagatgttactgtttggaaggaattcactgatgtcaagttgaaagtgagggaaagaagggctgatgtgagtggaaagtgaaggttagtgtttttagggtctgggagaggaggatagaattagttttgcttgtagctggtgttgtgttacaagtatgtgttcatggtcctgtcttgcttgtgtgagtcattcttgcaaataaaataaatattaatacgtatatgcataacatactttttgtaaattctatgagtgatgttccaagaaataataaattttggaagcaacctaagtacttatattggcagtctcaacacacaattctgtgtagtgctgtcactttactaggaggtccaaatgtgaagttattcgaatattccccagtaatacctgctggtattttagtgttttaatattatgtatagtgtactgttctttgtaaatactccaaagcttgacatttcttattcattgaacacatccttttagataagtagttaaagatacctataagtagttaaacttaaaatactgtttgaagtattttaagagtaaatgtaggatcttggaaatttttttctttttttgagacatagtcttgctctgttgcccaggctggagtgcagggtgcaatcttggctcactgcaacctccacctcctcttgggttcaagcgattcttgtgcctcagcctcccaagtagctgggactacaggcgcccaccatcacaccaggctaatttttgtatttttagtagagacagggtttcaccatgttggccaggctggtctccaactcctgacctcaagtgatctgcccactttggcctcccaaggtgctgggattacaggtgtgagctgcagtgcctgactggatcttggaaattttgatttcttgatccagaatcctatttggaaatactagatgtgaggacaccaggtcacaagctgtcagaggaagtgagaggagacagtgtggtttggatgggggcagacgcagtggcaatggagaaaactagatgtaatgaatatttaggagttggagtcagtcgagctaattgagtgtggggtgaaaaggagaaagcaggaaggtgctgctgctgttgagtgaggaggggaatgaggggccacccattgtgaatacacatgtgggaggggcctggtggttcctgcgagtgtgtgtacggaggacgacaggtgagttcagctttgtgctttctgagcattgaggaacccttgcccagcccaatggagatgtctagtggacactttggagatggaaatatggattttgaagtcaacagcacagaaacaatggaagcagtggaagagggccatgaaatacctctttttttctttttctttcttttttttttttttgcgacagcgtcttgctctgtcactccggctgtagtgcagtggtgtgatcatggcttactgcagccttgaactcccaggctcaagtgatcctcccacctcagcctctggagtagctgggattacaggtgtgcgccaccacgcctggctgatttttgtattttttgtagaaatagggtttcactacttgcccaggctcatcttgaactcctgacctcaatcagtctatccgccttggcctcccaaagtgctgggattacaggtgtgagccaccatgcccggctgaagtaccatttttgaagttaccagtaatggaatagtcggggaaaataaattttccaaaggatatggaaaagtagtgccagagaaatgagaggacccacagggtacagggctgtggcagctagggaagaatgtggccatgctgtcctgtgatgcagtgatggcagaaacctgcccctgggacccagtgacagcatttcttgataaaaattgaagatagtgttcatgacctggtgggagatgagcctcatctgcaatgggtgggggttgacaggaaggaatgttaggtagaaagagccagtgaagagtagaatggggagggtgaggggtgcagtagctgccagggagcacagagtagggagggtttcatttatgtttcctctttagatgggagacaccagagttcttactccttcccatcagcaactaaagggggagaggttgaagacaggcaaaaaaggagggcctgagaagcaggaagggatgggctccaggatccagagagaacggttagtcttagacctcgggaggaaagtttagcagagtgcctgtagatataggtgggatggttgatttggtgctggaagcccagggaattctatgaaagctgttttctctgtgaagctgaatatgtcatttgctaaggtagagttgtctcggtaaaaggcttgaggagactagtgaaggactgaattactttttgttggaatatatgagagatgcttggacagggccttatagaagtgccttcagctagtgtgagatcctgagtttatggtgtgtaaatccacagggctctgttgtttttcttcaccgttggttagcgacctgggtgtggttatggagaaactgggctcgttgtacttctcaggctttggaggttttttaggctgctgtgacagatattatagtgaagccagaattttcaggatatgataaacgttgaagtgagggattaaagaatagacactgaatttattgaaggaagtgaagatggagggtatttacatatacatgaaagtcattaggcctggtgcagtggctcacccctgtaatcccaccactttgggaggctgaggttagaggatcacttgagctcaggagtttgagaccagcctgggcaacatggcaaaaccccatccctacaaaagaatccaaatattagccaggtgtggtggcgcatgcctgtggtcccggctactcgggaggctgaggtgggagagttgcttgagcccaggaggtaaaggctgcagtgagatgtgattgtgccactgcactatagcctgggtgatagagggataccctttcttgaaaaaagaaaatgattagagctgggggctggataagttgaaaagaaagtctgggggatagctgtgtggacaggctgggaagttgggagtgcttgggaaagtggctttctgtgttctgagtccaggggtgatgatggcgcccaggctgtggctctggcagtgggtccctgaccttaaacagaggcacagtttgtgagaaatgagggaagctgagaaagtgagagaccagggtgctgaataggcagttgaccccctgaggatggtggcaggatttgcaacggggtgaaagaatatgctgcccaaagttatttggtgaggggcaggccactgggaggctggcagatggcagcagagaaggcatgcacaagagctttggcttaatgacagaagcctcaaaggaggagctgtgatgtgagtggagaagtcatcaactaaaggcagtagtgggttttttgttgttgttttgagacagtgtctcgctttgttgtccaggctggaatgcagcggtgcagtcacagatcattgaagccttgacctcttgggctctggtgatcctccgccttagcctctggagtagctgagactgcaggtgtgcaccaccaggcctggctaattttttaattctctgtagagatggggtttctctatgttgcccagtctggtcttgaactcctgggctcaagcagtccgccatccttggcctcctaaaatgctggcattacaggcatgagccaccatgctcggccagcagtgggagttttgatgtggaggttcacacgacttctgttcagtgagggacaggggggatgggggaccccacctgaagaataagggggagatccttatcaggatgagctaggtttcactaagaacagaaagcaaaagataggttcagtgaaagagactgaggctctgggatttattgactgtgtaattaggggttccacaggacacacacttgagaggaaacagatgtaggagtttgggtaaatggcaaacaatcccagggacactgctggcagctgcagtcccttggagggttgttagaggcctgttgtgggtgtgctgaggttgttggctgaggtttctgtgggttcagatcctggaatccaggagctgagggcagtgtatcatgtaagtgaggtactgctatctacagtagctgtgaaaccatcgctctttccctgcagtggcccctggaataacatgttcttgggctgtaacagccccatcaaggcaggtgactttgggatttgatagggctgtatttgctacagtctgattgggaattttgggaagcttttgggcttcctcagctctaaatagtgctctgaatatcttttttgctaaattgaatctgtgattttagtttttgcaacactcagttgtttatgtctttcctcagctctactcctaagatctgacacttcattgtctttaacttcggtcctctctttcaccttggcaacccaatatcctcattaactgagactttatctgaagtcaaagactccactttcaggcactatctgtagagttcacagctttccaaatcgtattagtccattttcacactgctataaagaactacctgagactgagtaatttatgaagaaaagagacttaattgactcacagttactcaggcttaccaggaagcttgacagggaggcctcaggaaacaaccacacactttcagagagttcctgagaactcactcactgtcacgagaatagcaagagggaaatccgcccctatgatccaatcacctcccaccaggcccctgctccaattcaacatgagatatgggtggggacaaatccaaaccacatcacaggtgctgcaggaactatcctttactgactcttgatgtggtacaggtgtacagagagttgctgtgagctgccttcagctcctccataccctcctgatacaggttttcaaagagagttgcttgtcgtgaactatgtcaataaaacccctcttgacctgatgatggcaagatgattaaagactcggagccctagagtcaagaagctgctagagatcatctagctcgaatgtaacccccgtcctgtctccctctatccctttagaggtgaagacatcgagtcagaaggtggcaccagatctgcaccttgtgagttctcgtcctttacacccattacacttcttggtcacatatcttgcctctcacttatcagcaatgcattgcaaaggagattattgaggtagcttgttatggagaagttaatttcgttgtaaaattacctaaatatgacctaaaaataccttatatttttccatttttaggaagaagtaagtctaacttgggctggacacctctacatctggcatgctattttggacacagacaagtggtccaggatctgttgaaggtctatttatgactttaatttttaatgactacagtaaatattattgttatggaaattttaagatgaaagtcttagaaaagccacctgagccataatgacttatttaaagcaatagttcatcattcaagacacttaattgttctttattaaataaatacatgaattaggttagcctgattaattaaaattgtatgtttaatcattagatttttttattactagcttttaaaaataataaaagtaggcatattaatgaagattttattttcagttctgagtgtgacagttgaaaaaataaccaaagcacaccctaaataattaaaaaataatgtcaatacacaaataaaaattaaaaagaaaaaacaatgtcacaatctcttagcactgtatttaaagagaattgagagctcatatttcttaattctatgatgaataacttctcacattctgatagttctgaaatttgcttgcatcttacaattcatctgtacatttaaataatggcatcttttttcctcaaaacttattaaattgataaaggaggaaatgtggtatttcattcagagatcattctccttttttcaatatgactgcttctaaagtagagtgaaggtgtatggatttttttttttttttttttaatcaagacaaggcctcactttgtcacccaggctggagtgcagtggcgtaatctcggctcactgcagccttgacctcccaggttcaagtgatcctcctgcctcagtcccccaaatactggagctataggcacgtgcctccacacctggctaatgtttttctattttttgtagagacggactttcaccatgttgcccaggctggtctcaaactcctgagcacaagcaatccgcccacgtcagcctcccaaagtgctaggattacaggtgtgagccactgcgcctggccaaggtgtatagatttttagtgaaaagtacctttttactttttatttttctacctatcaggtagatttttacctttcagaaaacctaccatatatacactactatatgtgtacatatatatatatatatataagatggagtctcgctatagtgccagactggccttgaactcctgggctcagatgattctcctgcctcagcctcccaagtagctgggactatgggctcaaaccaccgtgctggctttttattgttactttaaatttaatttattgttagtactgacacctaaacaatattaacaattttaattttttaaggccttaatatattttgaaggaatgattttcaccattgtatatttcttggtatttaaagtggtcatgtttactaggctggtgcagaagtgaatgtgttgaatgacatgggagacacgccgcttcatcgagctgcctttacaggacgaaaggtgaaaatcattctatgttcaatgtttgtaagtgaggtatttggaggagtagttaccattgttttctctgttataaccatctgaccagcaaccgaagaaagccacacaaaaaaatgtatacaccagcactttgggtcaaaaggccacaggatctttgagtctgacagtgaggtccagtactaaggtcatggagacccccactctgtagcatccctgtgaggagatcattccgtttctgcttgtgtactccagcaatggggaactcctgattattcttttttttaaaaaaaaaatagcttcattgaggtataacttacattgcataaacttcacctgtgatattgtgaaatatatatttggtctttgaccttgtacactaaagatgtacaaaaagatggctggcaacccctaggtggcttcaggatgggggctggtcaccagaaagaccaaggcaggactagggggttgggactttcagccgaactttgcaacctccagggagggtagaggggctgaaggggaaatggctcgctaatggccagtggtttcatcaatcatgcctatttaatggaacctccataaaaacctgaaaggacagggttctaggagctcctgggtagctgaacacgtggaggttcttgaatgatcacacccagggagggcatgggtgctctgtgcccttcctccatgccttgccctatgtatctcttcatctgtatcctttgtaataaagcagtaaacatgttttcctgagttttgtgggctgctctagcaaattaatggaacccaaacagggagtcatgggaaccctaatttaaagaccatcagtcagaagctctggaggtctggacctgcagctggtgtctgaggggtggggagaagtgctgggactgagccctcacctgtgggattaatgctatctctgggtagatagtgttggaattgaattgaaggacacatagctggtatttgctgcagaactaattgcttgcttggtggtggggagaactgcccccacccatatttggtcacagaagtctttagtgttacttgctgtagtaggagagcagaggaaaagcataatttgatcacatattgtaagtgtgcattttagtgatttttatacatttacaaaattgtgcaacatcaccaaaatccagttttagaacatttctgtcaccccagaagtttcctcatgcctgtttatattcatccccttcccctttcccatgccccagggtaccactgaattgtttcctttctctagatattagatatttgcctttcctaaactttttttttttttttgagaccgagtcttgctctgtcgcccaggttggagtgcagtggtgtgatattgattcactgcaacttctgtctcccgggttcaagcaattctcctgccttagcctcccaagtagctgggattacaggcacccgccaccatgcccagataattttggatttttagtagagatggggtttcaccatgttggccaggctggtctcgaactcctgaccttagaggatccacccacctcagcctcccaaaatgctaggattacaagcgtgagccaccgcactcggcctaaacatttcttgtaaacagtatcatacaaacttttgtgtctggcttctttaatttagcataatgtcgttgaggttcatccatgctgtagcatgtatcagtagtttggtcttttttatggctgaatattccactgtatggatacaccatcttttgttatctgttcaagttttattgaaaagactatctttttgcattgtattgcctagatacctttgctggaaatcagttgaccataatttaaatgtttctggatttttttttttttttttttttttgttgttgttttttgagacagggtctcgctctttcacccaggctgcagggcagtggcacagtctcagctcactgcagcctccgcctcccaggctcaggtgatcttcccctctcagcctcctgagaagctggaactacaggtgtgtgccaccatacctggctaatttcttgtatttttagtagagacggggtttctccatgttgcccaggctggtctccaactcctaggccacccacctcggtctctcagagtgtcgggattacaggcatgagccaccattcctggcctgaagttttcaacatagagatcttgcagtccttttcttaaatgtattaaccagcctggctttaatctgtggaatctggactgagtctggccagctaatatatctgctgagttaaaaaaaaaaaattaaaaaaaaattgtttgtttgttttagagacaagtctcactatattgcctaggctggacttgaactcctgagctcaagtgatcttcctacctcagcctcttgagtagctgggactgtaggcatgcacaactgtgcctggctttcagcatagtattttaggattcatgcctgcatctgtgtagcctagtggtgagcctgtatttgagcagcagtgggctccattactcaatccccttaggcttctgtgctctgccctggatctatgtgtaggctggagagtgctttcagagtccaggcatttctcgcttcttcctctgctctgacttttgcaaggccccctctcctttctcctgcaaatgtgtggagtttcccagcagcctggggtacctgggaagctcacctactcctactccagttcttttgttttcagggttgtctcattaagttttaggctgttttgccatttgcctgtgtggtaggcagaatcatggccctccaaagacatccacatcctaatcccccaaaacttgtaaatatgttagattacacagcaaggggaagttaaagttgcagatggagttgagattgctcatcagctaaccttaaggtaggaaaattattttggattatctcggtgggcccattgtaatcacaggtgtccttagaagtgtaagagaggctggacacagtggctcacgcctgtaatctcagcactttgggaggccaaggtggaaggatcacttgagcacgggagtttgagaccagcctgggcaacatagggagaatcccatctctaaaaaaaaaaaattgcctggtgtggtggtgtgcatctgtagtcccaactgctcgggaggctgaggttggaggatcacttgagccggggaggtcgaggctgaagtgagccatgatttcaccactgcactctagcctgggtgacacagggagaccctataagaaagaaagaaagatagaaaggaaggaaggaagggaaaagaaaagaaatagctggatgtggtggcatactcctgtaatcccagctactcgggaggctgaggcaggagaatcacttgaacccagcaggcagaggttgcagtgagccaagattgtgccactgtattccagcctggacaacacagcgagattctatctcaaaaaaaaaaaaaaaaaggaaaaaaagaaaaagaaagaagtgtaataagagggaaatgtgcttatgagagattcgtcagagagatacggtgtttctgccttagaaactgcaggaaagggggctgtgagccaaggaaggtggacagtctctagcaacgggaaaagcaaggaaatgaattctcccctagagcccttgcaacaccttgatttttcccaacaagacctattctggacttctcaaatacagaactgtgaggtaacacatttctttctgttgttttaagccaccgagtttgtggtcatttgttatagcagcggtagaaagctagacactctaatagaaaaagcagcctcatgctagcaagcatgtaggtgttctcatttgttttctgctgtatttgctacttttactgggtttttgccttttgttttaaatcaagtcatttccctctggcagcaaaactgctgggtttcactgccaggcctgccctggtcagacttgtttggggaggtggggaggactaatagcctgtggctagaaagctaaagactcccagtgttcttcctccaagttcctgccattcctctggagtaactgcctctcagtttgtttctttaatggatatccagcaccacaaaatggttagttttgacaattttgtccagctttatgctcattttttcaggataacagttgtcttatcctttcatagctaaaagttgctttaccccatattaatgtttttttgattatttaaatgatatgcaaaattaactatgacatagagtgtatttcttgtatattctagttgttgaccatagtccaacatgatacctaaaggttatttcgtaagcacgtgattggaagctttatgtgaatttatcatgagttaaagaacaaatttattattatattgtttcacacttttcattattctaatgactagatttaactaacttttaatacgttaccatgagtcaattctgtatgtgctaagcatgtttgaattagtacattttataccactcttgtctatttgttcataaattgatacttgtgaaccagatatggagtcttaactcaagctgagaaaaaagaaccttttataataaacaataaaggttgtggttaatttctatgcttgactttgtggggtttcaaatatgagctgcagatggctcgatttgcctgactacgtgaactacttgctgtttttttttatggtcttgctcattcttttctatatacctaagaaaattctattgtcatctatttctacatggcccagatctacccattcaaagtgctactcaaatgtaatatccataaattctttcctaacatcttgcagctggaaggaaactatactcttccaggattcctgggcacagtacagcactttcattcgtcttctaccttgtattagtgttatttttgtctatgtctttttttttttttttttttttttgagatggagtctcccattgtcacccaggctggagtgcagtggcacgatctcacttcactgcaatctccgcctctcgggttcaagtgattctcctgcctcagcctcctgagtagctggaattacaggcatgtgccaccatagtgtgtatttttagtagagacagggtttcaccatgttggttggccaggctggtctcaaactcctgacctcaagtgctctcaatcccaaagtgctggggttataggagggagccactgcacccagtctgtagtctgtgtcttaactctgctactaagttgcattaatcttgctagcaaggaattatcatgtcttgttttttgtgtccccatgagcacaaggtaagttttacctcccatctctgtaatcacctagatcaaataagttcatttatctatgttcagctctttacatatttggccatttctgctattttcttgaactttgaacgtgagaccatgctaaattgagccttagtttgacatgagcatcagcatatatacagtaagtcctcacttaatgtcaatgatagatttttggaaactaacttttggataaacgatgtataaggaaaccaacttcaccataggccaatgcatataaacaagagttaagttcctacagaataattatagtcacaaaaaaacatcactgccaggcatagtggcacatgtctgtaatgccagcactttggggcgctgaggcaggtggactgcttgagcccaggagttcaagaccagcttgggcaacatagggagacctcacttctacaaaatcaaaaattagccagatgtggtagcatgcatctgtagtcccagctactcgggaggctgaaatgggaggatcacttgagcccaggaagttgaggctgcagtgagccgcagttgtgccaccacactccagcctgggcagctgagtgagactctgtgccaaaaaagaaaagaaaattaccacacttctaaatgaagagcaaacacttctgatattaaacattgaaataaatgtgagctattcatacatttagaaacattagtaaaaacaagataattatttacccatttattccagttcaggtgtgagggtggctggaacctatcccggcagctcagggagcacagggggatccaggcctggagaggatgcatcttgtcacagggccactcacatacacacccacactcacactgggacagttcagacatgcctgttcacttgctatgcacatctttaggaggtgagaagaaaacagagtacctgagatacccacgcagacacaaggacatgtgaactccaacagacattggccccctccaagaatcgatttttttttcttgtgaacattgcaatgaaatgatgttgaatgaaatggtgttgtttgaagatctgctgtattttgttatctgttgtcttagaaaataacatttagctgaagttacatgattgtgttatgtaggaaacattaaaattaaaaaatgtatgtgctcaatatctaagcatgactgaattgtgcaaagagtttggtttctaattctcatgaaaagaatcaagttatctcattcctatgtgatcatttaccatgaagataattttaaaatatcttatgatcctgtgattcagtaagtagaatgttgagttgaaaagggatttggcttattataaagcactttaaactcttatcctctggaatatttaaaaaatgcagctccccagcttggcacggtggctcatgcctgtaatcccagcactatgggaggccaaggcgggtggatcacctgaggtcaggacttcaagaccagcctggccaacatggtgaaaccctgtctctactaaaaatacaaaaaaattagctgggcctggtgtcgggtacctgtaatcccagctacttcaggaggctgaggcaggagaatcacttgaacctgggaggcggaggttgcagtgagccgagatcgcgccatcgcactccagcctgggtgaccacagcgaaactctgtctcaaacaaaaacagaacaaacaaaaaaatcatgcagttccccagctcttgaggcacctttgggcttttcttggtacattagtgccccctagtgttctttggtaaaaatcagaataccagaattttaaaatactgtgtttagtatttgttccttactttactttcagatgcagttataaagtttttatgccttttataatcaatttaaaataggaatatggtatgtataatgaatatttggattgttgcactgaccttttagcagaattgagaatacttttatttttttttaatttttatttatttatttagatacaggatctcactctttcacccatgctggagtgcagtggggccctcatagctcactgcagccttgaacgtctgggcacaacagatccttccacctagaactatacgcgtgcgccactgtacctggctaatttttaaaaatcttttgtagagacagggtttcaccgtgttgcccaggctggtcttgaaccttaagcggtcttcctaccccagcctcccaaagttctcggatcacaggcatgagccaccacgcccagctgagaatgcttgtaaaacacatgcttccagagccgggtgtagtggctcacacctataatcccagctacacaggaggcgaaggcaggaggatcgcttgaagtcaggagttagaggccaacctgggcaacataacaagaccccctcttcccgccccccaccatatctctctctttctctctctgtctctgtctctttctctatagacagggtctcgctctgtcgccaaggctggagtacagtggtgcaatctcagctcactgcaacctccacatccagagctcaagtgatcctcccaccctagcctccccaggaattaggaccacaggcatgtgccactgtacctggctaattttctgtattttttgtagggacagggttttgccatgttgcccaggctggtctgaaactcctgggctcaagtgatctgcctgccttagcctcccaaagtgctggggttataggcatgagccaccgtgcccagccaagaccccatctctaaaaaactcaaagctggatgtatggcatgtgcttgtagtcccagctactctggtggctgaggcaggaggatcgcttgagccccaggagtttgaggctacagtgagtgagctatgatggcaccaccgcactccagcttggatgacagagcaagaccctgtctctaaaatagtaaataaacaaatacaataaatgcttcctatgttctgtgtctcagaaattctctctatctcacctaacatacagaatatatgtataatcctgggctttaggatttcctaggagaccatttctcatgtttatgtattgaaggcctactgtgtttcaggcgatgcccagacaacttgacacgtatcgtttcatttgatggagaatgactgccttgaaatatatacatataatttgttctagatctgttctcagggaagctgagatggagatgagtgggcagcaggtttatggagtgctcgtggcatcacacctgtgcacgagggtggggaagaagtggacaggagtggacaagtcaagtagtgctgccggctcaagcgatgcctcagcctttctgctgtgtgcgaagctttgcagaggagatgatgcttcaaagttgtccctgttggggatgagcagccaggcctttatacactgggacagtcagtcatggatacgtggatactctggaaaccctcatccctggaggtctgagcccctggataccatgcccttcttaggctggagttgctgcccttgtccatttaccataaaaattggacaagagaataccaggacacacctgagtttctcatcgtatgctaaacctgttcttccacgtacatccccaatgtgtacagccctacttttttctgctgatcaagttcaattacttctgctaagatggtgactattcttgcctgctggtccttggatgcaaggaccccaatgttcaggcagcctttggtgccttctagcatacgaatcagagcattatctttaggtgtggaataagctgccccaaaacctgttgaagccaaccaggcactgtgctcccttctgttatgggaagtgcaagatgcagtaatttattcttctgaggaagtgtcttgtcattgcccagaccagtgaacttctaaaaatttactgacatggaaaagctcctgaattcttcctaagttttacctcccacccactggatcagatatgtcttaccaaggctttgaacatcctagcctcgtggagaagaagcctcttctcctggttctgttagcatgatgttatgaaaggaaattaaattttgggaccccaaactcattttgccaaagggaaaaatcaagctgagaactgggtcatgcaaacctgcctcccccttttggttcctaaataaggtggctacaagaggaaaagctacatgcctcccccatattttgctcacaaggaaattcctagtgagcaatgcaaagtgatagcttatctttacaggtgcagtcacccaggcccaccacacgcaaatgcatatctaattgttcccctgccccattttgtctgtgttatgtagaatgcagattccctacgtttttcttctgccccgtttatgtcatcttatgtaaaaacatgcagattcatggagccagacaaaggcatgactatcttttcccacccacccccttacctgaaaattgtgtacttctcaatatcctgccctttcccctttaaatttgaagccctcaaaaatcatcttcagagaaagatgtctgtctcctgggtgcgtgtccttaactttggcaaataaatctaaaatgattgagacttgtctcatcatttttcttgattgacaatgttattgataaagtggaccagtgtgatttgctgccagattcccagatggcatgaggcggaagctgtacatgtatactcttgtccatgtgaatccaaactgtctttgattttttttcctaatagggatagaaaaggtacatttgccctatcggttgctgcttaccatgtacctgaggtggcagagtggctataattggggtcactatttggttgagtttctggaagttcagtgtcatcctccacattccatctgggttttatagtggcagatgagtgaattcaatggaaatatgatagggaccatggcccctgcattctcttaggtttttaagggtggcactgatttctgccatcccttcccatatgggatattggttttgatatgtcttggccatggctgggggtgagtagccacttccatttggctcctatacaatagaccaagatggcaatgtgagggttgtaccaacaactaagtgtgtctattccaatttcatattcagggactaggagaatgaccactaggtgtatttctggacccaaccagcacccgcaccgtgagccagacctcagccagggcgccatttatcatctcactcccatgcatgccccctttctaacacaggggcctcatgacattttggatctcttggtgtcagtgccagtttggaccttagatctaacagcttgtgagatgtcttggtgatccgctttctccactgtatagtttcttgagtaaatgatcattggtccctttgggaatggtcgggggaattcacgacagttcatgtttgctttggtgttgcagaatctttccctggaggatctggcctctccttcagtaaatagttctatgtccaaagttgactcaggtccagaaactggacaaggtatcataacttttttttttttcttttgagatggagtcttgccctgttgcctaggctggaatgcagtggcgcgatctcagctcactgcaacctctgcctcccaggttcaaggaattctcctggctcagcctcccaagtagctgggattacaggtgtgtgccaccatgcctggctaatttttcttttctttttttttcttttctttttttttttttttgagacaagagtctagctctgttgccctaactggagtgcagtggcatgatctcagctcactgcaacctctgtgtcccgcgttcaagcaattctcctgcctcagtctcttgagtagctgggattacaggcgcatgccaccatgcctggctaagatttgtatttttagtagagtcagggtttcaccatgttggccaggctggtcttgaactcctgacctcaggtgatctgcctgccttggccttccaaagtgctgggtttacaagcgtgagccactgcgctcagccggtatcatgacttttaatggggtgactctcttctgcctcttacctttcactgttgatatcttttgatggtgcagattgagttgtacttggatgggtcctaggatcagggaaaaagaaatggtccccattaagagatgtcaagaggccagaagtgccatgaaagacaggttttttgttgttgctgttttttgttttttgttttgagatggagtctcgacctgttgcccgcgctggagtgcaatggtgcaatctcagctcactgcaacctccgcctcccgggttcaaatgatctcctgcctcaccctcccaagtagctgggattacaggtgcctgccaccatgcccagctattttttgtatttttagtagagacggggtttcaccatgttggtcacggtggtctagaactcctgacctcatgatcctcctgcctcggcctcccaaagtgctggggttacaggcgtgagccttaataagtgggcatgctagattggctgtagtatgaagtccagaaaacatatcaggtaattaaatgccatggaagggcttagaggtcctatcatttaccaaagcagaagaaattgctggtgagaaaggcaacagcctcacggagaagctccctggcaattccccttcagggtctggggctgctgtgagaatgccactgtggacctgagttcactgacagcaaggggtggtgtggggaaagtgattggaccccaaggcagtagaagccaggagaggcagcacttaaccatcaggagccaggggggcacagttatggtaatgagtggcaggttcagcagggaacagtgggagggctgacctgcagagttaaggaaacggttaatagaactcagcattctgaagggcaaagttagatggacaaatggtagcagatactactttcatcatctttttctttctttctttttttttttttttttttttttttgctatattgagaaactactgccttgtactacactgatgtcattatacagctattgggtgctcagttctgtttcttcttttttctttcctttttctcttagagtttggctgatttctgctgacctgtcttcaagtttactgaacgttcctcagtggtactctgatatctactgatgagcccattgaaggcatcatttatctctgttgctatgattagctgttgctatggttacttccagtgcacctcaggcttcaccttccttcagtttccaaattcggtgttacctctgcagagggcacaggctgattcactggaaggtgttcccccgtgttcctgcttcaccctcaaccttaggcctgccttgtgtgcctcagcgggttctctccacacgttggcttctgtccgctaagagactgctgttgcctgttctcagtagttgctagtcttggggtaggagtagaggatgtgagctgggggttctctgttatctgggtctagcctccatcctagttctgtgtccttgcttaaggggaaggagaccttgaggtggttctttaccacttccagaagtacctacttttaatactgttagttttaacttgagttttttttttaacctcctgtttatagataacatagttgtcactaattgttgtttttctttttttaaattttattattattatactttaagttttagggtacatgtgcacaacatgcaggtttgttacatatgtatacatgtgccatgttggtgtgctgcacccattaactggtcatttagcattaggtatatctcctaatgctatccctccccctccccccaccccacaacaggccccagtgtgtgatgttccccttcctgtgtccatgtgttctcattgttcaattcccacctgtgagtgagaacatgcggtgtttggtttctcgtccttgcgatagtttgctgagtatgatggtttccagcttcatccatgtccctacgaaggacatgaactcatcattttttatggctgcatagtattccatggtgtatatgtgccacattttcttaatccagtctatcattgttggacatttgggttggttccaagtctttgctattgtgaatagtgctgcaataaacatacatgtgcatgtgtctttatagcagcatgatttataatcctttgggtatatacccagtaatgggatggctgggtcaaatggtatttctagttctagatccctgaggaatcgccacactgatttccacaatggttgaactagtttacagtcccaccaacagtgtaaaagtgttcctatttctccacatcctctccagcacctgttgtttcctgactttttaatgatcgccattctaagtggtgtgagatggtatctcattgtggttttgatttgcatttctttgatggccagtgatgatgagcattttttcatgtgttttttggctgcgtaaatgtcttctttttagaagtgtctgttcatctccttcgcccactttttgatggggttgtttgtttttttcttgtaaatttgtttgagttcattgtagattctggatattagccctttgacagacgaataggttgcaaaaatcttctcccattttgtaggttgcctgttcactctgatggtagttttttttgctgtgcagaagctctttagtttaattagatcccatttgtcaattttggcttttgttgccattgcttttggtgttttagacatgaagtccttgcccatgcctatgtcctgaatggtattgcctaggttttcttactagggtttttatggttttaggtttaacatgtaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcagcattatttctgaggactctgttctgttccattggtctatatctctgttttggtaccagtaccatgctgttttggttactgtagccttgtagtatagtttgaagtcaggtagcctgatgcctccagctttgttcttttggcttaggattgacttggcaatgcaggctcttttttcgttccatatgaactttaaagtagttttttccagttctgtgaagaaaggcattggtagcttgatggggatggcattgaatctataaattaccttgggcagtatgaccattttcataatgttgattcttcctacccatgagcatgaaatgttcttccatttgtttgtatcctctttcattgttgttttatttttctaattttagattttctgttggcttatctctggaagataagcaattttttctgctctttgtctctcccattctttttgtttgtttgtttttgagacagggtctcactctgtcacccaggctggagtgcggtggcacaatcactgttccctggagcctcaatctcccgggctcaagcgatcctctgacctcagcctcacagctaggactacaggctcatgccaccatgcccacctaatttatatgctttttgtagagacgaggttttgccatgtttcccaggctggtcttgaactcctgggctcaagtgatccctgcctgagcctcccaaagtgctaggattacaggtgtgagccaccgtgccagcctgtttctcccattcttaatccttgccaaagctacttcacctttttcattctcttagcctatgactagattttggttaaataaatattgagtttatgttattctgactgtgctagcttgagccacttaggggcctatgtttgtttgttttggtataacgccttattttttctggagttaacaattgcaggctgggcacagtggctcacgcctataatcccagccatttgtgaggctgagatgggcagatcacctgaggtcaggagttccagaccagcctggccgacatggtgaaaccccatctctactaaaaatacaaaaattatctgcgcatggtggcacacacctataatccccgctactcaggaggctggggcaggagtatcacttgaacctgagaggcggaggttgcagcgagccaagattgtgccattgcactccagcctaggtgacaagagcgaaactctatctcaaaacaaacaaacaaacaaacaaacaaaaaacaattgcatggggtttcttagtttagttctttttctcatcacgtaattttaaagtctttgtaagagctccaaaggtctttttactgtcttttactatgatcatatatgtcatgtaattatcccttctgggagcagctctcctgatttttttatgtcttttttttttttttttttttttgagacagagtcttctctgttgtccaggctggaatgcagtggcacgatctcagctcactgcaacctttgcctcccgggttcaaaggattctcctgcctcagcctcctgtgtagctgggattacaggtgtgtgtcaccacacccagctcatttttctattttttagtagagacagggttttaccatgttggccaggctggtctcgaactcctgaccttaaatgatctgcccacttttgcctcccaaagtgctgggattacaagtgtgagccaccgtgcccagcctgattttttatgtcttcttgctctgcctagactagttggcctccagagctgtacacatggtggtcattctggagcttatgtcttagtcattctgggaattctcttcaccactttctgatattggatttcctgtttcctgggccccatgtcttcctccatcttgatttgtctgtcatttggtggcgcacagccttcaggagcttcttgagaaaggttgcatgggaaatattttttttgagaattcttatgtctggaaatacctcttacctttgtatttgagtgatagtttggctatgtatagatttctaggttggaaatcactttctctcagaattttggaggtattgtgtcaccgttttctagcttttagtgttgttgttgagaagtctagtgctattcttattcctgttcctgtgtgtgtgacctgattattatttaatcactggaagtatataaattaaaattagaatgacaggctgggctcagtggctcatgtctgtaatagcagtgctttgggaggctaaggagggaggaccactttaggccaggagtttgaggccagcctgggcaatatagtgagaccctatctctacctacccccacccctaaaaaaagaatgacagataacctaatacagtgacttacaaaaaaagttagtttatttctctgtaacctaaaagtctagataagtggtcttgggcaggtggcaaatactcaaatactcagatttcttctgtcttaatgttctacaatgtgtggctttgaccatatcatcccaattgggagcatcccaatcccaggaagcaggctaggggaagcaaaaaagggacaaagaatatatacagactgccccttctagaagattcccagaggctgttatatgagacttctgcttaatcccattgactcgaatattcatggccacactagctaaaggggccacactagctaaaggggagcgaggaaatgtagtctttattcttggtggccatatgccgagctaaaaaatgttcggggtcagatgggatcttcccttcacccttggtgtcctagaattttactgtttacctttagacttttaaacctgcgaattaggtttctattgctgcataacaaattaccataaatttagaggcttaaatcaacacccatttattatttcacaattctgaaggtcagaattccaagcacacagcctagctgaattctctgctcagggaccgtgaagactgaaattaaggtgtcagctgaactgtgttctcatctgtggttgggggctttttgcaagtacacgcaggttgttggcagagttcactgttgttgtttttttttttttcttttttcttttgcaagggatcactctcagctcttacaggccaccctcaaatcatggccacacagccatatctggacttactcacacttctcatcttctttgccaggaagaggctagccccttttgagggctcacttcaataggtcgtgtctgcctgggatatttttcttaaggttgactgtgccatgtaacaaaacctaaccagggagatgtcttcaagtccgtcttctagtctttctattgcatattttatttctgctgttatttttaatggttaagaattttaactttttgaccggatgttcattttttaatagcatccaatcttggttaatgaagaaatttctcacttctctgaggatattatagttcttttaaaggttttcttccacattttcatgtctttcaaactttttttttcttgtctgtctagatctttctcctttgtgctagtcatatgtcagatctcaggttgtaattggctattgattcatatttaatattgacacttttcaaagcctatagaagttatgagagcatgagtaagacttttttttttctttgagacagggtcttactctgtctcccaggctggatggcagtagtgtgattacagctaattgcagcctcgacctcctgggctcaagtgaacctcccagctcagccccccaaatagccaggactacaggtgtgcatcaccatgcctggctgatttttaaatttgttgtagagaaagggttttgacacgttgcctaggttggtctcgaactcctcggctcaagtgatcccagacctggatctcccaaaatgctgacattacaggagtgagccaccgcacctgaccatgagtgaaacttactgttgggcttcattgtggggtgaactttgttcagtttgtatagtagactgtggtgtatcttttacctttttgaaggcttttttcttttttttcttttttgagacagtctcagtctgttgcccaggctggagtgcagttgtgcgatcttggctcactgcaacctctacctcccaggttcaagcgattctcctgcctcagcttcccaagtagctgggattataggtgcgcatcaccatgcccagctaactttttatatttttagtagagatggggtttcaccatgttggccaggcagatctcaaactcctgacctcaagtgatccacctacctcagcctcccaaagtgccgggattataggcgtgagccaccatgcctggcctgaaggtgtttttatgtattgtataaaacatattaacctctgtgcctcaggttccatatctttaaaaagaggtgtaataataataataccttcctcgtatgatttttgtgaagattaaaatgagtttaataaaagtaaaactttagaacagtgtctgatacaagtaaatgttaattaaatattgagtattattatatttacttggaaataattgtttaagtctttaatctggccttaaatttggtatatctttgatttttctcaggaaagaactaatatattatcttttaagtggatatacatttattgttgatatttttcaataaaaatttgggttttaggggatactttctttatttgccaaagtctagggagttgtatttccacacatatgggcattggattcaaacttaccctttcaggtaaccatcttttggtagctgagtttttaaatgttttaatatattatcctgccctctctataacagtatatcaacatgattaaaccccaaaaaggtgttctcttatttccttggagttgtattaatacgagttgtacgactcattatttaaaccatttttttgaacctctctttgtagtctctaggagttcaataagcataattcttttttttttttttttttttttcagatggagtgtcgctctgttggccaggatggagtgcagtggcatgatctcggctcactgcagcctccaccacccgagttcaagtgattctcctgcctcaccctcccgagtagttgggattacagccatgcactaccatgcccggctaatttttgtatttttagtagagacggggtttcactatattggccagactggtctcgaactcctgacctcatgatctgcctgcctcggcctcccaaagtgctgggattacaggtgagagccactgtgcccagcccaataagcataatttttagaaattatttctcctttctaatcttgaaacctgaagcctgcattaagaaattgctttacggccgggcgctgtggcttacgcctgtagttccagcactttgagaggccaagacgggcggatcgcctgaggtcaagagttcaagaccagcctggccaacatggtgaaacccccatctctactaaaagtacaaaaattaactgggcgtggtggcgggcgcctgtaatcccagctactcggaaggtagaaggctgaggcaggagaatcgcttgaagctgggaagcagaggttgcagtgagccaagatctcaccacagcactccagcctgggtgacggaacaagactcatgtctcaaaaaataaaattactttacaagaagtaaaacttttcatgtggtatttctgttgaaagtagatacttttatagaaaaagtatatctttcaaaatcaatacgggaacattcatagcagcataattcctaacagttaaaaaggagagactgagtttggtggctcacatctgtaatctcaacactttgggaggccaaggcgggaggattgcttgaggccaggagtccaaggtcagcctgggaaacatagcaagaccctgtctctacaaaaaatgaaaaaaaaaaaaaatagctaggcacagtggcatgtgcctgtagtagtcccagcactttgggaggctgaggttggaagatctcttgagccaggagcttgaggctgcagtgactatgatcatgccactacactccagcctgggcaacagagtgaaaccctgtctctacctaaaataaataaaaataaaaagtagaaatgactcgaatattcattagttatttaatagataaacatgtggtatagtcatgcaatggagtattattcagaaatcaagagaatgaagtactgatacacaccaaaacataaatgaaccttgagaacatgctaactgaaagaagccagacacaaaaagccacatattgtttgatttatttatagaaatgtccagagtaggcaaatccatagagactgaaagtagattagtggttactaggggattatgaggaggggaaataggcagtgattgttaacagatatggggtttctttttgtagtgatgaaatgttctgaaattagatagtgatgatgtacaactctatgaatatactcaaagccacagaattgtgcacttttagcagggtgaagtttatggtatgtgaattacacctcaataaagctgttatttaaaaaaaataatctgggcatgaggatttttctctaagcatttcatctgagatgacttgtgtgatggtgacagcaatataatggctcaataagggaatgactgactgctgagcggaaagtggagctggggcgatttgggagcgtgattcacggctgtgttaactttgttctttgccctcacccgtgtgctgctggtccaaacatactctgtgcagccattaaaaaataaaagtatcatgctcaaagtgaatactttactcctctgactttttagtagttagttgtcaaattggccaaagtgctgtcttagccaggaatattttcagtaaaacatctttattcaggaaaaagtattcaaaaacaaatagcattgctctaggggcagggagtatagcaatgaacaagagaccaaataccttttttcataaaagaggagcaaacaatacaggcatttagaagtgctatgaaaattagtaaggtaaggggatgagagtttgggagtggataatgctactttagacagtgagtgaggaaggcttctctgaggaggatgcttggatttaaaaaaaattaaaatatatctacatctcctttatcaactactttttttttttgagatggagtctcgctttgttgcccaggctggagagcaacaggacaatctcagctcattgcaacctccgcctcctgggctcaagcaattcttctgcctcagcctcccaaatagctgggactacaggtgtgcgccactacgcctggctaatttttttatttttaatagagacgggtttcgccatgttggccaggctggtcttgaactcctgatctcaagtgatccgcccacctcggcctctcaaagtgctgggattacaggcgtgagccacagtgcctggcctttcaacttccttaacacctgattattttgaccctttctagtctgagtctggctctcccagttaacttaatttttttccaaaggtcggcagtggtttatatactttaagagtttctgttttcttatttttccatagctacactttaacgaggctgactacttctctgggaggaggcatgctacagtttatttctctggctgcttttatgattgttgccttttttcccccttacccttcattatagatgttcttttgatttttttatttttttttaaacattcttctcagctgggtgcagtggctcatgcctgtagtcccagcacttcgggaggctgaggtgggcagattacttgagctcagggattcgagaccaccagcctgggcaatatggcaaaaccctgtctctacaaaaaaatgtaaaaattagccagacatggtggcacatgcctgtagtcccagctacttgggaggctgaggtgggaggatcacttgagcccaggaggtcaaggctgcagtgagccgaggtagtgccactgcattctagcctggctgacagagctagaccgtctccccccaagaaaacaaaaacaaaaaatcccccacattctcttttcttttgaaactttccccctcaacaaaccaatctactctatggccttattttctcctcctgggattcactggacgtcggcactttcacctgttgctcagctctaggcatccaggtcctctgctctgctgcatgctgggcgtccctagctgccccttgggcatctgaaacttcacgcacctaaaatgggcctcatcttcctccagcacctgctccctacacaatatttgagttggtctttgaatagttttcactgcaaatcctcctttctgctatctccactggagaacatacccatcgtgtttaacctagacttcttattttattttattttattttttgagacagaatcttgctctgttgcccagactggagtgcagtggcatgatctccactcactgcaacctctgcctcccgggttcaagcaattcttgtgcctcagtctcctgagtagctgctgggactaccggcatatgccaccatgcccggctaatttttgtatttttggtagggaccaggtttcaccaggttggccaggctggtctcaaacccctggcctcaagtgatccgtctgcctcagcctcccaaagtgctgggattaccttcgtgggcttattgaccatttgtacatcttctttggagaaatgtctattcaaattatttgcccattttttaatctggttatttgttttgtttttgagttttagacattctttgcatattctgtatataaatcccttgttagatacatgatttgcaagtattttttcctgttctctgggtttcctttttctctcttgatagggccctttgatgtacaaaagttaaagtttgatgaagtttttcattttttgcctgtgcttttggtgtcatatccaagaaatcattgttaactcaggccttgtgaagctttcttggtattttttcttctaataattttaatagttttagttttgacatgtttgacctatatcgagttagtttttgtgtatggtgtaaggtatgtgtttaacttcattctcctgcatgtggttattcagttttccccataccattttttgaaaagactgtcttttctgcattgaactgtcttggcacttatgtcaaaaatcatttgaccatatatccgagagtttatttctgggctctctattctgttctgttggtctgtgtgtctatctttatgccagtaccacattgttttgattatggtaactctgtagttagttttgaagtcaagatgtatctttaactttgttcttcttttaaatattattttggctttttggggtcccttgaaattccatgtgaattttaggatgggattttctgtttctgtaaaaatgtcgttagtatttgatagggattgcattgaatctgtagatagctttgggtagtattctcctcttaacaatattaagtctttccatccatgatcgctggatgttttcccatttatttatgtcattttacatttctttcagcagtgttttgtgctgagtcttttgtgtataagccttttgtcttcatggttaagtttattcctaagcattttattctttttgatgctactataaatagaattgtttttcttggtttccctttttggattgttcattgttgtctttgcccatttttaattgggttgtctttttattattgaggtgtaaatgttctttatatattctggatacaagtcaagagacttgtatttgtaaatttttttttctcattctgtgggttactctactttctttaattaatatgaactatttaggtaaagcatgaaaacatgagccccaaaatgttacctttaagatgatagaaaatgttaagatattttataagaattcactttattaaaatattaggatattttaaaaaaccattttcctgtttttttaatgtggtagtacattttatataataatactcaaatatgaaaaatgtgtaaacaccatgtactgtactgggaaatgtagctataaaacaattgtggcatgtaagtaaaatcatgttacgaaaactcaaattttgcctagggaaattgattagtaagaaatatgccaaaatgtttatagtggtcataaaatgatgagggtaataagtatatgtattttttgcctgtttatgttttttagattttatttaagcattttttgctatgaaaacattctaaaagaatgtaggaaatggacgtcatggcccaaaggaaagatgaaattcctaggacagcataacgtgtagcaacacaggatatcacttcatattttacaggcactgtcagtctagaagttagaacagcacagtttttcagcctcccttagtgcaagactgaagagcaagcattgccatcatcccctccctaggtgttgtgtatcataagataatcaaacatcaaatttctaatactgtccgcaatatcagaaattctgttcctccatttctgctgtcttgttaagttgtataactggcccagtgatactggacgtatgtacattatcatttgaaatttccataagagcagctagccacttagagtaaataaaaatatgtaatatattatctattgttgaatattgactccaggagactgtcgtgcttatctaatgcttaatgataatgcttcattataaaccattccttcaataatggtgtatcccatcagtcaataatggtatatcactttagaaaataatgctttattttgtttaaatatcaagattaatttttaaaaatcttggtctgttgggcagaaattatatttctcaacaggccttagaggaatgatcttcagtgaatgtacttccttctctaatttgaatattggctttgtttactaatacatttaatttgaccacatgaattattttggcaaaacagccagatagtttacataaaaatcaattatagaagttggctatgtatcaattgtggattggcaattgtttaggcagttgtcaagtattatcacaattagttgaatcactcatttattatagacataacgtgatacattctcacctggtgcttttttctattgtggagactctgtagtagttagtaatttggaaaagggtggtaatgcaataaaatcttagcttaatagttaaaaataaattctctgatttttaggagttggtaatgcttctcttagaatataatgctgatactactattgttaatgggagtggacagacagcaaaagaagttactcatgctgaagaaatcagaagcatgcttgaaggtaaatatcatggatgtgaacataaacagcatttactttcattataaccaaggttctgactaaaaatggcttctgagaaagaggacaaaacagaggataaccagctgatgctctaatgataatgtcatcttggagtcattgattaaacacacaattatctatatgatagtttcttcacttaaagcttttaaactcttaatttgtacaaaattatggcaagttttaaaaatctgtttttcaggctgggtgcggtggctcacgcctgtaaccctagcattttaggaggctgaggcaagaggatcacttgaggttaggagttctagactagtctgggcaacatggcgaaacccctgtctctacaaaaaattttaaaaaaattaaaaattaagtggatatgatggtgtgcacctgtagtctcagctacttgggaggcggagggaggaggattgtttgagcctaggagtttgaggctgcaatgaaccctgattgagctactgtactttggtccaggcaacagagtgagaccccccagccgaaaagtttgtattttgggcctcagaaaaaatatctgtttttcaaatactcaacaaaattcaaagtagaaaattagagacatgagggaatgtggctaatagactgatgaaacatgacaatgaagggatacagaagtgcaggacagtaagaggtggcagtgcaacctgtaagaggtgttgcttttgggagtcacttgatgttggctctggctgcctcagttttctttttgcccaggctggagtgcagtggcatgatcttggctcactacaacctccgcctcttgggttcaagcgattctcctgcctcagcctcccaagtaactgggattacaggcatgtaccatcacacccggctaactttttgtatttttagtagagacggggtttcagcatgttggtcaggctagtcttgaactcctgacctcaggtgatcttcccaccttggcctcccaaagtgctgggattatagtcctgagccaccgtgcctggctcgctatttatttattgagatgaggtctcactatgttgcccaggctggtcttgaactcctggtctcaagcgatcctcccatctcggcctcccaaaagtactaggattacaggtgtgagccactgtgcctggtattctcagttttcttgaggacttcattgcaatataccaggcagcagtaatttcttgatggttgagcttcattgttatgaatgtcaaagactaatttgcatttaagaaaacatgagtctacaataactcaggactttctctaaagcaatttaaaacaaaaaccattttgatgcttgcatttgggcaccctcatacaataggatctttctttgaatggccagggctttcctataattattttttagtagtatttctaatgttgagaagagaagatctttaattttctacttaatgagtaaaggtactgaattagagttgcaatttcacacatagcctttctttcctttggaattcagagaaaggcaatataattttgtacttaaaggatgttgatttcttaatttaaattttcaatatttttatttatgtaaaaaccaagatcctgctgtttattaccccgattagtcttgagagctaaaatcttctcactcattctatagtttaaaaaacaacacaaagtctacttgtcagacttcttaaggtcagtgtcttgtttctgcactcaaaatgaaccctctgcttatcaatgaacaagcaaattaacacataacatcttctatcagacactgtgttatatgaatttagtaacgtggagaacatattagctgtggttcctgccctttaataatttgtgactgaatagggaggatgaggtactgtctttaattatgtcctgtcattttaattataacaagaagagaacccagaactgaggttttcctgacagactggaatgttaggttagtctgacaagttgacatttaataagggcaattgtaaagacatgctctaagacatttccaaactcaaactgcacaagaaaaagggcttagttgactttacaggtaatatgatttgtcagctgatgtggtcttagcttgggaaacagaagtagagactgaattgagtgattctgctctaatgagagcaccttacccacatataataacatttgtggatagagtgttaaatggatcattggcaaattactggaagtaccttgagtaacccactataagtagaccataagaccataaatagatcagaaaccatgtcataggggctgggcgcagtggctcatgcctgtaatcccagcactttgggaggctgaggtgggcagatcacttgaggtcagaagtttgagaccagcctgcccaacatggtgaaaccccatctctactaaaaatacaaaaattagctgggcgtagtagtggacacctgtaatcccagcaactcgggaggctgaggcagaagaatcacttgaacccgggaggcggaagttgcagtgagctgattgcaccactgcactctagcctgggagggccaggtgcagtggctcacacctgtaatcccagcactttgggaagctgaggcgggtggatcacgaggtcacaagttcaagaccaccctggccaagatggtgaaaccccgtctctactaaaaatacaaaaattagctgggcacggtggcaggcagttgtagtcccagctactcaggagggtgagccaggagaattgcttgaacccaggaggtggaggttgcagtgagccgagattgtgccagtgtggtccagcctgggtgacagagtgagactccgtctcaaaaaaacaaacagaaaagaaaccatgtcataggataatgcatggagagacaagaaatgttttaccctagaaagagagacataggcaggcacaatgaaattatactcaagtacctgagagctgttacttgggagaagggatgatcttacttgtggccaaaccagggctgtttgattgcctagttgatggagtagcagggagtttatctttgggtccgatatatagaaataatgacttggattgccttgaaagatacatgatgggaggtattcagcaaaggatagactattgttaggcactattactaacgcagccttcttctacatcttgtctttttattttgaaaaatttcggccgggcacggtggctcatgcctgtaatcccagcactttgggaggccaaggtaggtggatcatgaggtcaggagatcgagaccatcctggctaacacggtgaaaccccgtctttactaaaaatacaaaaaaaaaaaaaattagccaggcatggtggcaagtgcttgtagtcccagctactgaggaagctgaggcaggagaatcacttgaacccgagaggcagaggttgcagtgagccgagattgcgccactgcactcccgcctggccaacagtgagactctgtctcaaaaaaaaaaaaagaaagaaaaagaaaaatttctaatctatgggaaagtttcaagaatactgcagtaaacatttgtatgtccttcactcaaattcaccaattattaacattttgccatatctggttgagactgttacatattttatgttatttatttacttttaatttttttgttgaactatttgagagtaatttgcaaacatagtgatacttcacccctaagtacttcagtatctcttaagaacaaggattattttcttacataatcaaaatatagtgctcgatttcaggaaaattaacattaacataatattatataatatatatttttatattcagatttagccagttgtccaaataatgacctttgtagcattttcccctcccatcctggattagattctaggatctaatccagaatcccacattgcatttaattgtgacatcatccctttcatctccttttatctgaaacaattcctcagccctgttcttgatactgacttttttttttttttttttgagacagagtttcactctgtcacccaggctggagtgcagtggtgtgatcatagctcactgaagccttgcattcatgggctcaagcgactcttctgcctcagcctcccaagtagttaggactataggcatgcaccaccatgcctggctttatgttatgttatgttatgttatgttatgttatgttatgttatgttaatgttatgtttatattatgtattactttattttattttattttgatagagaaaaggcctcaatatattgcccaggctggtctggagctcctggcctcaagtgattctcttaatttggcctcctagagtattggggttaacaggcgtgagccttgccacctggccgatattgacctttttgaagaggaaagcggttatggaattatttgtagaatggcccttgattttggtttttctcttgtgattagattcaggatatgtatttctgtcagaagcattatgtaggtgagtttctatcccatgccagtgcatcctattaggaggcacataatgtcactttgtttcattattggtgatgttaactctgatcactttgtggtccactgtaaaggcatcttttccctttgtaattaataaatgacctgcagggagaaaaactgagacaaagtaaataccccatttaccactaaacttctactcagtggttttagcattcatggataatatttgccctaatcattgattactctagtggttgcaaagtaatgttttgctatcatgaatgaaatatattttccaggtgctctcctgcatttcaagtgtactactattcagcctattctctgcatgtatgtaagcatcagtcaggacagaggtagactttgtgacctctaagatcctcactaacttgattctgatggaaaagaaagacagtttagagtgatactaaatttaaatcttataggacaaatattttttggatttgtagcatttgctttaggaatatttattgagatataaagtatatgcagaaaagttcacatcatgaatgtatagctcctttagaacgatttctgtagaacacatctctgtaaacagcatccatatcaacattgcgagcattctagaagcctgaccacccagactagaatatttgttttcattgatgtaatcagcagttttatttcagtgtcctgaaagaatacaggacaggaacataatctaagaacatatatagtattttcaactccatattcctgacccttttccttcatttatgagcctagacaacctagaaagaaacaatagggtatcttttcttttccttccctaaaacctgggacaaacattaagcattatttgaatattcaacacgtatttattgaccaactatgcatcgtgccagatgctgtcataaatgctttggttacacagacagataagaacaagtacctgacttcaagaatgacagaggggataacttacaggtcagggtgatacatgcagtggtggaggtatgtacgagaggtataggagatgtcactgttctcaaagagttcctagttcagcagccatagaaccagtgggaggaaagattgaaggtagtgcatcccagcagcagaagccatggacagtctacagagagtcttggctgtcttctgaggtagagtctgggtgtggaaataaaaatgtgggaaaagaagatgatggtatatagcaatgttagtcatttcttaagacaaaggtaaactaatttcagcagttgctggattcaatacatgtgttccctgtagtttaaatgcaatggtacgtgtagagtcttaaacagcatttagcacatagtgattactgttaacaaatgttcatctgtttccccagtcacctggctccccaacctgcttctctgtccatgacttgactttagtcaggatgacctgaaaaacctttcatagttcctcctttgcagcctctgcacaggacattgtagacgtatatttagtgggatcaccaagtcgttctctgaaattgcttcctttctataaaccaaaatagaattcagatctagcagaaattagatcttaccgacatattccattctctcacacaaatcggattgccagttgctcttttcctgtaagtatgacttcagaggaagcgtagtgataagagcatggactctggaactagcctgcttgagttcaaatcccagctcctccactctgattgtgtgaccttggttaaattccataacctcttggtgcctcagttcctttgtctgtaaaaatcaatataataacaacacctacctcagagtagttaatgaggatttaatgagttagtatttttaaggagctttgaatagcacttggcatgtagtaagtgccaaagtatttttaaagatataaaaataggcaaggtggctcatgcctataatctcagtgctttgaaaagtcgatgcaggaagactgcttcaggccaggagtttgagaccagcctgggcaacacagtaagacccccatctctacaaaaaataaaaatattcaccaggtgtggtggtgcacacctgtggtcccagctacttgggaggctgaggcaggagaattgtgtgagcccaggagtttgaagctgcaatgagctatgactgtgccactgcactccagcctgggcgagaggatgacaggcttggtgatcccactaaatatacatctacaatgtcctgtgcagaggctgcaaaggaggaattataaaaggtttttcaggtcatcctggctaaagttatggacagatgactttctcaacatatatacatacatacataaattttatatttttatgtggcaatttataaataaattggtatgtctgcatatatttatacgacatgtacatctttctatcagtgctatttcttgttatttttcacattctaaggttctagaaggtatgaaccccacttacctacctttccaaggcaaatatgtaatagtgtttcggtacataaaagtaatccataattagttttgatggttattgttagtgagtaaaatacttaaagacttctgaattgaaaacccaaattcatccaaacctgaaataaatagaattctgtaatctgaattgtaaggtaataacaataaattttaactgcatttgaattacaatccaaaacattttggtttttctcatcatgatcactttattctttataatgaatttgtaattggatcctgactagcagtggataataagtacttttcttttgcagctgtagaaaggactcaacaaagaaagcttgaagaattacttttagcagcagcaagagaaggcaaaacaacagaactcacagctctggtaaaacaaacaaaaaacccccaaaagacaaaaagcagtctttctttacacttcaggaaaatttttacttaatgttaagtaaataatttagttgaattgtggaaccaagaactccagagatcataatagtagaaccaaagttcttaatatctaaaaacactcagcatggtgatagtttaagcaggacacattttaaatggtgatatttttctgaatttctgatttacacccaccctaatccccctgaaaacctgatggataagaatctgatttttcatggtaaatagttaatgtaaggacaacttatatatatattacatatattttgtgattaagccaattgaaacataataaataggaccctataaaggaataagtttttctagttttgatcagcagtagtttctgggaggaatgctacacttctggaaggtactatgcaaagaagggacagtattttggaatacttataccacattagactgaaaggtttgcctgttccccgccaccttagaagacctactttccagcttccattcctgcacagtctcattaaacatgaaactctaaatttgttctgaattcatgactgaagcactgccatttgctttaaagttatttcagctcatttgaaagggcctctttggtttctaagtatagcacctaaagcagtttttaaattttgtgaaatggaggctatataaagaagcttctaaagcaataagttgggaacaacaaattcagtagaaccttgacatttacacatttaacatttatggttttaactcttctgaaggactggcagactgatttgtaattctgctgtcacaagtatgaattgcaagcctggtaggggcatgtaaatcattgtgaaatcttagtgtctgaggtgtgtgagatggtgctggcacagtgcagagtgtctcttgtcagaggagtgtgagacccggacacaggcctgagatctatctcagggcatctgagaataagcatgggtgtggcagggttggctggtttagtgagcaagaaaccactaacagcctggatgccaaggagcttggctattcttcgggctctgctgatacaccctcctgtgaattatgagaggaaagtctatctttgatatataattctgcattgcatttttttaattgttagctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatggtaagcatattggtgaaaaccatcgttggccattttgaaattataaaatgaagtcaatgccatataaaattgttttgtttcagtatccagcctttgttaaactgtatggtttctatttaattttggagccaaggcattcacacaaaagaaaaaatgatgacaaaggtagatcctaccctcaaggaaaagataagtacagttgattcttgttatttgcagtagctgtattctataaagttgccaccagcactgaattagggaacactgaactattgttcctaggggaaaatacaggattaggttcctgcaagccttgggtcacaacattttcatgaattgatcattatgaaaccttttttttttttttttgctgtttctatttaatacatattgttgactcattcacattgaactcatagccaacagcatcatagctcactcttgagtaaagttttcttcataaggcatatcacagccttttccactgaggtacattagacagcacttcagcacaatgctaggggccttttttttttttttttttttttttttttttgagacagagtctctctctgttgcccagtctggagtgcagtggtgccatctcagctcactgcagcctcctcctcctgggttcaagtgattcttctgcctcagcctcccaagtagctggaactgcaggcatgcacctgtagtgtaccatgcctggctgatttttttgtatttttagtagagatggggtttcaccatgttggccaggctggtctcgaactcctgacctcaaatgatctgcccacctcagcctcccaaagtgctgggattacagatgtaagccaccatgcctggccgcttggggccattttaaacagcaaagtcaccaacaaaaaatacaaaaggtggaaagtgtgaccctaaatagaccatgacgaggacatttgtttatagtaggagagcttctagaatgaaacaagaaggccaggcatcaccttcttctacctcagctggaaaatgagcactgggcaacccacatttttcaccactctgggcatgtttgtgaatgactgagaaactacaatgaatattgaccttgggattacaagtgaattttagcaatagccagatatgcaaatatggaatacgtatataatgaggattgactgtacatgtgtgacaatttgaaagacagaatcagaagccagaaaagaagctataaaaggtgtcttgggtatttaaaagaggaacatgccgccgggcgcggtggctcatgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactctgtctcaaaaaaaaaaaaaaaaagaggaacatgccatcagggccttttcacatcactttttaggatgcttcctgctgcctgctaccagcctgggttaggcctcatcaggggtcccacaggaccctgcgttcacctccatcagagcctaaatcacaccccatggtatttgttggcttatgatgctatctcccatgtgactgaactcctaagggcaggcctcatacttcattgtctggttcacccagcacctagagtaatgcatagcacataacacctgggaagggctgcatgtttgttgaaggtttggagtcattagaaatagtttcacaggccaggccggtggctcaagcctgtaatcccagcactttgagaggccgaggctggtagatcacaaggtcaagagattgagaccatcctggtcaacatggtgaaaccccatctctactaaaaatacaaaaattagccaggcatggtggcgtgcacctgtagtcccagctactcgggaggctgaagcaggagaattgcttgaacccaggaggtggaggttgcagtgaggcgagatcatgccattgcactccagcctggcaacagagtgagactctgtctcaaaaaaaaagaaatagtttcataaaggaataggtacttgatacagatcctgaagccctactaggatttaaaaaatgttttcatttctaggggctgggcactgtggctcacgcctgtaatcccagcactttgggaggccgaggcgggtggatcacctgaggtcaggagttcaagtggtggcacgtgcctgtagccccagctactcaggaggctgaggcaggagaatcgcttgaacctgggaggcagaggttgcagtgagccgagattgtgccactgcactccagcctgggcaacaagagtgaaactctgtctcaaaaaaaaaaaaaaaagttttatctctaaatactttactttgtaccttcattaccattattgtctttttatcttgagcctttttgtcttgataataatggtagttaataacaataccattataatctagtaagattttgataagcaggagtttgggaaagggtattctgagcagagggaagattatcagaaaaggttaaggtgaaaaatccaagtcaggtataggtgaaatccccagtttgctgcatccaagggcacatccaggggagcagtcggaggtcatcccaaaatttacacttgtacagcagggccattgaaatggtcttgggtgagaggtgattaggacctgaactttttattttcaaggagcaagacacatttatttcttaataataaaacaaaaattcttcaagcagatatcatattcagtaccaaaaagcctcaggataaaaaggtgccttaagcttggcatagccaggttacatttaagtaccgtcgtggatccacataaccaatcagctttgaggaaaatagttttgccatcacaacagtttaagataaaaaaatacattcaatttaaaatttataatgttattataggagctgtcaaatcaagtgccttatgtagaataacggtctaaaaaatgagcttaccatagtaagatttagaagatgctttccttggtgaatttgagttttgaagtttagagactttttttatacaaagatatttgtggaagcaaaggtgaatattaactatatgctacagtcataaatcattagccttcattgcaaggcaggccagtgtacctatgtttaattttatatattcagttaatatatattttatatgtaattaaaattaactggtatgttatatccatggacaactcagtgacttgatttgtattacataaggctagcagatcatactgttctttttttttttttttttgacagagtttcactctgtcacccaggttggagtgcagtggcgcgatctcgactcactgcaacctctgcctcctgggttcaagcgattctcctgcctcagcctcctgagaatctgggattacaggcatgcgccaccacacctggctaatttttgtatttttagtagagatggggttttgccatgttggccaggctggtctcaaattcctgacctcaggtgacccgcccgcctcagcctcccaaagtgctaggattacaggtgggagccactgcacctaatgtcttttaaaaattttctccttagagatggggtctcacccttttgctcaggctggagtgcagtggtgtgatctttgctcactgcagcctcaaactctgagctcaagtgacccttttgcctcagcctcctacgtagctgggaccacagatgcatgccactatgtctggctaggacctgagctttattgacatcaataggagtagaaaggagaaagaaaattggttagagatcccctgcttgactggctgttatgctctagactctcactgtctaatagaaatatgatgggagtcacatatgtaattttaaatttctagtagccatgttaaaagtgaaaaaagaggtgaaatcaattgcaattatgtgttttatttaaagtaatatatccaaaatgccatttcaacatataatcggtaaacagtaattatcagtgagatcttacattccttttttgatactaagtctttgaaatctggtgtgtatttctgcacttacagcacatctcagtatggactagccacatttgaagcactgtgtagccgtatgtgattactgtccaccatattggacagtgcagctctacacataatgaactgtcctggaggctctctggttcactgtgttgtcctcaccttgcacatactattctctctgccagaagtgctcttgtctttcttgtccgtctggtaaaccctagtcttgctttaagagctagctcaaactctgcttccccagagagcctttccctgtgtccctaagacagatacaggttcatggaggaggagagaattcagaaatcaacccatgtaagtatggtgatttaattttcgacagaggtgtgaagacagtcaatggaaaaggataaactaagagttacaaaagcaaatattgatgtcaaagtgagattttggccaggtgcagtgactcacacctgtaatcccagcactttgggaggctgaggcgggcggatcatgaggtcaggagattgagaccatcctggctaacaaaccctgtctctactaaaaaaaaaaaaaaaaaaaaaaaaaaaaatacaaaaaattagccgggcgtggtggcacgtacctggtagtcccagctacttgggaggctgaggcagaagaactgcttgaagccaggaggtgaaggttgcagtgagccaagattgcgccactacactccagcctgggtgacagagtgagactccatctcaaaaaaaaaaaaaaaaaaaaaaagtgtgatttctagtgtctttaccagtttgccaaagacttgagcagtttttctgtgtggtattttataatgatttttccttcaaaaatgtagattcagaagtgtccaaatgaaataagaattaatatagttccatacaaataccagtctaaatggaaaaaaaaaaacttcccttgtaaatattgaaaagttactattggtattcaaatatatatttactctatagtttatactagtaaccaaagttgaacattcctgttaaagctattaatttgtttttgacaaaagtcagaatggcatcttctgaaagagaataatttaaaaaaatcaggccaggagtggtggctcaagcctgtaatcccagtactttgggaggctgaggcaggcggataatttgaggtcaggtgtttgagaccagcctgaccaacatgatgaaatcctgtctctactaaaatataaaaattagccgggtgtggtggcaggtgcctgtacttccagctacttgggaggctgaggcaggagaatcacttgaacccaggagacggaggttgcagtgagctgagatcatgctactgcactccagcctgggtgacagaatgagacgccatcttaaaaagtaaaaaatcaatcaatcaatcaaaggctgggtgcggtggctcactcctgtaatcccagcactttggcaggccatggcgggtggatcacttgaggtcaggagttcaaggccaacatggtaaaaccttgtctttactaaaaatacaaaattagccgggcatggtggagcacgcctgtaatcccagttacttaggaggctgtggcaggagaatcgcttgaacctgggaggtagaggttgaagtgagccaagattgggccactgaactacagcatgggtgacagagcaagactccgtttcaaaaaaaaaaaaaagaaaaaagaaaaaaaccataagagcaacatttacattatagaaattcttcaaaaataggaaaaaagaaaaaacccgcaaattacccaagcatagccacagttactttggcatccttctaatctattttcaggcctattttagaacattttttaaaaattgtagaactaatgcttgttatagttgcaatgaggaaaacaaaagcactagaaaagtatataatcacctctaacccaaacgtccaaagatttagtttttagttgttaatgttttagttttagttgttaatgtttcatagtaacatatattttttaaaaagttttaagtaatgatactacctcaagaatataagcaaaagaaaagttatacattactcacagacgaatacacagtcatctcatgatattccaaagtgggaaatggcattaggcatcagatgggatggaactgggaaccagagaactgttaggaacccagatggctgccttgtgtgtctgtctctcactgcgtggtctgatcatgtcttctagcagaccagctgttttgttttccaggatacataatggaagatggctgccccgtgactccactcaggagaccacaatctctcaacctcaatgttacatttcagtgggagataatgtgttagtacctgcttgtgtcaggcgtctgtgcctagtgtggtcacttgggactttaggggcaggacatatggtacagaggtgactgccaaggcctcctcctggcaatgtggatagggacagagaggggtgaatggatgaggactggcagacacctcagaaagtgtctcttcattttagttgacaggttgtaaatagagttggcctgataaaattccacttttatgaagcatcaacagcttttccacattgtccccagaagcacagtcatcatggctcaccttatggaaagtacttcatgtggatataacataattttttcactcaaaagtctagtgataagaacaattctgtatgtttttttttctagagtgaaaatgtcctagtctttttttctttttttcttttctaaaaaataaggggctagctatggtggctcacgcctgtaatcctagcactttgggaggccaatgcaggaggattgcttgagcccaggagtttgtaggctgggcaacacagcaagactccatgtctgaaaaaaaataaaattaaaattaaaaaataaaagcaaggatatttaaaatttttaatcaaattggttaatccatctctttgatttcttctaagacttcttagcttaggtagagatttgataaatgtttaattttgtttcctcccagtttaatcacattcattcattcagcaatgctgcgcctccactgtgtgccaagaaccgtcctaggtgctggaggcccagcagtgaacacagcccaacagtccccgtgctcttgagctcatattctggtgggaggaggtagacaacaaataaatgcatatgtgctgtcaggccatgaggtgcaggaaaataaaataggatgaagggactagagagtgatggtaggatggggggtatcttagaagggatgcaaaggaagggctctctaagcaactttgagcaaacagctgagttgagtacaggagtgaaccctgaggaagtctggcagaagagcattcaaggaaaatggaaagccagtgtaaaagctctggagtagaagaacacgtggcacattgaggaaaaggaaaactgccagtgtgcccagagcagggcgagctggagaagagtggatagcatcagagctgccagaggcccaggcctgcagggcctggttggctgtgagcaggagcttggtggtatgtgagtgtggttggagggctttgagcagcaaagtgaatgtgagagtgtgtgttaggatgtgggagtctcaacttgtccatcccttacgtttataccctttatcaagtaatctttccttttccattattttgtcatgcctttcttatacattctaagaattccttttctttctttctttcttttttttgtttcgatactgagtctcgctctgtcacccaggctggagtgcagtggcgcaatctcggctcattgcaacgtccacctcctggcttcaagcgattctcctgcctcagcctcccgcgtggctgggattacaggtgcgcgctaccatgcccagctaatttttgtatttttagtagagacagggtttcaccatgttggccaggatggtctcgatctcttgatctcttgatctgcctgcctcggcctctgaaagtgctgggataacaggcatgagccactgcacctggcctcttttttttttttttttttaatagacagagtctcgctctgtcgcccaggatggagtgcagtggtgtgatctcggctcactgcaacctctacctctaagattcaagcaatgctcccacctcagcctcctgagtagctgggactacaggcatgcgccaccgcacctggctaatttttttttttttttttttttttttttttttatattcatattcatgtttttattgggagtctggaaatacgcaccaatgtatacacgtgagttatctatgggtgagggaattgttttatgtgtatgcatgtagtttatctatttgatataattttttttttttttttttttttttttttaactttttcagaaaatttattgagagggagggagagggcaagacagaagcatctgaaatttagtcttctgcctgtgagggccctctggctgaagttcaaaaggaaagaggagctttgcccaaggaaaactattcaaaactatgtttggtgcacttgggaaagcctggtggtgcattgttggcccagaacaggttctctgggattcaaaaggcagggtgaagcttttttttttttgagacggagtctcactctgtcacccaggctggagtgcaatggcgtgatctcagctcactgcaacctccgcctcccgggttcaagcagttctctgcctcagcctcctgagtagctgggattacaagtgctcaccaccactcctggctaatttttttttttttttttacccaaatgagtataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaagaaaaagcctcaccctggctgggtgtggtggctcacgcctgtattcccagcactttgggaggctgaggtgggtggatcacgaggtcaggagttcaagaccagcctggccaagatggtgaaaccccgtctctgctaatttttgtatttttagtagaaatgggatttcatcatgttggctgggctggtctcgaactgctggcatcaagcgatccacccacctcagcctcccaaagtgctgggattacaggcatgagccatggtgcccagtctctttttgtattttttattgttttttattcactcatctgtctcttctttcgacagtatcgcattaaaaaaaagtttttaagatagtattgcacttttaatggttataatgttttaatatgtgagatttccccttaccatttttaaggattttctttgacatccttatctgtttattcttccagaaggcatttaaaataattttctgaggctcttcattgggatttaattgaaattacattctatgtaaattaatttaaggagaattggcatctttattaaattttcccattaagggacaaatctgtgtcatgcaaacttttaaatattacatcattcctgtttttcactttattttgttgtggttggtaagagagatagtgtattttttaactggtggtggaacccatctagattccatctaggaggctatttcatttagttcaaaagcattttattgaattcttactgtgtgccaggcattttagacatcaaatccagaaatgaggtctctcttctggaatttcatctagttggcaggagttcagaatttatttttggtattagggcagaattctatgaaagaaatcatagtgttgtctttctctctgcctaaagaaataatttctccaaagtgccctgtaggtagaatgaaaataacacagaattggcagacctctataaggcattttcctatgtgctaggcagaaaaactaaactgagtattaattttttggttaatgttttaaaaagttttttccccactaaagaagtaatgtatcaccagccccaggttccccatcagcagctctataaatcttcctccaaaataaatcttaaagccacatacaaggccgggcacggtggctcacacctgtaatcccaacactttgggaggcccaggcgggcagatcacgaggtcaggagatcgagaccatcctggctaacacagtgaaaccccatctctactaaaaaaaaaaaaacaaatacaaaaaattagccgggcgtgatggtgggcgcctgtagtcccagctactcaggaggctgaggcaggagaatagcatgaacccgggaggcagagcttgcagtgagctgagatggtgccactgcactccagcctgggcaacagagggaaactctgtctcaaaaaaaaaaaaaaaaaaaaagtcacatatttctctctatgttaaaaatgatctccattttactactgactttctagtccaaaccaccagtatcctttacctgcactattgccatctctttgtaattagcctccctgcatttcttttgcccacgtttacaagccatattgcacacaacagccagagtgacctttttaaaaaaaatcatggaaattatcaaagcttcagaaatcaaatagcataattaattgatgtacccatcaccctcctccagaacttagcaataatggccactctgtatctcttcctactccctgaattcttgtgaaacaattccagatatcatgccatctctttttctttttaaaaaatttatttgtttttcttttcttaccctctcaacccagcttttcccaattctgggaagaactggaaagagaaggcctgtcatgccattttattcatacatacccagtgctcctcaacttactgtggggccacgtcctcatagaaccattgtaaattgaaaatacacttaaggccaggtacagtagctcacacctgtaatcccagcactctgggatgctgaggctggcagatcgcttgagcctaggaatttgagactaacctggtgaaaccccattcctacaaaaaaatacaaaaattagccaggtgtgatgacacatgactgcagttccagctaccagggaggctgaggtgagaggatcacttgagcccaagaggtcgaggctgtggtgagctgtgatagttgaaaaaccattaagttgaactgttgtaagttggggaacatctgtagtccagtatattagtaaaaaataaggacaccctttaacaaaaaccacaagcatgtgatagttgcacaactctgtgcacctataaaaaccattgaatttgtgcagtttaagtgagtaaattgtatgttaatttgtatctcaatggggctattaaaaaacataagcacaatagcattatcctattaataatattctagtaatttatcaaaatcatggaactgccaaagtttgtgttttcccagttattattattattcttttcttttctttttttttttttttttgagacgaagtcttgctcttgttccccaggctggagtgcaatggcgcgatctcagctcactgcaactccgcctctcaggttcaagtgattctcctgcctcagtctccagagtagctgggattacaggtgcctgccaccacacccagctaatttttgtatttttagtagagatgggggtttcaccatgttggccaggctggtctcgaactcctgacctaaggtgatctgcccacctcggcctcccaaagtgctgggattacaggcatgcgtcactgcacccggcctatattataattttttaacactttgacagagttttaaacatgagtcagatcatgttactcttacttaaaacccttcagtggcttttcatcctatttagaataaaactcaaactccttatgctggcttacaaaagtctggcctacaaaccccttgtgtgatgtggcctctgcgtgcctctctgactttatctcttgcctgctgaattgttcctacctcagagcctttgcatcagctgttcctctgctagaatgtccttccctgtattttcacaaggctggatccttcttttcaacctagacatcccttcctcaaagaggccttccctgatcaacccctcatcctccaatctaaagtggtatcccagttactctgtcaaatcatttatttaaaaagtctgggcgtaccgtggttcattgtctgctgtatctttaagaattaatttatcatctgtctttcccaccttctatgctttcccatccccccagtattttttctgttatgttcactgctgaatcctcagtgcctaaaatagtaatcggtacataacagaccctcattaggggatatcatacaaaaaaattgccaacacataccagatgtttggtatttataaaaatattattattttaaaccacccccagcccccctttttgtttttagagacagagtctcactctgtcacccagtctggagtgcagtggtagctgggactgtaggcacatgccaccgtgcctggctaattaaattttttttttttttttttgtagagataaggtctcactgtattaccccggcgagtcttaagcttctggcctcaagccatccttccgccttagcctcccagagtactgggattatagttgtgagccactgcgcctggcctaaaaggttatctgatagaatatatcaccttcctgcataaacagttccagagttctcattgatatgttgttttgaaaggactgttctaattttcataggtagctttcatttctctaataataagctatttgaggctaggagatggtttgatttatttgtgggtttttgtttgtttgtttttttaccttttgtccttcatttaatgtcctgctcacttcagaactctataaataactttgataagacaaactccatttttgttgttgttgggcaaaacatggaatgtgcatgtgtaaggttggaaaaattaacattgatagcttgccggctttattctccattgtcacctttttcttttgtcctaaattgtggaccatcacaccctcagcttgtgagccatctctgctacccattatgcagcgagacggctgaagcgtggctgtggtcggctaaagagtggaccccaaatttgtgattagttaggtatcttgagatgaggggaaatcctgaattatccaggtagatctatgtagttacaaggctcctgataggagggagggctatagagagagagagaacagaatgctggaagcagaggttggaatgatgtgctttggagatggaggaagagaccccatgtcaagtcaggtagttggccgctagaagtggaaaaggcaaggaaatgtctcccttagagcctccagaaggaatgcagctctgtccacatgttgatttcagcccagtgaaattgatttcagacttctgatctctgaaactgtaagataataaatttgtattgtttaagccacaaatttatgagttcatgataatttgttgtgaagttaatctgatttgctggcttaatagttagcgaccaaaagggaggccataaataattgagatggcaacctctctctggtaggtaattttctggggaaagaaaaagatataggcaatagaaaaatgaaggactattagatgctgcagttacagcattgattgtcatagtacatttaagctgttgatggctttttttctttgtattttgcacagatcagaaacctcttgaccttgcccagggtgctgaaatgaaacacattcttgttggtaataaggtacagagtaatgaattaaatttatctaataatttttagaaaaaaatttttgaatgtttgaaatatgtagatgcatttttcatgaaaacatgtttttgacaggtcatctacaaagcattgaaacgatatgagggccctctctggaaggtaagttgaggtggttttttaattatataactgtaaagaataattctcaggtgctctatttctgtttaaaacttttaaaaaatcatttctgaagtatatgtgatttaatcgctcttggatcgtataatgtaaaccactgatttttttttttatttttagttattgagacagagtcttgctctgtcacccaggctagagtgcagtggtatactcactgcaacctccactacctgggttcaagtggttctcctgcctcagtcttccaagtagctgggattataggcgcccgccaccgtgcctggctaatttttgtgtttttagtagagacgagggttcaacaccttggccaggctggtcttgaactcctgacctcgtgatccacccgccttggcctcccagaatgctgggattacaggtgtgagccaccgtgactggcaagccacttttatactactggatttcaagaggcttccactggttgtagccattacttttctgtgtgttgatggtcccttttaggtgtttttttggtgttgatgagtcacttttaggtgactaagtttttatgaaaaggagtggggggaaaatacatttttttcttactagatcaaagaattacagtattatttttgttatgaacatcaaaccatggaagacttagaagaaaattaatatttgaattatcacatggtacatatataaaatttttccagtcctaacagtttctacattttggagaatcctgttttctagaattaaccttgaagagcacataatttcttttgcatttgcaagcaatcccttaatctatttatgtatctgtatgcttatattgtataagataaatttaggataattttcttttttagacattcattcatgactttgaggaaattgtctttgaagcccacaactggtatattttctgtaaataatccctgaacagttttgtcagaaccataaactgtaatcatcattgatcttatcagtatggcatttctgctgttcctgtcaccctgtagtggtatgttttcattactgcacttagtacctaagttcatgtttgatcatttttttttactgttcagtgctactgtctaaagactcaaatatgactgtcctcacttaattactttttatcagtcaagcatttgaatctagatgtgtcagcttgggaaatctttgttatttttcccttagagttcaagattttttggctggagattattctgggtagtgttagagcatggagtcctttcatggtataggaaacagtaagtattatgatctttacacttatcaaatttcactgtataaattttgaaatacgaatttttttcacttgtctcttttccttttgtcttgataatttcatttttattttgaaggcctgatgcagttcataatatttatcgccagggatgcaaacacctgactcaagcagtatgcacggtaggatgaaacatggatcatttgctcctctaactgtgaaatcagttcttcaagtgattgacccaaatcatttatacagccttgtaaaatcttggggttctgtggaatgctgtagaaaacacttgtatatattttaatttgataacaagtaaagtcgtggcatctccattttgaacaaaattttaaaatatagttaacttttatttatctccatgtattattatggaatgagagatggattgtccaaaaatatttgtcaaatttacccaggcttatttgatgatgaaatatcctagtacatgcaattgaaaagaatgtgtattttgctattattgttggttgttttgctattgttgttggttgtagggacctatcaatattaattcagtcatggtggttgatagcattcagatcttttgtgtcttggttttggctagtggttgtatcagttgctgaaagaggaatgtgaaagtgtcctactgtgcttgtggaatgttgcatttccttctctgttattgataacatacttatgattgttgtcttcttgattaattgatccttttattgttttgtggccctctttatctcttgtaatacattttgttttaaaatttattttgtctgatatgaacataaccactttggccttcttatgtttactgttcgcatggtgtctttttcctatccatttgcttttagcctatatgtatctttatatttattttctgtctcttggagatagcgtatgttttagttcctattacccattctggcaatttttgccttttaattggatttttcttttgtgaatgtgttctactttcatgcttcttcatatgtcaggtaattgtgggtttggttttgttttgttcttgtttctgtttttttgagatggaatctcgctctgtctcccaggctggagggcagtggcacgatctcagcttactgcaacctccacctcccaggttcaagcagttctctgcctcagcctcctgagtagctgggattataggtgaacactgccatgcccggctaatttttgtgttttttggtaaagacggggttttgccatgttggttaggctggtctcgaactcctgacctcaagcaatcctcctgccttggcctaccaaagtgctgggattataggcatgagacaccgcacccagcccgtatgtcaggtaattttggatggtactcttaatattattaatattattattatataattataatattatataatatataatatctttaatatattttattatataatatatactatatattatatattttattatataatatatactatatattatatattttattatataatatatactatatattatattatattttttattatataatatatactatatattatattatatattttattatataatatattacatatattatatattttattatatagtatataatatactttattatatattatatattatattataattttatattttactatataatatatataattaattatattatgattataatatataataatattaatatgattataatatataataatcataatattattaatattatgaatgttgagttctggagattttggattctgttgtttttctctgttaagtgttgtccattgcagcaagtccttttcttggttcggtttggattatgagctatgtgtcttgggcagtggctctggactcagttcagataggttgtgtttatatgagctgcttctatgtgtgtgtggctcatgagtcagagatgtgagtagcagacagaatctggggaccatctctctgtctctttcccttgggggattcccctgttctccttggtgcttatgggttcccaggtttgctttattaatgtccaaagacaggagttgccacatgtgcccttgctgctgtcctgtcaccatgtggactgtgcttagtcccaggtgcaaaaccttaggcatgggaacttacttccacagctccttggcccctttcctccagagagcgtgactcccatcggagtctgtcagcttttgttcaggtccaggttcctccatgtggttgccttttctttcgtatccgggttttatagttgttttctgcaacaggtggggggcctctgatagggtcttgaagaaatctaccttttcccattcttaacccatttatgcctggtgttccattattggaacgctaagcttgtgggagttatttatatcctactgctcaaggtcatcgccaaggtctgatttttcacaaaacattttgcaacctctggcataaatggcttaaaatccttttcatgccaaatttttattttaaaacccataattatttctgatccgtcttactctctttcccttttctccttctttatcaacattatctactgctgattattttatactcagctcaaacaaaaaggtaaggcgacgggtatgaataaaaaatgggaactgtggtagctaaacgattttataacccaagtgcatgttaagttatacttaagaaaagataaaaataaaacgacaaacctgatgaaccatagtatttatgttgagtaactaagaagttgagagccagactcaacatagttctacagtgcatttgatactcccactgtaatctatttttttccaatttttatctgtcaatacttaagtgttcaactgggtatcgttaagtcatgtcactactttaaattttatgtatagataattttagggtcctcttttatgtgaatgaatgttgtcttactgacttctttatatccaaggtaaaatccactgatagctgcctcttctttattaaatgctttgatgacaccattcatggcttccgggttcctaagaatagccttcagcagtcaagagaggtaatcttatggattcatgtatctttcctaaaacttacagaacatttaaagacacggagaatataacataggttcagtggtaacatccaacatcttgttgattgtacttttaatttttttaaatttttatttatttatgtttttgagacagagtctcactctgtagcccaagctggagtgcagtggcgcgatctcagctcactgcaacctctgcctcccaggctcaggcgattctcatgcctcggcctcctgagtagctgggactacaggcacgtgccaatacgcctggctaatttttttttgtattttagcagagacaaggtttcaccacattgcccagggtagtctcaaactcctgagctcaggcgatctgcccgccttggcctcccaaagtgctgggattacaggcatgagccactgtgcctggcctgattgtactttttaaatgaagcctttaaaatttggtacatgaattagttctttatcaacatgtacctgcaggtattttctgttcataatttgtttttcaattttaattctctgaatgtaaggggcatccttttaatgtaaatgacaggtctacgccttaacttataggtgaggaaactaaagattgtaagattgaagtgatttcccaaggccaggcagcttgtgagtgacagaacctggactacaagccaggcgttctgacactcattacaatggagactcagccttcctagtgataaattaaacaacagcagcaagctagaaaattgggatttacttgaccaatacttatggtgcagtcacttaatggactatccctattctttttttttttttttccgcccaggcttgagtgcagtggtgggatctaggctcattgcaacctctgcctccctgggtcaagtgattctcctgcctccacctcctgagtagctgggattacaggtgcatgccaccatgcctggctaatttttgtgtttttagtagagacagggtttcaccacgttcgtcaggctggtctcgaaatcctgaccttgtgatccgcccacctcagcctcccaaagtgttgggattacaggcatgagccaccgcgcccggcccttttctttttcttttatttatttatttatttagagatagagcctcccttgctctgtcacccaagctggagtgcactggtgtgatcttggctcactgcaacctctgcctttctggttcaagcaattctcctgcctcagcctcccgagtagctgggattacaggcatgtaccaccatgcctggctaatttttgtatttttagtagagatggggtttcaccatgttggccaggctggtctcgaacatgatccgcccaccttgccctcccagagtgctgggattacaggcatgagccaccgcggcaggcctattcttattcttttaaatcaaagcagtgttcatagacatatcttgattttttggtaaactatgtaagaggttaaaataatctattttccaaagtggtaaactttggccatgcaaagaaccctaaacaatctaactcatgactctcccaacatttcataaaatggtaagatttgaccctgagtatagtgtaagaaaatgaggaaaaagtaagatagggtatttttaggccaaacattctttttgtgaaatcactgttatttaaaaaatatagtaaaagttaatgcatcagggcaagtattggctgttttaatatgaccttagtttcttgtgcttctaatttgagtgtaagttagtaaaattgtgtgtctggatccattactatatagtaacttattctgttaggttataaaattacaggttctcaatattgaaaacgagaacctataattttaagtgacaaagttttctcccattatttaatttctgtaatgtgtttgaatattaacattcatgaatatgtaaacttatagatgatattttttaaagtactaggaaaagcttttatccagacatatcatggacaagagacccacattgctgtttcattactggttgctttgctttcccttttgaggccataatatttatttcactaggtaaattttatgcttatcagatcattgtaatattatctctttggaataaaaatgcttttcactctcatttaaattcttgcatgatttcaggactggctggaagcaatagaagaacattctgcttacagcactcactactgttcccaggaccagctgactgatgaggaggaggaagatacggtttctgctgcagacctgaagaaatcattagaggtaaataggaaaatgtaacctgacctttatagctatctatgtcatgaggtttaatcaagaacttttttctttaagatgtaaggttttgaaattatgatttctgacaacaatagaaatagtactgttcttcactgagttgcattgtgttggtagcttatgtctctcatggtaatactatcaaatgcatttgtagatatgctctgatgagatggacatgtgccttaaaggcactgtacttttttagctgaaactttttacgttgctgttaacagaccgtcattttgtttgaaagttgctgcgaggatggggagcatgcatagcttgacttgatgccctttatgacttcactgcacatttcagagtttaaataatgcaaccatagtgatacctttcctggttggtaggtttcctttaaaaccacttgtaatctgtagcttggttgctaagagataaggtaaagcatcattaatgaatggagaagtcttctgaagtgacaccagtgccttatccctagaggaatatcagcataggtaattgaaatgaaataggtgttttgaggggtcatcaattttctggctgtaccttttatttccatcttgtgtctaaaagaatgggaattgagttcggaagaattagaactatggaatgatgatgagtttcagtctgaataattacgtcaggatatatgaatttgcctactaaatttaatttttgtctttataaattaaatgagttggcggcaagatttgaatgtttctagttcaactttaatgaagttaaattccccaatacctatggagttttatcaacttagggacctttacattaaaatataaaaggtattttgactctttcaatccctaatcttaatttatgatggaacattaaagaatttgaactctcccatgtttgttgaagacattccccagaattgatgacaactcctttaccatactacctctggtttaaagcctaatgtgtatgtgagaaccataaacaaaattttcagatcagtgaactttgcaaaggtaacatctactacagcatttaagtaacattaaaactgggaaaatatggaagatttaaatacatatggccaaaattacattaaacaagtaaaaaaataaaacgatgctaaatattttaactttcagttggtattccctaattgaaaagaaatccttccctatttacctatcgtcaataagaggtaaatgataaaacctggaaggattgacaaagcatactaatatctttcctaggattatgataattttaaaagtttttaaatggaagttacaggtaaaataaaagcatactaacttacataccattaaaaatatttcttctttttttttttcttttcttttttttttttttttgagacggagtcttgctctgtcgcccaggctggagttcagtggcgcgatctcggctcactgcaagttccacctccagggttcacgccattcccctgcctcagcctgccgagtagctgggactacaggcgcctgccaccgcacctggctaattttttttttttttttttttgtatttttagtagagacagggtttcaccgtgttagccaggatgatcttgatctcctgaccttgtgatccacccgcctcgtccccgcaaagtgctgggattacagacgtgagccacaacatcccggcaagatttcttctttagcataattttcaaattttcaggtcatcaacctcgactatatctttcagtttattccttaatgttttgttcacatgttaactttaaaaccatgaagcttttgccttttagattttattgcacctagagttaatgagagttttagcactatagtgttaagcacttttacgttttgcatgttcctctccaacagagtttgaatgctaattctgtaaatcttttttttttttttcttttttttttttttgagacagagtcttgctctgttgcacgggctggagtgcagtgatgcgatcatggctccctgcaacttccgcctcccgggttcaagcgatcttctcgcctcagcctcctgagtagctgggattacaggcacacaacaccatgcccagctaatttttgtaattttagtagagacggggtttcaccatgtaggccaggctggtctcaagctcctgacctcaagtgatcctcccgcttccgcctcccaaagtgctcggattacaggcatgagccaccatgcctggccaatgctgtgaatcttgattctgtctcaacatctggagactggttcaaaataggtaaaatccaaaatgagctttgaagtgtgttgaatcatagcttgtcagtagactggctccaggatgcccttcattcttgagtttttaagttccagtgaaattcaggggccaatttatggaaaggtctattcttgatacctatagacattctaaggggaattagtcattctaggactgatatactctaaaatcatctgaattaacaacaaaactgattttatttccttaacatgcttttggattagtacacagacctataagaaatgagggaaaggctgaggtggaaggatcacttgtgcccaagggtttgagttcagcctgggcaatatagtgagtccctgtctcttagaaggaaagagagagagagagtgagttagtttttcagtataaacattttttggtaaacattgtcttatacaatataattctataaaacaagtcctagaattaattattgacctcatggttgttgctgtaatagcaacttgaaaatatttcagaaataaaaattagaaattaatcaagcatggtattggtatagaactgcgctgtccaatatgatagctattagctttcctgtggctatttacacatgtggctatttacatttaaattaattaaaatctaaaaattcagttattcagctgggcacggtggcttacgcctgtaatcccagcactttgggaggctgaggtgggtggatcacttgaggtcaggagtttgagaacagcctggccaacatggtgaaacttggtctctgctaaaaatacaaaaattagccaggcatggtggcgggcgcctgtagtcccagctactctggaggctgaggcaagagaattgcttgaacccagcggggcggggcgcacaggttgcagtgaggtgagattgtgccactgcactccagtctgggcgaaagagtgagacgactcaaaaaaaaaaattcagttgttcattttaactatatttaactacatattagccacatttcaagtgctcagtagccacatgtggctaccacaacggacagcgaagatatagaatatttccagcatcatagaaagttctattggacagtgctgggataggctcttagaggctctgggtggtactagcaaagtgggggttttatttgttgaagatgtcttgattctgtaggatctgaactgtttttgtgttacaagaagtgatgagcaggccaggcatggtgtctcacgcctgtaatcccagtactttgggaggctgaggtgggtggattgcttgagcccaggagttccagactatcctgggcaacatggcgaatccccatcttaaaaacaaattttttttttttttttaattttgaggctgaggctgcagcaagctgtggtcacaccactgcactccagtctgggcaacatggcaaaaccctgtctctactaaaaatacaaaaattagctggacgtggtggcccatatctgtagtcccagctacttaggaggctgaggtgggaggatcacctgagcccaggaggtggaggttgcagtgagccaagatcacgccactgcactccagcctgggcgacagagtgagaccctgtctcaaaaaaaaaaaaaaaagtaatgagcagatgatgctcgagtttaatggaatgagaaaataagataaagcttttctgatttaagaataaatgattcccgaggcgggcagatcacatgaggccaggagttcgagacaagcctagccaacatggtgaaatcctgcctcaaaaatacaaaaattagaaaggcatggtggtgcacgtctgtaatcccaactacacaggagcctgaggcacgagaatcacttgaacctgcgaggcggaggctgcagtgagctgagatcgcaccactgcactccagcctgggcaatagggtgatagagccagcctctctcaaaaacaacaacaaaaaaagaataactgattcccaactaaaataaatgtgcagaaagttgcatgtacatccacgtggagctaataaagattggtacatccatgcaagaatgaggcagatgtatatatgctgatatatttaagatatacagttaagtgaaaaggacaaggcataaaatgatgtaccaaatatgatactacttgggaggaaaaaaaacagggatgtacacatatatatttgtgtagacttagatcattcaggaaagatgagaaattagcacttgttgctctgcagctgagaaagctgcaaaataagattgtcaagtgtgtgaaggagaattacttttctctctatatccttttgttttttatttttactttatgtaaatacatattgcaaagtgaaaccctaagaaagttacaaagcaggggcataataatcgccagatgtcagaaagaataaatgtgcttttgggttgacttaggaaagatggagtatgggttattatttttttctttttgagacagggtctcactttgtcatccaggctggagtgcagtggtgtgatcacagctcactgcagcattgaccacctggggtcaagtgatcctcctgcctcagcttcttaagtagctgagactataggcatgtgccaccaagcctgggtaattttttcattgttttgtttttgtttttgtttttttttttttgtagagattaggtctcattatgttgcaaggaaggtctcgaaatgctgggctcaaatgattcttttgcctcagcctcccaaagtgctgggattacatgcatgagccaccgagcctggccagagtatggggctatctttgaagtggatttggctggagttaggaagacttagagataagtgctacggcaccactgcttgtaatagcggccattttctgcaaagaagaaagtgatcagagtttgacaatctattatttttaaagtttgaattaatattgaaatataatgtttgcagaaaaaaggaattcactttatgtcttcaatttgatgtattctgacaaatgtgtattgtctgtgtaaccaccactcctatcaagatagagaacatttttattatgtcaaaatgttgttcccttgctgctcttcccagataataccctccacttccatctctggcaaccactgacctaatgacactgatataatgacaatgtcattataagcatgatcagttttcctgttgtagaatttcatgtaaatggaatcatacagtatgtgctcttaggtgtcttttttcaccgtaatgttgtgtgtattagtagtttattcatttttattgctgagtaggtggcaatctgcttctgtgcttaattaaccaaatgtggattttctgcagcaaatagcctggaattaattacttctctactagcctatgcattcctctctagctattcacccccttgatatgcattttcgagctgccctgtaggttagggatcataaggtaatttaacatcagcttaactcatacaaaaccaacagctaaaattttggtttctaagcaggagacctgtgttgtaaatgtggctcagctgctcacctggggtaacttctgatcctctaggcccctgtatcaatgggtttaatccttgttcttgtgtgctttgtccagataacttgggcaaagttaaaatactgttaaactttaggtattataacattgctcatagtgagattccatttatgtagaataaataaatagaaattaaaacttaaaaagagtccctgtattagttcgttctcatgctgctaataaagacataccccagactgggtaatttataaaggaaagaggtttaattgattcacagttccacatggctggagaggcctcacaatcttggtggaaggtgaaggaggagcaaaggcatgtcttacatggcagcaggcaagagagcttttgcaggggaactcccctttataaaaccatcagatcctatgcggcttgttcactatcatgagaacagcacaggaaaagcccacccccatgattcaattacctcccaccgggttcctcccacaaaacatggggattattggagctataattcaaggtgagatttgggtgaggacacagccaaatcatatcagttcctgacataatatcaatggcatagaagtcaaaaatgagaaaccatgttggactctgcaaaatattaataagaattaactttcataaattgatttttagtttttcaaaatataactagtagcgactaagcaaatgggagaccatattatgttttattatattaataacctcttctttttagtatcttttagtatcagttaaaaagcactaagttgtttagaacagaagacatactttgtacacaacttaaaacagtatgtgtagattggatcttctccagctgacctgttatgtaccctttaaaacaagtaaatcgtcgatcaaggaaacttattaataactgttagatggaaatatgattcaagggaagataaatgtgattcatgtatttgaagatgatgctatagaaggtgtttcctgcctttaattataacttaggaaaactatcctgtttattacagattcatagtctgcaattgaagccattgcttacttttatgcctctagcttactttcatcataggaaggataaaacagtatcattgacttgcacataagcagagtattaaatatgtatagagcaagaatgatgattttctattcatcatgagtgatgcatttggttgcagtgcatgttttggtgcctctagataaactttttccctgcccctcaacctgtattcacaggctgtgtctggaaaaattatcaggcatatatggtgttttaaattgcatagtgtaggtattctccccctgctctccaccaagtgaatggtacgtaggtgttgttagagccctcaaaacaaaggagagtaatacaaattttgaagagaatattgcctgtcactaatgtgataacatgaataattctactgtggttgagttgaactttgtaagcactaaaaaatttataaggtgaaataggagaaaagagtatttacctatgccaccttgacatactgatctatagtaagtttgattttgggggtgcaaaatgttttgtgatgggctagctgagattaggagtacaaagtagggaagtttcataaggctaaatatattactctacctaaaagaatgtgattcgattgtttataaggtcaagattctcagaataaatattttctattttgataaccaagcaaatttacaataataattttcttgcttattcttcccacctctttaaagggaaatgatatataaaactgccttcaaaatgacatttttaatgtaataaatggatttgactgatctttcattttggatttctaaatctgcactaagatgggatgtaactttcatcaagaaattctatatttatgtttttttgcctttagggatctaaaaatgtagaactttcaaattacaaggaagaatgctttctataattgactttaccttattttcagaagctttgacacactaagaaaatgtcctttttggtttgatgatgtgggggctgtatgcacttagattgctgaacgagaatcagcttgtggtttccaaatgttaggaccatctggatttttttttctgaacaaaacagtttttaaaatatatttttaaggaatgcattttataatttcttgatgaatttcatgaggcctactaaaagtgctaataaatcagagaattataattcctcagatacacatggcataatgagatagtaatagtaatggatgcaattgtatggtatctacacaacagatgttgaatgtatttaaacctttaaaatatttatttttactttacacttgattaaatgttatattcagtttacaaggaaattttctctcacctttttcttttctttaaggcatatgtctctgttatggtatatcaatctatgtactgaaagttttgatagaaacactaaagcataagtaatgtaaaatcttttattactttgttttaattttgtcttttctttttttgcagaaagcacagtcatgccaacagcgactagatagggaaatttccaactttctcaaaatgattaaggagtgtgacatggctaaaggtaaaaagacaagcactatccctacaatcactctttaacacatagatactgacctgttgtagttttgtttgacttcatttttaaacagtttttggttttgaattaagagttatatttgataaaactattttgaaactttaaaagggcaatttaaagtttctactcacagaggatgcttgctttagagattaataatgtttttatccttttaaaaaaagaaagataagtttaaagttaatgtttttggcctgtaaattaattttggctgcggaatgagaattctgcttatgaatcccagaagacttgggttttggagtcagaatgtctaaagcttgaggcctggcgcagtggctcatgcctgtaatcccagtactttgtgaggccaaggcatgtggatcacttgaggtcaggagttcgagactggccttgccaacatggtgaaaccctgtctctactaaaagtacaaaaatcagccgggtgtggtggcacgtgcttgtaatcccagctactcgggaggctgaggcaggagaatcgcttgaacctaggagacagaggttgcagtgagctgagaatatgccggtgcaccctagcctgggcgacagagcaagactctgtctctctctcacacacacagacacacccacacacacacacacacaaagaatgtcttaggcttgaatccttactcttccacttaccggctgttacttcgaacaacacttttaactcttgcgagcttcagtgccctcatccataaaataaagaagttggttgttttaggccttggccttttatgcttctataaatgtatatatgatcttgtctagctaattattaatcttcctttcagtaataactttttatgtcttcattctctattatgagttctcaagagttgactataaatagcctacaaggctgggcgctgtggctcacacctgtaatcctggcactttgggaggccgaggcggtggatcacctgaggtcaggagttcaagaccagcacggtcaacatggtgaaaccccgtttctactaaagatacaaaaattagctgggcgtggtggcacgtgcctgtaaccatctactcaagaggctgaggcaggagagttgcttgaacccggaaggcggatattgcagtgacccaagatcgcgccactgcactccagcctgggcaacagagggagactctgtctcaaaaaaaagaaaaataaatagcctacaaatcaaacttaagtattgagaaaaaggtgcctattcctgtgtaaattaaaaaattatgtttcttaaactcttaacagatgcttagactttagccatgatgcatatataaatgacttcaccaaagtataaatgatgtagttatttgtgagtttatgattaactttttttttttttttttcttgagatggagtcttgttctgcctcccaggctggagtgcagtggcgcgatcttggctcactgcaagctccgcctcccgtgttcatgccattctcctgcctcagcctccagagtagctggggactacaagtgcccgctaccatgcccggctaatttttttatttttatttttagtagagacggggtttcaccgtgttagccaggatgctctcgatctcctgaccttgtgatccacccgcgttggcctctcaaagtgctgggattacaggcgtgagccaccacgcccggccatgattaactattttaatcacatgttagtttcctttagtcaactccaagattcagtttctatatttccagagaatgtgaggaaatgttaatattagagtaaatggaccataagtattctgtatctgtccaagtgtacctatggcatctctttacttcagttgaacaaacatatatttttatcagcagttatagccttgggaagggcagtggttaggttattttgattattagttgcaggctggagtattatattacttagcactgttcattctcaatagactttaagataataacggtgtcatatttggtataattcacataacaaaattcacacatgtgaagtgtacaattcagtggttttactctattcacagagttatgcaactatgactgtcattgagcttttaaaacacgtcaagaactaccaaaaagtagggagatttaaaagatgtagaaacattttaaagatgtagaaaagcacatttaaaagatgtagaaaaagtccagtgatacgaaatatgaagattaattcatttaacctggaccacatcgataaattatatcagaattacaaccaaattaagttttaaaaagaatcttgagtcaaatctcttgtttcagattgcctgtatgacatgtcattcgtaatgatggtatgtatatctgtattagcaatgattgagcagataattaatccaacttggagaaactgagaagaaatcaacattgtttagagatatgcgtaatattgatactacaaaagagataattatggacattttctgaaaaatcagtacagataaactgcattttacataagtaataatagggttaagatgatttgatgaatggaattggagagttgaatgtaattgagcctgcccttactgtcaagggtttgtacaggatagtcttttacctgccatgtgctttattaaagaaaactgatattagccaggcgtggtggtacacacctatagtcccgggagggtgaggctgaggtgagaggctgacgtggtaggatggcttgagcccatgaggcagaggttgcagtgagtcaaggtcatgtgattgcactgcagcctgggtggcagagccagaccctgtattgagagagagagagagagacagactgatagataggtattctgctccagacttcttacatagtctgccagtgacttaagataaaaaacaaaaatgtttgtagacagaatccagagcttatagttgtaattgttagttgacttacattttagtacaaaattgcattaactttaagacccagatcacttccttcttattccaatttctgccatacttgttgagttctatatcccctcaaatccagatcactgcagcagcctgccctttagtccctgtctcctgggactctccctgcattccatccttgagggtagttgaatcagaagcctttaaggaactcttctaactcagattctgtaaagtactgcattattgctgccagattaattttttgtaaaggtactttttggatcataattttttacattgaaaatcttttataaatccttgcaactagagaataaaatgcagacttatctgggcatttaaagattttcatagtctggccacagcctaatttcccagcgttattttcagttattctctcccatgactcctagaaacacccttgaccaaacgttgtgtctttgatcggaaatgctgtctattgaaatataccttttattttcttgagtggaccttaaacctaatttttgtctgaatgaatatcagagtttctgtatatagtgttgagaacacataattcaaggttcaagaatgtagtattgaaatttttactattttatctttatcaaaagcctggttgcaaaaacaaaatcacctaaagtaatgaaacttttggaagacttcctgaaggccatgttatcaatccattcttccatacatccttaaatgtaccattgtgtatccaatttttgtctagtataaatatattgtgcatttatatttgatcacagtaactcaggattcttaggatgggattagtgggtgaaaatgtatgaatatttttgagactgttgatacatatagttaaattgccgaaaaagatatgttattttacatgccaacttttaatacatatactatattgcatgttactaaatgtgtatagtgaatacttggttaaataaattagaaggacttcacttatctaaaataaaaaatcctttataagttacctgatgctcttgtctgacagctcttagaattctttccttcatgttgactttagatagcctgatgattaacagtagacttcttagcagaaaccttataagctggaagggattggggtcctgtctttaacctccttagacagaataactgtcagtcaaacttttttttgtatccagaaaactttttttttgtatccagaaaaactaagtttgataaatgaaggagaaatgaagtcattttcagacaaataaactctacgtgaatttgctactaccaaaccagcactacaagaaatgccaaaaggagttctaaattgtgaaacaaaagctcaatatgtaccaaaatagaactggttggaagcataaaactcacagggcctataaaacaataacacaatgaaaaaaaacaaagtatctaggtatcgactaacatgatgaatacaacagtacctcacatctcaatattaacattgaacataaatgtcctaagtgctctacttaaaagatacaaaatggcagccaacagataaaaaaatcacaaaccaaatgtcttctgtcttcaagagacttgcctaacacataaggattcatataaactcaaggtaaaggggtggaaaaagatattccatgcaaatgaaagccaaaagcaggcaggagtagctatttttacatcagacagactttaaagcaataacagtttaaaaaagataaaaaaggtcattacataatggtaaaaggatcaatccaagaagaagatattacaatcctaaactttacatccacctaacactggagctcccagatttataaaacaattactactagacctaagaaatgagatagacagcaacatggtaatagtgcgaacttcagtattcctccactgacagcactaggcagatcaagacagaaagtcaacaaagaaacaatggccttaaactacactgtggaacaatggactgaacagatatttaaagaacattctgttacaggaaaggggtcccaatccagaccctaagagagggttcttggatctcatgcaagaaagatttcagggcggccaggcgcggtggctcatgcctgtaatcccagcactttgggaggccgaggtgggtggaacacgaggtccggagatcgagaccatcctggctaacacggtgaaaccccgtctctactaaaaagacaaaaaattagccgggcgtggtggcacacgcctatagtcccagctactggggggctgaggcaggagaatcgcttgaacccggggggtagaggttgcagtgagccaagatcgcaccactgcactccagcctgggtgacagagcaagaaagaactcagggcaagtccacagtgcaaaatgaaaacaagtttattaagaaagtaaaggaataaaagaacagctactccatagacagagcagccctgagggctgctggttgcccatttttatggttatttcttcatgatatgctaaacaaggggtggattattcatgcctcccctttttagaccatatagggtaacttcctaatgttgccatgatatgtgtaaactgtcatggcactgttgggagtgtagcagtgaggatgaccagaggtcactctagtcaccagtttggttttggtgggttttggccggctcctttactgcaacctgttttatcagcaaggtctttatgacctgtattttgtgctgacctcctatcttatcctgtgatttagaatgccttaaccatctgggaatgcagcccagtaggtttcagcctcattttacccagctcctgtttaagatggagttgctctggttcacacatctctgacaactctacccaacaactgcagaatatacattcttctcattagcacgtggaacttctccaagatagaacacatgataggctgtaaaataagtctcaataaatttaagaaaattgaagtaatatcaaatatcttctcagaccacaggggaataaaactagaaatcaactccaaaaggaatgctcagaactatacaattacatggaaattaaataatatgtttatgaatgatttttgagttaacaaatcaagatggaaattaaaaacttctttgaaatgaatgatagtagtgacacaagttatcaaaacctctgggatagagcaaaagcagtgctaagaggaaagttcgtagcgtttaatgcctgcattaaaaagtcggaaagagcacaaattgacaagctagtgtcacaaaaaatacaaaagataaatgaaacaaaaaactggttctttgaaaacataaacaaaattgatagaccattagtgagattactgaagaaaagatgagagaagatccaaataagcttaattcgaaattaaacaggagacattacaaccaaaaccatagaaatacaaaagatcatttgaaactattatgaaaacctttacatgcacaaactaaaaaattaagaggaaatagataaattcttggaaacacaatcctcccagattaagccaggaaaaaacagaaaccctgagcagaccagtaataagcagttagattgaatcagtaatttaaaaattgccaacaaaaaaagcccatgaccagatgtattcacagctgaattctactggaattcaaagaattggtaacaatcctactgaaactattccaaaagaaagagaaagaaggaatcctccctaaatcattttatgaagccagtatcaccctaataccaaaaccagagaaggacacaacgaacaaggaaaactacagaccaatatccctgatgaacataggtgcaaaaatcctcaaaaaaatactagctaattgaatccaacagcatatcagaaagataatacaccatgatcaggtgggttttgttccagggatgcagggatgctttaatatatgcaagtcaataaatatgatatatcacaaacaattaaaagtaaaaaccatgtgatcatctcagtagatgcagaaaaagcatttgataaaatccagcatccctttatgttaaaaactcttaataaactaggcatagaagggacttacctcaaaataataaaagccatatatgacaaacccatagccaacatcatactgaatagggaaaaattgaaagcattccctctaagaactgaaataagaaaaggatgcccacttttaccacttcctattcaacgtagtactggaagtcctagccagagcagtcagttaagagaaagaaataaagggcatctatgtggaaaagaggaagtcaaactagtgttgtttgccagtgatatgatcacgcacctagaaaatcctaaagactcatccaaaagactcctagatctcataaacaaattcaataaagtctcaggttacaaaatcaatgtatacaaatcagtagcacagctgtacagcaacagcgaccaagctgagaatcaaatcaagaagtcaatcccttttacaacagttgcaaaaaaataaaatatgtaggaatgtgcttagccaaggaggtgaaagctctctacaaggaaaactacaaaacactgctgaaagaaatcatagatgacacaaataaatggaaacatatctcatgctcatggatgggaagaatcaatattgtgaaaatgaccatactgcccaaagcaatttacagatgcaatgcaattcccatcaaaataccatcacaatttttcacagaactagaaaaaaaatcttaaaactcatatggaatcccataagaacctgaatagccaaagtaatactaagaaaaaagaacaaatctggaggtatcacattattggactttaaattatactgcagagctctagttaccaaaaacatcatggttactgttatggagaaaaaaaaaaaggctcttagaccagtgaaacagaatagagaacccagaaataaaaccaaatattatacagccaactgatctttgacaaagcatacaaaaacataaattggggaaaggacggcctattcaatttatatatttgaaaaaaacataaattggggaaaggacagcctattcagtttatatagcttttccccaaaataggctatcctttccccagtctatgtgctgggataattggcaagccacatgtataagaatgaaactggatccccatctctgccttatataaaaatcaactcaagatggatcaaagacttaattctaagaccagaaagcctaacaattctagaagataatattggaaaaactcttctggacattggcctaggcaaaaattcatgactaagaccccaacagcaagtacaacaaaaataaataaatggaacctaattaaactaaaaagcttctgcacagaaaaagaaataatcagcagaataaatagacaaccagagaatgggagaaaatatgcaaactatgcatccaacaaaggactagtatctgaaatctgcaaggcactcaaacaaatcagcaagaaaaatacaaataatcccatcaaaaagtgggcaaaagacatgaatagatgtttctcaaaagaagatatacagttgaccaacaaacatataaaaaaatgctcaacagcactaatcatcatggaaatggaaatccaaaccacaaggagataccatcttactcctacaagaatggccataatgaaaaagtcagaaaacaatagatgttggtgtggatgtggtgaaaagggaacactttcacactgctggtgggaatgtaaattagtacaacctctatggagaacagtatggagattccctaaagaactaaaagtagatctactatttgatccaacagtcccactactggtatctacccaaaggaaaagaagtcattatatgaaaaagacacatgcacatccatgttcacagcagcacaattcacaattgcaaaagatgtgggaccaacctaagtgcccatcaaccaatgaatggataaataacgtggtatttatacaacatggaatactactcagccacaaaaaggaatgaaataatgtcttctgcagcaacttggatggagctggaggccattattctaagtgaatggaatacttagaaactcaggaatggaaaaaccaaaaaccatttgttctcatttataagtgggagctaagctttgaggatgcagagacttagagtgatatggtctttatggactgggaaggaaagagtctgggggagaaattaaaatctacatattggaccgggcacagtggctcacgcctgtaatcccagcactttgggaggctgagtcgggcggatcacctgaggtcaggagttcgagaccagcctggccaacatggtgaaacctcgtctctactaaaaaaatacaaaaattagctgggcctggtggcgggtacctgtaatccccgctactcaggaggctgagacagaagaatcgcttgaacccaggaggaggaggttgcagtgagccgagatcgcgccactgcactccagcctgggcaacagagcaagactccatctcaataacaacaccaccaccaaaaaaaaaaacaaccacatattggatgtagtgtacactgctcaggtgatgggtgcactaaaatcttagacttcttcactaaggaacttatgcatgtaaccaaacaccacctattcccccaaaactattgaaatataaaagcaaaatagtcgaactcaagaaaataaaactgaaaaaaaaaatctgagaggaaaagcacttctatttagcctacttaaaactgtttcctcaaaatctgggctttgagtaaacaaacttaccactttctctgttgccacctggtccaagccaccattgcctcccacgtggacatctgaaaacctacttgctgtccccagatttcacccttccccctacagcttctgccccaaatcctcccaaaatgtcagtggattgaggtcctttgctggaaacatccagtggcttccagatcttctcacttggagtgagagacagagtcattctaatgacctgcagagccttccagccccttccacccctcagccccccacctcccagttccctttctggctcctctccagcctcattggcctggcctacgcctgccagtggcctttcgtgtgctgttccctcttctggaaggcttttctcctgagtggcgtagtcactcccttccttccctaggtctttcttcaaaaggtgcctgcacacagaggattttcctggcctcctgcgctggtttgctcctcctcgtctgctctgccctgctttgtgtactgcagcctcagccctggggcttcttggccctcggacttgtgattggattcagcaaatgggaggctctgtcgggagacctgcggagggacgggagaggaagtcgtttcagggctttaccttcattctctccagccggactgtggttccgcagtgctgccgggttcctctgcctggccactggcctgatctagactccagctcttgctgggcttagcaatactgtcctctcccctttccccctctgtgccaggatggtaactgtgtcccgcacgccagtctctgttacttcaaccctcctcacctttgtgagcaatctctttttcaaattcttctcagttaacgttttaattttttcttttcttttcttttttttttttttttttttttttgagacgggagtccctctctgtcgcctgggctagaggcagtggtgcgatcttggctcactgcaacctccgcccccaggttcaagcgatactcctgcctcagcctcctgagtagctgggaccacaggcgcgagccaccacacccggctaatttttatatttttagtagagacggagtttctcccttttgggcaggctggccttgaactcctgacctcaagtgatccacccacttcagcctcccaaagtgctgggattacaggcgtgagccactgtgcccagacctcagttacctttgagcaggccagctcttccctgctgagacccttagctggtacctcatcctctgtgaagttcacctcccctcagcacttgttacccctctaccttactgcagtttctcttttgttacttatcagacttcctatgagtgtgtgtagttgattgtctgcctttcccaccgtggtataaacttcagggcagggatttttacctgtttgccgattatctttggtacctcaacagaacttggcatgtgatgggggtctctctctcctctctctcgccgtctctctttctctctgtgtgtgatgaatgagtgagtgaaatgaatgacctacttatctagcttaaatttataccttatatctctcaaactcagggagaaacaataaatttctgtcaagttagtaaatttaacgagtgtacaagtcaaagagaccttttagagacatgaaatagggaagaaaccatcagaactgtggcatattttgcattcttttgccaagagggtttccacagttaatgccactgatttttatatcctactcctctcccctgaattctgttttattttctgaggcaaatctttgagtaattctttcattgggggtctgtgagtagaagaatttctaccttatctaaatctttatttcaccctcactgggttatagttatcttccactagcattttgaagatgcaattgcaatttattctgacttctgatattttcttttttctttttgagacagagttttgctgttgctcaggctggagtacagtggcgcaatcttggctcactgcaacctctgcctcccaggttcaagtgattctcctgcctcagcctcctgagtagctgggattacaggtgcacctgccaccatgcctggctaattttttaaattttattttaatttattttaattttttattttttagtagagacagggtttcaccacattggccaggctggtctcgaactcctgacctcaggtgatccacctgcctcagtctcccaaagtgctggaattacaggcaatctctcgtttttttttttccctgtcccccaagtccccttttgttactgcaaagatttttcactttgtttttggtattctgcagttttattctgtctctgggtttggattttgttgttctatagcttgcttgaaactctgttctttaattcaaggactcatttattatctttctttaagttagaaaagttcttagctattatctcttccaattttacttcatcattctttatattctctcctgccagaactcttaatagacatatgttgagccttctcgttctatcctcctacctcatttcttattccatttctttctgttgcattctgagtacttttcttagttctattttctagctttagtttctttctcaatttagtcagtttttctgcttaatcttttgactttctactttctaatcttagtgactgtattttataattctagaaattttagttggtggttttaaaaatttgttatttttccccatagtgacatgttcttttatattacatgcatttctaattttatctctaataacttcagacatatgaatttaaagcatttttttcagaatgtttttatacctcaagttgttgcacagctaagtcttttgtttcttctgctgaatgtccatcacaatggattgtaactttatggacagctcatcttcagtagagcttgtgggtttttttgtttgttgtgttttattttgtttttgtttttcctgcttcttgggtttggaggtgtccatatagagtagttttgtgtgtgtcgctgttgaggctgtaaaggtttctctgcttctgggctactagttttaaatttggatttcatatctaggcatgctacaagctaggggcttcagtttctcaggtttcccacccagagcttaggcaagaaagtgtccttcttccctgcatccctgagcacaagggcagttttctactcccactgtcactaggggtctgcccctttactagaccttacccacttgatttgggaggccaaagccacatacctccattcatgtagctgtaaagcctcatctattttgttgttgttgttgtgttttgttttatttatttattatttatttattttttggagacagagcctcgctctgttgcccaggctggagtgcagtggcaccatctcagctcactgcaacctccgcctgccgggttcaagcgattctcctgtctcagcctcccaattagctgggactacaagcacacactgccacgtctgggtaatacttttgtatttttagtaaagacagggttttatcgtgtcgcccaggctggttttgaactcctgagctcaggcaatccacctgcctcagcctcccaaagtgctgggattacaggcgtgagccactatgcctggccaggctcatctgttaatcttctggatgtatgttctgtctgacacccacctctatccttgaccttcctaccaggcatcactggttaggcctgttgcatcagccttgccttttgtttgtttctttctttctagcatatctgggattttattctttcaaactctgcactacattattttactgttttattcggtgtctttatggattgtgattggagagatggtcccatcagcctagtctgctaggtaccaccagtgtcccatgctctttctaatataaaacatgtcaatactctacaatttatattatctagtataaagcaaacacatatagcctttttttgtacattgtcctgtgtatttgacgtatagatagtccctaacttacaatggttcaacttatgatttttcaactttacaatagtgtgaaagtgacattttcagtttatgatgggtttattgggatataaccatactgtaagttgcggagcatctatattaacttatttgtgcctggtaacagccctatgcagtatatacaactattctttccattttacaggtaagttgactgaggcacagggagcctatataacttacttaaggtcacagagcttgtaaaaaccagagttagcatttggccctgggcagcctggctccagggtgtgttcttaaccaataaacaggctggcatggtggctcatgcctgtaatccgagcactttgggaggctgaggcggcagatcacctgaggtcaggagttcgagaccagcctgcccaacatggcgaaaccctgtctctactaaaaaatacaaaaattagccgaatgttgtggcgtgtgcctgtaatcccagctactcgatcctgaggcaggagaattgcttgaacccgggaggtgggggttacagtgagccaagatcatgccattgcattgcagcctgggtgacagagcccaactccatctcaaaaaaaaaaaaaaaaaaaaacaggaaaaaacaataaacagtctggaatgaatatcaaaaattcagtgttgacccctgaacatttgatctaggaataggaggaacaggagaagtttttcagatttataaccagatctacaatgtaaggtagaatttgttgaggacaattacattagcttggctgttgtagttaagatagtgtttaaatcttcattgtcttctactcagaagttcaagggtagagggggattgatgtagagcaggagtttcctttccacaaaaaagaaatcccccttttttgctgttgttcttttccttctcttttcttgtcctcattctttctgttcttcatccctaaaaatacatcatcaattcactcaatttcccaagaccaaactttggagtcattgttcttcctctttctccaaatatattttgttgatcagttctcccattcaagtactaaccaggcttgactctgcttagcttccgagattagctgagattgggtgtgttcaggctatagatagtcctgtctcttaatatcactttactttgtttctcttcctatgtccccctaccattatgctaaaataggccatagccatctttcccattgattaccacaacttcttggctggacacactgcctccacaatttttttttttttttttgagacagtcttgctctgtcacccaggctggagtgcaatggccgatctcggctcactgcaacctccgccttccaggtttaagtgattctcctgccccagcttcccaagtagctgggattacaggcgtgtgccaccatgcccagctaatttttgtatttttagtagagacagggtttcaccatgttggccaggctagtctcgaacttctgacctcaggtgatctgcctgccttggcctcccaaagtgctgggattacaggcgtgagccactgcacccagtcctgcctccactcttatattccttcatttacctccatggaatattccacagaatagttagatgcttctgaaacaccaattggaatggtcacagccttaacagaagcattcagtgccttagggtataatctaaactctaagttgactgactttatgacctgtgtgtctactcacttcagctgcttcctctcttaactattccttccttccttctacactctgtgcagcaacagtgaccttttctcatgcatttgggtcttagcgtatgttgtttccaaggtatgaaatcgctttttctcatcttttacatgtagtttccagaaactcctccttgacttctctaagactatgttcttatgtgttttcagatcaccctgcactttgtctaccatagcactagccactctttaatgtaatgcttcctgtttccatttctctctctgggcaggcccagcctcctcaggtgttagaagggacagaaagagcaagcaaaggtacaggccacaacagttgcccctattcaggcctgtcgtacagggcactggagagtgagcttctgtctttggtccaagctttctttcaggcagcaaggttgaagaatccaataggtgagacagtgtggctatgagactacgtgatttattgctcacttttacttctgccaaagtctattttattttattttattttattttattttattttattttatttttgagacagagtctctctctgttgcccaggctggagtgcagtggcacgatctcggctcactacaacctctgcctcctggttcaagcgattctcctgcctcagcctcccgggtagctgggattacaggcaagtaccacctcgcccagctaatttttgtatttttagtagagacagggtttcaccatgttggccaggttggtctggaactcctgatctcaggtgatctgcctgccttggcctcccaaagtgctgggattgcaggtgtgagccaccatgcctggcctacttctgccaaagtctagaagacaggcaagcatcataccctgaagctctctcaagcactcagaatggataaactctcttatgtcatccagttctgcaccttattctttgtggcacagacctttccaagactcctctcttgaccttggccataggtggccctttctagatcatatgtggctcaaccctagttaccatttacttcattgactccgtttttctcataaggacttaccataaggtggggaacccattggacaattcaatcagaagtgatgcaaacccagttataccctttgatgaagatttcctcagtttgattaaaattaacttccttattgcctcacttcattctcttttgcaagagagtacaaaacacattctgtagttctgctggcttctctcctgttttgtttgactccaggtctttgtgacttgtactcttttctaaatttttaaatgtaattcattttattttttccaaataataatatccttctcctcttactcttctaaagtctccctttgatcagtattattctttcaatagtaattgttttattttccattttccttgctagacagcaagctctgtaaaaacaaagactgtctgtccaacttacccctttttctccagcacttagctggtgcctgccacgtggctgccactccataactggcagatgaaaacctctcaccttgctagagttctcattgatcataattctgaaactatcttccctcaggactagtatatttggcactctattttagaagtgcttattgggtttatatttagcaatacaaaaatgttccttgttctttaagatccaactcaagtgcaacatcttttcatcaaactatggattattctagtccataatgacaatgctcttctctgaaattttaatattttttaaaagtatgcacaacttgctagttatgtctcacaacatccctgatattatctttttattattcatttaatacatgccactttgagctatatattttatatcctccagtgcaatgaatataaattatatagatgtagatatatagattaaatggtcagaggtacttcttcagtggatgattgtattcaaggtagtcattttaatttgaacaaaaaatagatttctatttttatgtctttcagcatgacctcttttgatatttttcaagttatagttttatggagtagtttttagaaggttagttgatttttatgtgcaaacattttttccctgttttgaaaagagagtactgattttcattgaagcatttatataattccaatctgatatgaaagtccattttgtttatttattttttgagacagagtcttgctctgtcacccaggctggagtgcagtggcgcgatcttggctcactgcagcctctgcctcctgggttcaagtgattctcttgcctcagcctcctgggtagctgggattacaggcacacgccatgatggccggctaatttttgtatttgtagtggagatggggtttcaccatgttagccaggctggtctcgaattcctgacctcaggtgatctgcacgcctcggcctcccaaagtgctgggattacaggtatcaaccaccgcgcccagccttgaaagtccattttaaaatggacttcaatcatttaggttagatcaggtctttcatgtatatagtcattatgtattgcatttttttacaccacaaaagataaatcatcccattttgttattttctgtattttctctgatctttagctttgtcactagattttgtagtttttggactatttagtctctctcctgtttgtgtttaattattaaaaaaagccacatacatattcaaggtagcaccattaccagaagggtaaggatggggaaataaaatgccttcatccagtttttttcttttaaatacttgtcccaaatgatggaaatatttcagttaaatgttgaaaaacaggcaaaatatattttcttgtgccacaagtaaaaaacaaaatgtagttaaaaattacttatttctcaatctgccctaatcaaccaacctatagtaatataaatgaaaaagttttcatttcacatttttaaactaaaggaccataattcttttaaggtaaaatataataagtgaagccatttggattcagattatattttatattaaaagaattatggtagcaagatgtggaataagatattttattagtttccttattcatttaataaatatttgagaggttttattttggcaaagcttggtgtttggatgggggtaaggaggtttagagtttacagagggtcacagagagacaacatacattcaatgcctcatgcccctataacaagtgggtgtggccgctgttggagtccaggagcagctgctgtcatgtcccatggtgatattttgtcgtcgttgttgtttttagagacagggtctttctctgtcgcacaggctgaagtgcagtggtgtggtcatagctcattgcaaccttgaactcaagtgatcctcctgccttggcctcccaaagtgttggcattacaggcatgagccactgcacccattctccacagtgatatttaaggaaggcttcctgggggaggatggcatttgaactaggccttgaaagaaaatagttttttttgtcaagtagggaaacttctgaatatggataattattgtttccaatattcaagtaacatgtcaatattcagcattcaacatccaatattcaccaatattttgaagactgtttttaggtaaacaaacatttccaggagaacaatctggctgaaacaaatttagtttattgagcatcttaaatgttaggctaaggaaatgtggacttttttttttttacactaggataacagtggaggttgtctgtacaagggattaatttgttcacataaagaaacaagtgttttcccactattttaaaaacttacccaattaaaaattgttcagcgtaatcatgaaaaatgacagattgtgagctttttatgtctctaaagttaagcttttccaatatgatcttctcacagctttcatgactttaaaaacgtttttagtacgaaaaataacttttttcctgaaaatcaacagcatcagattcttacagcaggccaaataaggcaacatactggcctttttgcgtttattcatgacagtttagtctctaaatattaaccagctaaaacgtatttgcagtgattcccagttggtcacttttctagaagcttagcaattttaattttttttttatgtaacattatgtaaacataattctataagaagcatgccagtgtgagttgaatggaccctgatgtgctacactgcagtgtggcatacggcaaggttcggcaattcttaaactgttccgctgtggaagttcatttcaaaaatcttgttttaacattagcttgtcaaagaaatgaagtaacatttgactcttttggacaaaagaattcgacgctctctcaatggtggattcttatgaaaacttctttatatatatatatacacacacatatatatatatttggaatattttttgaaaccttgcagaaccagtattttcaaacacttgtaagtattcctaagcatgtatttggaccattaatgttgcttcatggtaacaagtatctaaagtttatgaaatatctaaaacagacaaaaacaggatgattaagcttatgatggtattaataaaagaactatatctatgaatggttatgcttctatcttcctgccatttatgccctgaaagtggaaaattactagattactcagaaaatttatggaagggataggctgtgtctgtttctcctggtacatctcctcagtcctcggtccacagttcgtgttgagacatctgttcaggcactatttaagtcatatggcacctagcatatggtagtctcttttgctatttagcaactaagtagagaataaatcttcacaatgtgtatcagaggttcaaaatgaaaaataaagtctgtaaagtcaaatttgttttagaatatggtagttttcaattagttgggctttattaaagaagctaacaagagaaaactattctgtaagatgtattttgtaagatgtaaactgtggtaaaatataatttggccttcatatccatatgtgtgtgtgtgtgtgtctgtgtgtgtgtgtatatatatacatatatatatatatatatatattttttttttttttttttgagatggagtcttgctctgtctcccaggctggagtgctgtggtgccatctccgcttactgcaacctccacgtcccaggttgaagtgattctcctgcctcagtctcccgagtagctgggattacaggcgccagccaccatgcccagctaatttttgtatttttagtagagatggggtttcaccatgttggccatactggtcttgaacagtagtatagaaaacttgaactcctgggctcaagcagtcctcctgcctcagcctcccaagtagctgagactacaggtgcacaccaccatgcccagctaatttttaaattttttgtagagatgaagtcttgcttttttgctcaggctggtcttgaactcctggcctcaagtgatccttttaccttggcctctcaaagtgcgaggattacacacataagccaccatgcctcgccctagctgtaatcttgtgtcttttaacaaatcttgttctgtcccgaccttttagttattttttgatgaaaagacttcttaaatgttaagatttttatttgatggaagggacagatttaaaggatcttaacgtctaattaacaaaatatcagaaaccatttcaactaagtgcatttcttttgcattaatctggacataatattttacttgtttttaagtgatatatatgcactttgcaccttcctcttgtcaatattttgtttttgtttttgttttttatttttaatgagtaaatgggttaagattttctttagaggaccagggcagatactgatactaccatttctttattgccaacttaaacatatactcaatggtactggaccttcataggaacacatttttgagagtgaaaagacctacttatgccaaacagtggtccaaataggaagtagagttaatgctgttttcagatatgttagccaccatgataactacagaataattttttttattacttgcttttgaataaaattacttatctacaaaggaaattttaatgttttataaggagtgctatcagtccttcttgtcagctgtttttcttaaacattaccctgttgtttaattcctgtaaacttttttttttgtcttggtgattcttgtagggcagtgctccccaacttttttggcaccagggactggttttgtggaagacagtttttccatggactcgggggtagggttgggagtggggggtggggagatggtttcaggctcaaactgttctacctcagatcatcaggcattagattctcataaggagcccgcaacctaaatccctcatatacacagttcgcaatagggttcgtgctctcgtgagaatctaatgctgccactgatctgacacaaggcagagctcaggtggtaatgctcactcaccctccactcacctcttgctgtgtggccaggttcctaacaggaccacagaccagtaccagtctgcagcccgggtctggggactcctgttgtagggtatagacctttctaggagaaggctccattctttctttttctgtaccaatttatgtgccctaaataaagcgtgtgcttaaataatgatgcccaagaaacatgaggctgggtgcagtggctcacgcctgtaatcccagcactttgcaaggccgaggtgggcggatcacctgaggtcaggagtttgagaccagcctggccaacgttgtgaaaccccatctctactgaaaatacaaaaaaaattagccaggcatgatagcgtgtgcctgtagtcccatctactcgggaggctgaggcaggaaaatctcttgaacccgggaggtgaaggttacaataagccgagattactccactgcactccagcctgggccacagagtgagactgtgtctcaaaataaaaaataaaaaaaaaaagccgggcgcggtgactcacgcctgtaatcccagcactttgggaggccaaggtgggcagatcatgaggtcaggagtttgaggccagcctggccaatatggtgaatccccgtctctactaaaaatacaaaaattagctgggcgtggtggtgtgcgcctgtagtcccagctacttgggaggctgaggcagaagaattgcttgaatctgggaagcagaggttgcagtgagccaagattgcaccactgcactccagcctaggcaacagagcagactccgtctcaagaaaacaaaaaaaaagaaaagaaacatgatatgttttgcttaagatagctagatggaaagatgaggttaatagatatgagagtatttttgtggtcttagtttaccttaagattccttaaaatccgactcactgtatttatttttttctttatagaaatgcttccatcatttcttcagaaagttgaagttgtctcagaagcttctagagaaacttgtgtagctttgactgattgccttaatctcttcaccaaacaagaaggggtaggtagttcagaattgaatttgtaaaataattgtttggatgttgcatgcgtggttgtccatgaagtcattgctttcaaattgttcaaaggtaggaaaaaattagtattaacaaaggaaagcttcatttgtcacaaaaatttagaacttatttattattgattaagcaggatgaaataacttgtgttcatatcttttgaatttgttgatgtagccatatttaataagtatacttaaaattgatctactcaggattgttatgacacttcaataagagagatgtgaaaatattctagaaacagaaggtctttacattaaaaatacttttatttagaaaatagagtactatcatacttatctatgtaaactaagcccaatggattaaatattttttgtgttctttcccctcactctcttacccttcaacagtttgccatttgcttttctaaatatgagtaagggctgagcatggtggatcatgcctgtaattccagcattttgggaggctgaggcgggcagatcacctgaagtcaggagttcgaaaccagcctgtccaacatgctgaaaccccgtctctaccaaaaaatacaaaaattaggccaggcgtggtggctcacgcctataatcccagcgctttgggaggctaaggtgggcaatcacttgaggtcaggagttcgagaccagtctggccaacatgatgaaaccccatctctactaaaaatacaaaaattagccaggcgtggtggcgcacacctgcaatccagctacttgggaggctgaggcaagagaatcacttgagcctgggaggcagaggttgcagtaagccgatattgcaccactgcactccagcctgggtgatggagtagactctgtctcaaaaaaaaatcagccagagaatcacttgaacccgggaggcagaggctgcagtgagccaagattgcactactgtactccagcctgagtgacagagcgagaccctgtttccaaaaaagaaaagaaaagaaaagcaaaccaaatatgagtaagagtggtatgctgagctatcagtgattcattttcaaaggattgaaaagttacaaagatgtgttttggttgccagaattaggatttttcttgttttgctgtttttcccctaatttttatgatttcaatgtaagtcaaggtcactaggctttcttttccattttgttaatttatatatatatgtctaatcttcaatattttagattaagataccaaatttcttattcttgttttagtttacttgtaccttttggttagagattaggttttggtaaaagaagatagatgaaattgcttttatatattttcctctaatacgtaaaaatctaacaatttattttctcatgactagaaagggatccttatgaattcatatacaattttttttttgagacagggtctcactctgttgcccaggctggagtacagtagcgcagtcatggctcactgcagcctcagcctcctgggctcaagtgatcctcccacctcagcctcacaagtagctgggactactggcatgcaccatgatgcccagctaatttttgattttttttttttttttttttttaaagaaatgggcctttgtatgttgcccaggttggtcctgaactcctagatgcaagccatctgcccgactcggcctcccaaagtgctgggattacaggcacgagcctccatggcgagcatatacacatttttaaatgctgtgtttgctatatgtagcaccaattctacatattaatttatttggagaataagacaaatatggaaataaaaatcatttaaaacaaacttaccaaaagtcttttaatagaattatattaactatcacaggaaaacataattgttcattaaacatttcaaatggttgattttttaatactgtttgaaaatatccctcctcagcacttctatttttggtggtttgcaaatttcatgtgtaagtttatttaaataacagatgatttagtgttctaaataaatctgaacaggatgattgcattcagaatatctttgaaattaataaaatatgatgtcataggattcatgaaatatttagtaccttgtaaaaccgcatttcactcatgtctcttatgtggtacctgatggatgtatcgatagctttcttgttccagagatatatggttttaaggctgaacattagattggaagtaacgtgttatgttggttcatgtttaatttctgaagcaatcaacctattctaatttttaaactatctgcttaaaaaataacctaattctttaggttatttagatgtgcaagagtgttagcctaaagtttaggctaattgacctcttttagcctcttaaatttatcatgaggattaaataagataatgtaagcaaaatacttagcatagtaccagacacatagtaagccctgaataaaagttaacagttattgtaagatcttaactaattaacatttgtagcctctcttttctgatagtatcttggagcttttatgtgtgtaacagtggatttattttgttttgggaggaagtagcattgtctaaagaacttttatttgaccactatcattggaatgatcgtgttgtgtttccattcttgttgtttaaatgacaaggctacttcacttctctgaaccttgttgtcttcatcttttgaataagggaaaccatatagcaagcttttagaagcactggtctgaaagtctggtggacccgtttttaatctcagtctttctctaacttttctccaactgtgggacaagtttctgtaaaatgaaaataaacacctcagagttgggtgtgggcatcaactatatgtagatgaatgttacatatatagagtatgttagcatactgcgtggaacacagtattctgtttagtaactagcatttaatgtttcaaacttttggaatgtattgaaggtatcttctgagtaattatatgaaattatcaactccatgaaacacttagaatccatagatttccttctcaacaataagataaacagtgagaaggcactgcaaaatatttgaaaggtaagtggcatttctaaagttagtctttcaaatgcataaggattacaacataggaatttaacagcgtaatcgaggtcagagtggtgtaattatgtgctgtaataccttttttatctggcattataaattacatgtctattatctggaaattttattaaaagagcaggcataaagctttgaagacctacagacctggctctaattcctagctctgctatttgctctctttgactcagttttaaaatacaatctcctatttaaaatggtgaccacccaaaagggattgttttaaagagtaaatgcgatcatattggtaaaacacctctgtagggactggcacgaaacagggatccagtagatgtaagtgaccccagcccccacagcagcaacgctgtttttattctagtcttttttgatggcagttattctaaatgttccacatttacttcttaacctaaaactttaaaacttaattttatgtttatttcttttcttttttttttacaagcccttgtcagaccataattttatgttttctaggtgtctcaagattggccttttgtatgtcaataattattctgtgccttaatacagagatgccctcaggggataatgtttatgtgagtctgtgtttttctaccaaatggcctggtcctgccaatgctttctggactcttgtttgctctttataggtttttaaaaattacctctcttgatttttcaaattaactgtgtacctgcctctagcagtggaatactgatgcctctgatttactctttctaatctcctgtttattaaaaagaaaactagataaccaaactccataaaattatgtccagtcagagtaaactggctctctatgagaatcttgggggtttacagtgtgtgcaggctttcatgccttctatttctgtggtatgtgggtgttttttgcttatttgaggatgtactgatatgatctacataatcgaggttttcataggagctataaataaatgaggcattattgtaggaagattttatttgtaaataaaactgctatggcctatggctcatgcctgtaatcccagcactttgggaggctgagggtgggtggggggtggatcacctgaggtcaggagttcgagaccagcctggctaacatggtgaaaccccatttctactaaaaatacaaaaaattagccaggtgtggtggcacatgcctgtaatcccagctactcgagaggctgagtgaggcaggataatccattgaacccaggaggcggaggttgcagtgagccgagatcaggccattggcactccagcttgggaaacaagagctctgtctcaaaaaaacaaaaaacaaacaaaaaaactgcttatgctgttgagaaaatggcaatatataaaatactttgtaaagttggtggttgatctactgaagaaaaacctagatgctgtttttagggtagttttcttggaaacagtataacagaatgtgagtgctgggtcttttcttagcctggtctgagagttccattcaaaatgccagaaactggtttctggaattatatttgtttctgtagttttccttgccagaggatgccctcctcattttgtgtactatcgagcttccttgatgttagtcataccaatttttccaaggtaagaactgcccatttaaagtcagtagaagctcacttatcaagtgttttatacatatttcatgttaaatctcctgactgctgaaaagctgtgacccaactgtatgactggaatgtcatacaggcacggtggctcatgcctgtaatcccagcactttgggaggctgaggtggtggatcacctgaggttaggagtttgagaccaatctgtccaacatggtgaaacctcgtctctactaaaaatacaaaaaattagccaggcgtggtggcaggcacttgtaatcccagctactcgggaggctgaggcaggagaatcgcttgaacccaggaggcagagattgcagtaagcgagattgcacccttgccctccagcctgagcaacggagtgagactccgtctcaagaaaaaaaaaaaaaaagagagtgggactaattttgtggtataatggaaagattcagaccctacattggaaccgtctgaagggttggaattctgtactgcttctttggactggacactggtatctttgaagagagatcatgtgttcatgtggacttacagctctacaaagtcatgatctcttccattcatttcatttcctttgctgtcgggcagtcctgtagtcattttgtgaccctgatatcttttgttccctaatgttcttcacagctcttttgggcctgcacccgtctctggccttctgtctctgtagtcccctcagatctccttccactctgagcagaattcctttgttaaacatgaggtagtcactgtatatggctccactccctaccactcttcactccagtttttatctgcatctgctcttatactttcctctagccttttgctggaggcatctgtctccttccattctgcttctctggggaccttgcttcaaaaaatagctcctgtctttggaattctctacccccttatttatagcttttgtctatctccctgcatccttttccaattccatttttgaaaatgtgatactttctgtttctacttcttaattttcagcaagtccaccgaaactgttcttgccagtatttccttattgctaaatcaaaggacatttaaaaattgtcttgcttgtcctctgaagggcctggcatgtgactacttcctgttttttggaattgcgctgtggcttccacagtgccgcctcttttggcttctccttcctttgtagcagctccccctcagtcaccttcttttttttttttaattttgagatggagtcttactctgttgcccaggctggagtgcagtggtgccatcttggctcactgcaacctcagcctcccgggttcaagcgattctcctgcctcaccctcctgagtagctgggattacaagtgcacgccaccacacccagctaatttttttgtattttagtagagatggggtttcactgtgttaaccaggctggtctcaaacttctgaactgaagtgatacactcgccttggcctcccagagtgctgtgattacaggcttcagccaccacgcctggcctcagccaccttctaaagcattttttcatctgcctatgtattaaatattagtattacctaggtttctgcgagtgaccttctcactcctcatattctccctggatgatgtcacccattcttttaactagaattccctgaggactcagatgtctccacctcagacttctcctgagttctgatctaatatatccagctgccttttgaacatttacatatgcttatatcagaagcatttcaaaaccaacgtgtctcaaactgagttatccattcaactcatagacttgccacccattcagtaattcaggccaggatcatgggaactggctttggttcatcctccttcttcctccctatctttaatcaagtcccgtcaatttttttttttttttttttgtgaaggagtctcgctctgttgcccaggctagagtacagcgacacagtcttggctcactgcaacctctgcctcctgggttccagcaattctcctgcctcagcctcctgagtagctgggattacaggcacacaccaccataccctgctaatttttgtatttttagtagaaacggggttttaccatgttggccaggctggtctagaactcctgacctcaagtgatctgcctgcctcggcctctcaatgtgctgggattataggtgtgagccaccgtgcccggttcaatttggttttttaatatcttggttgcctatctccctttattctgtcttccctgactccagcatacagttccccattgctgttctgtgagataaattctcaaggctgctctgttggatgactgtaaccatttcctcatacaggctccacccttcaaaactaggtgaggtgtccctgctgctccatgagttcctggctgtcatagcatttatcatattgtatcattatatattcacaaactggagcttcctaaggaagcaactgtatcttagttatttttgtagcatggtacttggcatgtggtagatggtgaataaatatttgaatgaatgaataatgaatgtacaaaggaaaaaattcaggctttgggatcagaccaatctggatctaaactctgctacctcgaccttgaacaaatgaatatatgtttaggaattctgtttccacatctgaaattgagcgcatatatgtgctattttatgtgaggtgcttcagtacagtacctggcacatttaggagccatgtagattgccttttaaaacaagaaggtaatttgttgttcattgttttgctacctagcactacttttataaactgaattcattctctaattttcagggcctagggagagattctgtagcagggactcctctttccatacatgatttttccaagtacagtaacagttattattctgagtgaaaaaagtaaaagaaatgaactgacttttcaaagatgccatgaggctgggcgtggtggctcacgcctgtaatcccagcactttgggaggccagggcaggtggatcacttgatgccaggagttggagaccagcatgaccaacatagcaaaacccccgtctctactaaaaatacaaaaaattagctgggtttggtggtgcaggcctgtaatcccagctactcaggaagctggggcacgagaatcacttgaacccaggaggtggaggttgcagtgagctgagattgtgccactacactccagcctgggcgacagagcaagactctgtctccaaataaataaattaattaattaatacaataaaataacaatgaaaacaaagatgccatgaaacctcactgacattcattcccaattttcccagcatggcctggaatggtctttaacacattctaggtctgtagtgcaattacagctaccaccaacttcaatgggacttaaagtacctaggatcttgtgaaagaaatatttaattttgttcatttttactctgaactcactaaagtatgaggacagagttaaacactttagtaaggtgaaaggtttgaaacatgttgaaacaaaaagatttctttccctccatcagagtgttacagttaaccataaatttcattaacctgaacatcccacttaagtgtggtatttgggtggtgggttttcctgtcctctgaacctttgcccttcaagcctggctggaataattttacctaagtaggtttcacggtagtaggattaataccgttgttttccttgttgctcagtgtcccaactagggtataaacaataaatatgtgaagactgcctttcagtcttggttttggaaccgtaaacgcgaacgcttcagcgtgagccggagtaagtgacaggcaggactggagagaagattcctttgctttccagagtttcccaaggggcgggttggttaaaaaaaaaaaaaaagaaaaaagaaaaaaaaaaagttgccagggccggtgtctccaggagagggccgagcgcacagcagctctaggacctcgcaggcgcctcggcgcggcactcacgtagagcccaaggagcagtccccgacctctcctcggagggccgtgcaggcttccccggcggtccctacctgcgcctccgcccgccagcggcgctggggaaggggaggagcggcccggacgctgcccgccgcgcgcagggagccgcccgccgcaggccttgccgccgcccgcccgcgctctccccgcgagccccggagggcgggtctgcggccgagccagcggcggcggaggggcagcgcagacctctgcggcccgggcgggcgcggcgcgggagtcctgggccgctggcgggcaacgcctctgcccgacctcgctggggaaggctggcgctgctgcccggccggagccaggggcaggctgcgcaaaggtgacttagggagaccttgcgggccgccctgggtcgcgcctcccggatcggctcgcctcggctcgactggaggggaggaggaggagcaggccgagcgcattcgcgctggagcttgcgaggagcgcagggtggagcgcgccagccggggtcctcggatctggcccaggtaggtgggtgtatttgcagctcggtggctttgcggggcagcctggggccacggaggacgccgggggacggagcggggagggcggccagacttgatccagggatgtgagtagatccaagaatagttggacgtgtgtgtgcagagtggggtgcagccgcgggcgcgtggggaggggcgcaccagccgggagaccctgctctcttcccagtgcgggtctccctgccgtggggttcctgcaggaagagcccctggggaaaaagcccgtggactgatgtgtttctcagttgaatattggtattaggtcaagaagggctggagtgggaggagtaagacagtgaaagacattattgtcctaaataaccttccaagttagtgatttttcgcatggctgtgctccggctgacattgagatgaacttaccatccgctcttcagaggccgctgaaattccaagaatacgagaagtgcatgagcggattaaggagagaaagggaaattctatttgtgttggggaatggggaggtggcttttaactttaatgttttgattaaggatttttgattactcacaggctttctttgtagcctaaaccagcggggaatcacgtttcctagcattcagagcatgtggctagttgttttgtgctttctgttgtgctggatttttctgggtttggagagagggtggtaaggagaggaagatgccagagaagagcttagtacagcttttctgagttattaaggctattaaaagtttcttaattttaattaggttcaaagactgaattaaggcattgcttagcaggaatctttttcgagagagaaaaatgcttgaaatgtgtgttggtggaatagtgtgtaggcaggaaaacggggtggggtggggggtgtctaaatacaaacttgctttccattttgaggacacaccgaagttaatctcctctccaaatcaaattttttagtccctaagctgatgtctttggcaaggtaactcaatttctgtttagtggatatttaatctgagcataactaccagggagctatttcagcctctgtcccagtgctacttttgccagactggagttttaaaggaacttgtatcagcctgaatatagttgctggactctagtctcccctctttaaaaaccctttaaaggttaaatttaggagattgtattgacagtgaaagtgacccgtataatttctttgcccccagttgtgagccctgcataatgggggggaagtaaaagagcctgttaggttttccatattaaagcaaaggtcttactgatactcagggtggtttataaatagtttgagcatgtttaaatattgtgcataactgagaaaataattatgcaacatcataatctaagctccatgtacaatttttgacatttatcatttacattctttataaaaaggttggctaaacttactacttctggcattcaaatatatgactgtttatcagctttctgagaattataagaaatattttaattcctctaaaaatagaaatttagaattgttattcagtccacattattcaacatatattcctaaaattttcagtttattttatatatagtccagagatatagctacaaattaattttggaagcagctaagacataagttataaatagaatgaagtttatgtaaactgaagctggatttcattgtgataacttttggggaatttttgaacaaaatacataaggttttaattagcatggtgtgtgtgtgtgtgtgtgtgtgtgtgtgtgtgttaggcttgtcatgcttgatgtgactcaagatctatcctgataagtttttgtatctcacgatggtaccaagactataatctgcatgtgactgtgtttgtcttattccgtaccatattcccaatatagaatgcagtgcctggcttgtactctgattaattttgcatgagttatataggcagacataattttcctttcattttaacttcagagtcttaagggtgtaacccctatacatttttataatggtccattgaggatttgatgtctgttactttctgtgacttttttttgagtcatttgataaatatttatagattgtttaccttataagaaactgctagaccagtctgtcttcataaaattagatgactaaaatctatgtagtcatctgacttataccggcgtcaggtgactaaataaattcttacagaaggtgcaacatacccagaagcaacagaagagggtaaattttagcaaatcgttaagaccggaatggaagggaaagaataaagagaaagtccagtctaaaagatagaagcggggtccttttgaaggactttgtaaagtatgcttatagagttcgaaacttatcttgggcagttagagtcactgaaagattttaatcagatttaatgagatttgctccttatgagaaggattagagaggagcacaggcctgcaaacaggacgaccaggtgcaggaactcaagagagataatcagggactgaaccaagttagtgactgtggagaaggaaagggggatgcagagcagagatgcttcagaaacaaacggcatgaataggagctggtactccagggaatgtggggaatgaaggtggagccataggtgacacccagttttatggcacaagtcacactgtatagaggtgattaaggtagggaattgagggaatgtggaaagatgagttgccttttggacatgctattatgttcaagtaagattgtccttaggtgtctgataaaaatttgagaatcattagcattgggagtcacctacgtcaacatggtaattgaggtcaaaggaacgaataatgttacctaggagaagacgcttgaacaagtttgaaatcaaaagattgaatactgatgcttaaaagacaagtgaaagaaagggagccagtggagatgactgagaaaaggcgaccagagaggcaggaggaactctagaacaggggagatcaagggagacaagctgcccagaggacaggtaagaactgaagcatgtccattgtatttggtagccaggtggtcattggaatcttttttttcctttattttttctaaaaaacaaaaacaaaaaaaaatggggtacatgtgcagaacatgcagatttgttatataggtatatgtgtgccatggtggttggtcattgaaatctttgattttggaagttttagaagcttcatatagggccaggtgcagtggctcacacctgtaatcgcagcattttgggaggctgaagcaggtggatcccctgagctcaggaatttgagaccagcctcagcagcatagtgaaaccctgtctctcccaaaaaaaatataaaaaattagctgggtgtggtggtgtgcacctgtggtcccagctacttgggaggctgaggtaggaggatcacttgggcctgggaaggggaggttgcagtgagccgagactgcaccactgcattccaacctgggtgacagagtgagaccctgtctcaaaaataaaaaataaacaacaaaaaaaggaagcttgacataagaggaagccagattgcagcatgcaaaggagtgagtgtgagggaggtgaggaaacaaatgatgaagatagactttgtagacattcataatctgtggatgattgtaattttattcctttttttcaattcttacacatttcatttctttttgtaattcttcatttactggctagggccttcaggacaatgttgcatagaagctgagatggtaggattcatgttcatccctgatttaaaaaaaaaaaaaaaggcatacctctaacttctaatgattcactgttaagaatggtatttaacaaataccatttaccagatttaaagagtttcctttcatatattgttgaaaattttttttatcattaaagggtgttgagttttatcagatgttctttggtgtctattaaaagggttgtatggtttttttaaatctgctaagctggtaaatgatatatttggactgtttccagtgccaagccagccatctttgtgtacttggaataaacctaatttggttatgatgtattatctttaacattgttctcaatttggtttcctttggattttagtatctattttagtatgtatgtttataagtaagattgacttgtaattttctttttttgttctgtcctcatcagggtttaatatcaaggttatactgacctcataaagtgagtttaggagtattccctcctttgctgttttgtataaaattgaaatggtctgttccttgaaaatttagaactttcttataaaaccaccttatctttgtaaagttttttttttaactagtaactacatatatttaatgtttctaggattattttagttttctatttctttttgggtcagttttgacaagttatatatttttaggaattcttttaagttttgaaatgtattataaaggtattcataattttctttcttttttttttttaacttaggttggatctgtaattatatatctttcctaaactttttccattttcttttttctaatactgacttggatatctccaaataaatttcttttcaaatgaatctcagtccctccctataagtctcattaaagctttttttgattacttttcaaagaacggtctttagtttcttatctattgcatcttttttaaaattaaattttacaattatctgtatcagttttttgagttttatttttttctttagaacatttattatcctctgtcttttgaacctggataattcaaagtttttcctttctggatttctagttgtatatttcgtagttctagcattttttgtaatttcgtgaatgtatcactgttagctttagccgttggtttattttttagactctaataatgtatttttgtagactccatctttccagcctgaagactgcttatgaatggagtctaggtactatccccctaacatttaaaaagcctaaaaggtacagaaggtttggatgacttccaagttttttctgtgagccacctcgtcctgtttccactgcttggcatttctgtttcttttgctcacctactgctcaccttcttcctctttttccttcatactttcttttctattcttgagtggtagaagaatgaccctcatccccttgttgccttttccaccttttttctttctcccttgttttctctctcctacactttgaggatttttccatctgctcaacatattcatctccccctttccttcttctcagaaccttggccccaacaccaaagaggaacaagccaggataacctgtgtctggttttctttagatgctcaaaggctcaccattgtttacctcatgatctgtgttattctttatgcagaccagctgaagacagagccagggagagcgtggggaaagccagggaggaaggcataaatgatagaactcaaacctgctattatgtagggtccccaggcatgggtttcagtaacagggacccttttcttgctctttgactctgggcaacttactccaaggctcacgttcttttgtctaacacggagtcgttaacgcagaccctttctttctacatcacaggtggctgtgacattcagatgcaataaggagaaacctgtcagtttccatgttttattctcacgaaaatatcttaaaaggaacttgtgcacaactcagggagagaaagggagcaaaactggtttgtggcatggtgtgttggaggagagaaaccccgatgggaagcagtaggtggtgatgggaataacaagaagcacagtggttgtgctcagtggtcaagagagatgcaggggagatgtctttcccctgggagaggggagctcatacccacccaggctgcagacatggacacactgttacacacagtggcaggggagatgctatgctccggtgacaacatgctacatgctatgctctggtgacgtcagctgttcttttgcctaattatttgctacattcaggacactgggcctttttgagtttacttgagaaatcagccctcacttataataatgtttctgtgagggagatttttgttgttgtttttctgggttctgaacagctggattagaaatgatttgtgagcataattcttagtaaatttctttttctttttctttttctttttccaagatggagtatcactctgtcgcccaggctggagtgcagtaacgtgatctctgctcactgaaaccgctgcctcccaggttcaagcaattctcctgtctcagcatcccaagtagctgggactacaggcgcatgccaccatggctggttaatttttatatttttagtagagatgggatttcaccatcttggccaggctggtgacgaactcctgacctcaggtgatccacccacctcggcctcccaaagtgctgggattacaggtgtgagccactgtgcctggccaaaatttcttacttgtgttagaacttatttaattttgaatattttatttatttgtggtatttgtgttaaggactagttgtttaaaatcccaaagtctcagaatcggtattagattgtagaacatctggtctgatggtcttcagaggttttattggcagtggaggcaggatgtggatgccagtatataagaccgatgaaagtaaaagcacccattcatccactgcggtacctccatagaaaagtttgaaagtgatctattctttattttacagaggatgctagggccaggaggagagtgtcatttacttgcccaagcatatgccgctaggagcgggcaaaacttagaactaaatccaggataactgcctccaaatttaatgccaaagaacagcccaactatatcatacacgcctagacttaggaaaagtctttagacagcccaagcggatgtggccatctatataagctactttctcaatttgaccaaaggatgccacatttagaaataagataagcagatggccaagggtattgaaatatcttctgattttgcacagaatacctgtgttccaggttctcaacaggaaattgctgtccatctttttgtgaagatttggcttggtagaagtcgcattttgggaaaatatagaagtagtctatttcctaagattccttatcttaatgttaaactggcctgtcagaatgctatagcctggactatgttttcttgatttttcagaaaaatggccctcactgaattataagttggcgttacacccttaatttttgttgaagggcatttcaaaaaatattggccttaacaacatgattattttgccctctaatactcttactcccctttatataatcctggatgagaaattagagctaagggcaaagagggagtttcttttctccaaggaacagttggtgttttttttttcctggtggacaattaaaagggcacaattgattgtatttctctttctgttttggccttaagagaattcaaagcctggtttgtggttcatccacagtttctgtgtaggcttcatcactggtaggtcctgcgtcaatccctattgggaactgtattgtaatttcatagtcttacagtttggcaatcactagattccaacattctcttgtgaattaattgaatatggttgttccccagggtgcattcacatatgctgactacattttgggatttttttctgcaagtagtattaagtaaatagttgttaaaatgttaggaataggctgaacgtagtggctcacacctgtaatcccagcactttgggaggcagaggtgggcggatagcttgaggtcaggagttcgagaccagcctggccaacatggtgaaattttttgctactaaaaatacaaaaaaattagccaggtgcagtgacgcatgcctgtaatcccagctactcgggaggctgaggcaggagaatcacttgaacccgggaggtggaggttgcagtgagccgagatcgcgccactgcactccagcctgggtgacagagtgcaactccgtttcaaaaaaatgaagtgttgggaatatatttttaccttatgctatggttttgtgtcaagaatatatacattttgatagtgactttgttataggtaatgtcaaggacccaagtaaaaatacatggcaaatattgcaatcgcagtgttttggggttttgttggtgtgttaatatgagtcatcctaactatatattttagtccaatatttggaggaaaaagttttattgttttttgtttttggtaaaatatacatatgatttaccatcgtaaccatttttaagtgtgttgttcagtggcaaacctcacaagattgtgggtggggaggatcatatgagctagtacagcacgtacttagcacagcacctggtgtaaagtaaatatacatactgacaaaacttgggaagcactgctttaacatatttgcagtgttttcttcagatagacatataacctcctaagttgtgattccagcacatttaaattttttacctcagtttgagaactgtgaaaacacttgtcaaaacagaataaaatatcaaaattctaaaaaagcaaagtgattgtccttctgggcctaacaatgtttaccatatacagaaagctattttcagagacagagctgaaggcatgtaaaaagcggagctggaaatcatggaataaatgtacagtggaatagtcctttgtaaaaaggaaagaactgcgtatagttgcaaaaacatggatgaatctaaagaacattatactagtaaaaaaagctagatacaaaagagtacacaccctgcatgattccatttattttaagttcaaaaacagacaaacctaaaccatggttattgaagtcagagcagtggttgcctgggtagggggtggagagaagggggacagtgaccgtgaaaggggcacatgggggagagtgaccgtgaaaggggcacatgagaacttgggggagagaggtaatggaaatgtcctgtatcttgatggtggtgctagttacatggcggcgtatatatttgtaaaagcttactgaatcatacacttaacataaaggtattgtatatgattcaaataaagtttatttaaacaattcattgctatggtgttacttctgttacatataactgtttctagttattttcatcagcaaaactatcaattgcagagcccctgaataacttctgaaaacaagatttgtttagattatgattaaacttccctacttttaaaaatgattatttacctctggtggcgtatctcaaaaaaaaaaactatttattttgaggatatgtaaaatatacaaatctgtggctagtgattatgtaagagcaagctatttttaggtcgaagctttgcaaccatgatgagacaggagtgtgcttaaattctcagattgggctcccataccagacatctgagaaagtcatatgttctgcagtatttaagaggaccttgcaaacattgttttgcatctgatgcattgccaatctgatgcaaaatttgatgatgcaattatcagttcctaagtaggcgtattttaaaatatttcgctaattatagaattatgagatatatatggaagatatacaggagtatacagaaagctattttagagcttatagagaagaatatgaaaaccaggtcccagcaaccaccagcaggattttggtgtgtcttagcttatacacatgagtgtgcaaacacaaatacaatgcatcttgctgtttaatatcttacatcattttcagtaatatcagagtgagtatttttctttgaaaaacacctattctttgaaaaaattttttattttttgagacaaagtcttgctctgtcgcccaggctggagtgcagtggcatgatcttggctcactgcagaggtctcagctcactgcagccttaacttccctgggtcagatgatcgtcccaagttagccttcctcatagctgggaccacaggcatgcaccaccacacccggctcatttttgtattttttatagagatggggttttgccctgttgcccaagctggtctcaaacccctgggctcaagtaatctgcccgtctcagcctcccagagtgctgggattacgggtgtgagccatcatgtccagcccaaaaatgtttttaaggctgcatatgaaatgtattattgttttaacttccattgtcaatatatgagtggtttttttactatgcccttcctattgctaaatgctatcatttttatagctttattgacgtataattgatgtacaataaactccacgtatttaaactgttattgaatgagttttgacatgtgcttgcactagtgaaactgtcaccacaacaatcaagataaggaatacttctattccttccaaaagttccttactgcctctttgtaatatcccttattctttcttccacccccatccacaggcaagtattgatcagctttttatcactagacattggcaggaattttctaaaattttatagtaatggaatcatatcgtatgcacttttgggggcgggttctggcttctttaactcagcatagttattttgaggttcatccatgtcgctgaatgtatcaatagttaactcctttttattgctaaatgatattccattttgtggctgtaccacagtttatccattcacatgttgatggatatttaggttgtttccagtttggggatattataaataaagctatgaatatttgtatatacaagtatttatgtggacataagcttttatttttcttatggaaatatctagtagaatggccaggtcataggtcatatgataaatgcatgtttgtcttttttttttttttttgagttcttttaaactttggggaaaaatgggatagaattcacataacataaaattcactcttttgagcatacaattcagtggcattaatacattcacagtgtgcagttatcacctctgtcttattccaaaacattttcatcattccacaaggaaccctgtacccattaaatactccctgtctctctggtaccccatccccagtccctgaaaaccacgaatctgcttcttctctatggatttgcctgtcttgaacatttcgtgtaaatggaattatacaatatgtgagcttctgtgtctggctttctcccttagcctaatgtttttgaggttcatgcgcattgtagcatgtataagcactttgcctttgatggctaagaagtatggtatgtatatatcacattgtatctgtatatccatttatgggcatttgggctgtttctaccttttggctgttgcaaatagtaatgctgtgaatgtttttgcaagtatttgagcatttgtattcaattcttttgggtatatacctaaaagtaggattcctgggttagatggtgtttctatgtttaacattttaaagaaccaccatactgttttccgcagtggctgacgttttacattcccatcagcaatatgcaaagttccactttccccacattcttctgaacacttattttcttttttttaaaaaaaattatagccattctagtaggtgtgaagtggtatctcattgtgtttatgatttgcattcacctgttgaactcatcttttcatgtgcttactggctgtcttttttggagaaatgtctgagtcctttgcccattttttaattggattgtttgtcatcttattgctgagcgtagagttctgtacatgattgtgtatatattgtagatactagacccttgttagatatatgatttgcaaatacttccttccatttcctgggttgtctttttactttgttgatagtgttcctttatgcatcaaagttttaaatttttgttgtttgtactttcggtgtatttttttttaactaaactgaaatttctctaaattactttttatccaaaagccatatcagaatagcctgtggtgctttataaaaacgttacatgtatcagtgtattaccatctaacaagcaaaaaaccccaaacccaataacattagcttaaattagagatttatatttctttcactgtaaagaaaatgagaggcgggcagtctgggcctgtatggcagtttcaggtgttaggggctgttcctactgtcaaattttcgtcagctggaaggaggaaggggcagaaaaaggggtatacccttccctttaattagttctactatcctttgcacaatatttccattcttcttggccagaacttagtcatttgtctatagctgacagagagatggagaagtatggtctgttagctggagggcaaaaggtaaaacttggggcttactaatgacaaaggggagaaatagctattgggagaaattagcagtctctgtcataggccttgttcattcttggaaatcctgattaagtagagcacgttccagggaccattccaggtactaggatacagttgtgcacaaatatttaatacggagttaaaaagatgtaattttaggccaggcgtggtggctctcgcctataatcccagcactttgggacgccgaggcaggcggatcacgaggtcaggagatcgagaccatggtgaaaccccgtctctactaaaaataaaaaaattagctgggcgtagtcccactactcgggaggccaaggcaggagaatggcgtgaacccggaaagtggagcttacagtgagccgagatcctgccactgcactccagcctggcgacagagcgagactccgtctcaatttaaaaaaaaaaaaaaaaaaaaaaaaaagatgtaattttaaaaatagactttaaaaaattacagaatttcagcaagtaggttgatttagaattttactatttttatatagcttacacagatttattatattacattaaaatatattggcaatatatttaatatctaccactatgaggcaatttagcattctgttttttaatttttaatttttgtgagcacatagatataagggatacatgagatattttgatgcaggcatacaatgcgtaataatcacatggaaaatgggatagccattccctcaagcatttatcctttgtgctataaacaatccaattataaagtgtgcaattaaattattttgactatagtcaccctgttatgctatcaaatatcaggtattattcattctttctatttttttattttgcatccattaaccatctccacattcccccaaccctgccccactacccttctcaacctctggtaactagccttctcctctctatctccatgtgttcaattgttttgatttgtaattcccacaaataagtgagaacatgcaatgtttgtctttctgtgcctggcttatttcatttaacataatgacaacatccagttccatccatgttgttgcaaatgataggatcttgttcttttttttatggctgaatggtattccattgtgtgttaagtaccacattttctttatccatctgttgatggacacgtaggttgcttccaaatcttggctattgtgaacagtgccacagcaaacatgggagtgcagatatctcttccgtatactgcttttcctttttttgggaatatacctagcagtgggattgctgggtcgtatggggtagctttatgtttagttttttgagaaacctccaaactgttcttcatagtggttgcactaatttacattctcaccaacagtgttcccctttctccacatccttgccagcatttgttactgcctgtcttttggagataagccattttaactgggatgagatgatacctcatcgtagtttgatttgcatttctctaatcagtgatgttgagcgccttttcatatgcctgttttccatttgtatgtcttttgagaaatatctgttcaaatctttgactcatgttttaatagcattattggatttttttcctgtggagttgtttgagctccttatatattctgtatattcatcccttgtcagatgggtagtttgcaaatattttttataattttgtgggttgtctcttcattttgttgattgtatcctttgctgtgcagaagctttttaacttgatgtgtttccatttgtccattttttctttggttgtctgtgcttgtggggtattactaagaaatatttgcccagaccaatgtcctggagagtttccctagtgtttccttgtagtagtttcatagtctgaggtcttagatttaagtccttaatccatcttgatttgatttttgtatatggcaagagataggggtctagtttctttcttttgcatatggatatccagtttttccagtacaacttattgaagagactgtcttttctccaatatatgttcttggtacctttactgaaaattagttcactgtgagtgtgaggatgtgtttctgggttctgtattccgttccattggtctatgtgtctgtttttatgccagtaccatgctgttttggttactgtagctctgtactgtaatttgaagtcaggtaatatgattcctccagtttagttctttttgctcaggatacttttggctattttgggtcccctgtggttccacataaattctaaaattgtttttttctatttctgtgaagattgtcactggcattttgatagggatagcattgaatctgttgattgctttgaatagtatggacattttaacagtactcattttcccagtccatgaacatggaatatctttcctttttttttttttttttttttttttttgcatcctcttcagttctttcatcagcgttttatagttttcaccatagagatctttcacttctttggttaacttaattcctaggtatttaattttatgtgtggctattgtaaatgggattactttttaagtttctttttcagatattcacttttggcatgtagaaatgctactgatttttgtatgttgatcttgtatcctgcaactttactgaatttatcagctctaatagttttttggtgtagtctctaggtttttccaaacaaaagttcatatcatctgcaaacaaggataatttgacttcttcctttccaatttggatacctttatttctttctattgtctgattgctctagctaggactaacagtaccatgttgtataatagtggtgaaagtgaacgtttgttgtgttccatatcttaaaggaaagtctttcagtttttcctcatttagtatgatactagctgtgggtctttcatggcttttattatgttgaggtgtgttccttttataccagttttttgagggtttttgtcataaagggatgttgaattttatcaaatacattttcagcatcagttgaaatggtcatatggtttttttcatcagctctgttgatatgatgtatgacactggttgatttgcatatgttgtaccatccctgggataaatcccacttgtttatgatgaatgatctttttaacatattgttgaattcagtttgctagtattttgtcaaggatttatgcatcagtattcatcagagaatgaatattggcctgtagttttctttttgtgatgtgtctttggttttgatatcaacatgtggattcaaaaatctgagacaggtctcagttaatttagaaagttttaccaggcatggtagctcacgcctgtaatctcagcactttgggaggctgaggcgggcgggtcacttgaggctaggagttcgagaccagcctggccaacatggcaaaaccccgtctctactaaaaatacaaaaatcagccaggtgtggtggcgcacgcctgtaatcccaactacttggggggctgaggcaggagaatcacttgaacccaactacttggggagttggggaatcactcccaactacttgggaggcagaagctgcagtgagcagagagcgcaccactgcactccagcctgggcgagagagcgagactccatctcaaaaaaaaaaaaaaaaaattagaaagtttattttgacaaatttgaggatgtgcctcaggaagttctgacaacatgtgtctgaaggtggtcagagcacagtttggttttatacattttagggagacttgagacatcaatcaacatatgtaagatgaacattggttcggtctggaaaggtgggaagactggaaggagggaagaggcttccaggtcataggtagataagagacaaatggtttcattcttttgagtttgtgattagcctctccaaaggagacaatcaattatgcatttatcttagtgaggagaggggacactttgaatagagtgggaggcaggctggccctaagcagttcccagcttgacttttccccttagtttagtaatttgggggccccaagatttattttcctttcacggctgtaatgcaataagtttggaagtattcccttctctattttgtagaatagtttgagtacgattgatattagttctcctttaaatgtttggtagaattcagcagtgaagccttcaggtcccaggcttttctttactgggagactttttgttatggcttttatctagatacttgttattgatctattcaggttttcagtttcttcatggttcaatcttggtgtaggtttatgtgtcttaagaatttatccatttcctctagattttccaatttattgccacatagtttctcatagtagccactaatgatcctttggatttctgtggtatctgttgtaatgtttccattttcatccctgattttatttatttaggttttcccccgttttttctttgttagtctggctaaaggtttgtcaattttgtttatcttttcaaaaaaccatctttttgtttcattgatctttctattttcctcacttcagtttcatttatttctgctctgatctttattatttcttctgttgatttattctactgatttattatttcttcaactgatttgttttgctcttgcttttctagttctttaaggtgaatcattaggttatttgtttgaagttttcctttttttttgatgtaggcacttagagctgtaaatttctctcttagtactgctttcgctgtatctcataggttttggtgtgttgtgtttctcttatcatttgtttcaagaaatttttcaatttcttaatttcctcattgacccactggtcattcaggagcatattgtttgtttgtatagtttccaaaattcctcgcgtcattgatttctagttttattccattgtgatcagaagatacttgatattattctctttttctgtatgctttaagacttgttttgtggcctaacatatggtctatctttgagaatgatacatgtactgaggaaaagaatgtgtattctgtagccattggatgaaatgtttggtaaatatctattaggtctgtttgttctatagtgcagattaagtctgatgtttctttgttgattttctgtctgggggatctgtccaatgctgaaaatggggtgttgtgacctccggcaattattatattgaggtctagctctatctttagctctaataatatttgctttatatatctggtgctccagcatttggtgcatatatatttacaatagaaactgcctttgcaaaattataactgaggaaattatgacagtaaaataagacctaaccaactccatcttgcttctaacatttaagctgtgcttattcattcctgggcataggtcagactaactttgggaaggaattcagctcatggcttgattctgaaacaaaactgacaaagccttttcccaaaaagaccccctttttgccttgggaccagtctgcccttgcaagactaacaaattagctacaagattagaaattacagtttaggggtcatgcagcctctggctccaagagtctgaacctccctaaattcctcctggggataacatcagcattgtaaaacctaaggtcagtgcttgagatattttgtagaccctatgttggatggatcagctgacaccaaggagaccagtaatctggctcaaccagttctgccatcccacccaggaaaagacagcaagaaaacctcacttgaacccactatgattccatcttcaacctgaccagtcagcactccccacttcccaagtccttaccagccaaattatccttaaaatctctgatctgcaaatgctagagagactgatttgagtaataataaaactctggtctcccacacagccagctctgtgtgaattattccttctccattgcagttcccctgttttgataaatcggttctgtctaggcagcaggcaaggtgagcccattgggcggttacacaattattatatcctgctgctggatttacttctttatcattatataatgaccttctttgtctcttgttacagtttgtcttggaatctgttttgtctgatataattatagctactcctactcttttttggtttccatggacatggaaatgtctttttctatcccttcgttttcactctatgtgtacctttgtaggtgaaatgcatttcctgtaggcaacagattgtggggtcttgtttttttcatccattcagcgcccccccccgccatgtcttttcattggagagtttagtccatttacattcaatgttattattgataagtagggactcctgtcgttttgttacttgttttctaattgttttgcagccttctcttccttccttctttccttcctgtcttccttttagtgaagttgcttttctctggtggtatgatttaatttcttgctttttattttttgtgtattgtatgtttttcgatttgaggctactgtgaggcttgcaaatactgtcttataacccattattttaaactgatgacaacgctgattgcataaacaaacatgcaaaaagaaaactaatcaaaactctacactttacttcattctcccggctttttaccttcttttgttcctttttatgtcttatactgtctatgtcttgaaaagttgttgttattatttttgattagttcatcatttagcctttctagctaggtgtagtttacacaccacaattataatgttttgatattccgtgtttttctgtgtgcttactattaccagcaagttttgtaccttcagatgactttgtactgcttgttaatgtcctttttcagattaaagacctcctctcagcatttcttgtaggacacgtctggtgttgatgaaatccctcagcatttttttttttcctgggaaggcctttatttctcctttatgtttgaaggatattttttgcaagatatactattctagggtaagagtttttttccttcagcactttaaatatatcacaccactctcttctggctggtaagatttccactgaaaagcctgctgccagacgtattggagctccactgaatgttatttgtttcttttctcttgctgcttttgggattctttctttatacttgacctttgggagtttgattcttagatgccatgaggtcgtcttctttgggttaaatctgcttggtgtcctataaacttcttgtacttgaatgttgatctctttcttaaggtttgggaagttctctgatattatccatttgcataaactttctacccctctttctctacctcctctttagggccagtaacactgagattttcccttttgaggctgtttcctagatcttgtaggcatgcttcatcattttttgttcttttttgtctcctctgactgtatttttaagtagcctgtcttcaggctcactaattctttcttctacttgttccattctgctgttaagtgattctgatgcatttctcagtatgtgagttgcatttttcaactctagaatttctgcttgattctttttaattatttcaatctcttggttaaatttatctgatagacttctgagttctttctctgtgttattttgaattttttgagtttcctcaaaatgactattttgaattcactctgaaatgtcacatgtccctctttctccaggatcggcccctgctgccttatttagttcatttggtgaagtcatgttttcctggatgaccttgatgcttgccgatgttctttggtgtctgggcattgaagagttaggtatttattgtagttttcacagtctaggcttgtttgtgcctgtccttcttgagaaggctttccaggtattcgaagagacttgggtcccaagcccaataatgatgtggtttctccatatttgcagaggtactgccttggtggtcttggataagatctggaagaattctctgggttaccaggcagagactcttgttctttttccttattttctcccaaacaaatagagtctctctctctctttgctcggccacctggaactgggtgtatggtgatgcaaacacccatgtggccaccactaagactgttctaggttagacctgaagccagcaccacaatgggtcttaaggcccactgtaaccactacctgtctaccacttatggtcactcaagacctcagggatctacgtagtcaccaggtggcaaagccagccaggttttgttcttcctttcagggtgacaagtttccccaggccccaaataggtccagagatgttttctgggagtcagggattggaatcaaaaaccttagaaatttgcctgatgtcctattctactgtggctaagctgacactcaaaccccaatataaagtccttcccgctcttccctcccctttccacaggcacaggagcctctccctgtgagcaccactaccactggcccatgggggagctctgccaggccactgctgatgttcacttaaagcccaagggctctttcatcagcttatggtgaatgctactaggcctgggactcacccttcagggcagtgggctcccctgtggcccagggcaggtccagaattgttgtccatgagcctaggcctggactccatgacactaagagcctgcttattgctctgtcccactgtggccaagctggtacttaaggtgcaagacaaagtccctttacctttccctctgcttttttcaaagaggagtctttgaccatagccaccacagctggtaatgtgttgggtgtcacctgaagccagcaagtctctgaggctcacccaaggccctcagtgtagtacctggtatcactgctggttattcagggcccaaaggctcttcagttagcaggtgataaatgctgccaggactgggtcctttccttctaggcagcaggttcccttctggcccaggatgtgtctagaaatgtcgtcaggaggctgggtgcagtggctcacgcctgtaatcccaggactttgggaggctgaggcgggtggatcacatgaggtcaggagttcgagaccagcctggccaacatggcaaaaccccgtctctactaaaattataaaactagctgggcgtggtagcgtgcacctgtaattccagctactcgggaggctaaggcatgagaattgctcaaacccaggaaagagaggttgcagtgagccaagatcacactactgctctccagtctgggcgacggagtgagactccatgtcaaaaaaaacaaacaaacaaacaaacaaacaaacaaacaaaaacacacaaacgccttctgggagctaaggcctggaatgggggccccacaattctgcccagcatcctatcttgctatggctggctgaactggtatcctagatgcatgacaaagtcctctctactcttcgccctcttctccttaagcagaaggaaagagacactttcattgctgtctgctgtgctgcctggggttgggggagggatggtgcaatcactcctttagccaccttggccagtgacttcctaggtcaggtgccacctagtcctctggctgtcagcccagcccagcattagaagttgcctaggaattgcagtccgtgtgtcctagaccacctttcaaatttacctaggaccccccagaggactttggccgcgggtgacgaagcttgccaacaaactcgagttctgaccactgagatgggtgattctctggctagggctggtccaaatgctcctgtgtgtgtgggtgctgggtgagcccagcctggctttgctcgccactatgacaggggagcaatgagttcaatgtaatgtcccccagttggtgtactctgcaagtgcagatactctccatgctgtacagctgttgccaggggataggggagggttggtgttggtgattcaagactgtctgttggaccctcctcaatacctttttcagagatatgaaatcaggtgctgtgattgctcacctgatttttggttcttgtgatggtgcttttctgtgtgcagatacttgttacaatttggtgttcctgtgaggggtacaaaggatgtaagcttctattccgccatcttgctctgccaacattgttttttaatttacatgatgatacataaaacccttttgaaattttaaatacattataccataatctgaaaaaatttggaaatgacacatggacgtgcatagtacttttaggaatataatcctctaagtgcgacttctggattgtaaactgtacatggtaatggaaattttaaatttctgtggaagttcctcatatgagagttataaccagcattaagtagttcaactttgcagttgaagagcaaactgttgtgagacttgcatcaaattattttaaatgccagagccattaacaaagcattggagtaaatgtgtattgaatccactattggtagcataccgtgggagtgaacacgacttttgtttcagaagacgcgttcatcttatctgctttgtaaaagacatgtaaaaactaaaacgtatttgttaaattgtcatttgtgtatagtgctagtcttccattgattttatgggaagttatttttaaatcattctgacaaaaataagtgtcaaatattctgggtttatattgattcttccaagtatcattatcaccttgcttataaaatgccctatttatttaccaagtctttcttctgttcccccaagtatttaggggctctgtcctagatttggggttatctccaaattctaccctgatttaaatgtctgaaggtacagtttggaagtaatcgatctaacagattgttagcagaaagtgatgttgaacaagcttcattgaggccattctatttttagcatggtcagtacgtcaaaaaccagacaagttcttatcttctttcccatggaggagcttgagtgaagagatatgcagaggtcattctgagtggcatttccttttctttgcttgaaccaggttgaagaagatggcaatgcctgtaagaaaggggcatttttagtggtgccacaggccaatcacagtcagctataaccaatgggaaaatgtgttgggctgatcaagttagtgctcatgaggctttgtagggccttgagactcgtttcatttctaatctcaggatgaacttatgtataatgtcaagagactagaggcttcttacttcatcacctgttggaatcaattaggttgaggacatctttgtctgtttcttattctctgtattccttatatgctctgagatagcagaagcaattagaagaaaacttggttacacgtactcatctatctgaatctgtgcaccatactcactgcatttctcctgcaactaaggatggactgtctgagcctttagcaaaggccagctgtatactagtggattagatctcctccctttttgacaaagtcaagaacattattccagcaattctcccctctcacttctgcaaacataatcccatctcagttgaaccttttctatccatgtaaaagcaacccgggttgtcttccataatgaaaacttcattgaccccacaaccccttccagcaactgccctacctttctcctccttttttgagcagaaattatttttttaaaagaattttattctttttttagtttttaaaataacctctgtaaccagcgtcctcttgtaggctaggcgtgatgtggctctgcctgtaatcccagcactttgggaggccaaggtgggtggattgtttgagtcccgggagttcaagaccagccggggcaacatggcaaaaccctgtccctattaaaaaaaattacaaaaaaaattagccagccatggtgatgtgctcctgtagtcccagctccttgggaggctgaggtgggaggatcacttgagcccaggaggcagaggttgcagtgagctgagatcacactgccttctagcctgggtgacagagtaagatcctgtctcaaacaaacaaacacctcttgtccaacaaaaaccttcttaagaacaggttgtactcactctctcttatctctcttgacccatagggcatcgcctccagcatcctcacaacacttcactgaagctgcccttgtcaagttcactcttgaccttcacatcgccagtacagtggtcttgtcttagttcttgaagcagttgatctctcatcagtgtttgacagttaatcactttttcctccttgaaatacctctttgaggcttccaagacaccacacacaactggtttacctctctctgtctctctcttttttgtttcctttgctgactctttctcagcatttctgctagggttcagtccatggcttccttcacatttctgtctcactttctcccttaatgttgctatctagtcttttaattttatttatttctagttttaaaatttaattttaaaaacttaattttatttaatttttgagacacagtccttgtagttgcccaagccaaaacatggagtcgtccttgatttcctttttttcttatatcacatagtcagtctgtcagcaaatcatttgagccttcaaaatatatccagaatctgaccacttctcatcatttctcttgctatctcttacccatctcttgttctagttattgaagtacttcttaagggatttttttttttttttttttttgggagacagagtctcactctgttacccaggatggagtgcagtggtgccatcttggctcactgcaacctccgcctcccgggttcaagtgattctcctgcctcagcctcccgactagctgggattacaggcatgtaccaccatgcttggctaatttttgtatttttagtagagacggggtttcaccatgttggtcagactggtctcgaactcctggcctccggtgatccgcccacctctgcctgctaaagtgctgggattacaggtatgagccactgcacccacctgggatcttcttttattctactcttggctcctccatccccttttcagcattataaccatggggatcatagtaaaaagtaaataaaataatgttacttcttcccctcctccactggcttcccatttcactcagagtcaaaaccagagtttcagctgtggtttgcaagccctgtgcacatcccttactcatttcagtttcctcccatcaggtaaatctgcctcggtcccttaggtggctttattcttagttcttaatttagtctttattcttacatatttatttatttatttatttttcaagacggggtttcgctcttgttgcccaggctggagtgcagtggtgtgatcttggctcactacaacctctgcctcccaggttcaagcaattctcctgcctcagtctcccaagtagctgggattacaggctcctgccaccacgcctgcctaatttttgtatatttttagtagagatggggttttgccatgttggtcaggctggtcttgaactcctgacctcgggtgatccacctgcctccacctcccaaagtgctgggattacagatgtgagccactgtgcccagcccctaaatttttattcttaaatgagtgtcattgtttagtgctaggaaggactgaaaaaggtttcaggagcatagggaaatcaattgcatttgaaaaggcagtgatgagatgagatggaaggaggacattagagagtcaatgaaaactctgaaattgaatgtgagcaaaggtattttgtaaatctataaaacaaagcaagagtatactatactataatgaagacacatgtccatcctgcctgagacaggaggtcaaagcttcacttccctggaccctggaggtgagagagtaattcagcctggccatggtttcagaagtaacattgaccatttgcatccacatgggagctccatcctcctctaccttaacaatataatagtcagacttgtgtgcagaagagctcttactagctgtaatcatcagacccatactttttatcagctgtgtgtcaacagcagggagtcacctaaaagcacataccgtgaaaaaagttttgaagtgagaacattgttggtcctctagccacagcaataagcatcagccaggtgcagtggctcacacctagtctcagcactttgggaggcagaggtaggaggatcacttgaggctaggagtttgagtctagcctgggcaacgtagggagacccgtctctgccgaaaaaaaaattagctaggcatggtggtgcatgcctttagttctaactactcgggaggccaaggcaggaggatcgcttgagtcaagaggattgtttgaggctgcagcgagccatgatggagcctgcactccagcgtggttgacagagcgagaccttgtctcagaaaaaaaaaaaattctaatatttcagtctctaatacattttgttaattgtagccatccatgcactagcgaagaggaaagagtaaggcttatcctgttgaactgaccagagtgtggccagttggaagactgatcatcaaggtcagaattgtacctatcttataactggctgattgcacacagtgttctgtgaataataatcacttattccccacttagtgctgtgtctttgccagattgaattactctgccttatgtaacccctgtgaaacacaggtaagtaacggggcactttctagaatgagagcgtaggtgaatgtgtcgtagctggctagcacatgactgttttcaaaactctgcattctcttgctggcgcccattcactttggaaatagccactatggattttgccttctggcctgaaagggagtgaaatgagagactgccatattgaagtggtttgaggagacagattactggaaaggcttacatttgtattttaaggggctacagacacagatcaatgcgtatgtttactgttaagcgtatggtggttcagtccttaagcttttcttaataaaaagtgcaacatttttgttaacttgaatgtatgttgatttttgtcatgggaaagtcattggactgagggtgtatattccatatgcgaatttgaaaggtaaaatttcagccttattctagaaaagttctaatgtataaacacatatacaattataatctaataattataaacatatctgttgggacccactagttctgtgaaggaagttatttattcttttagtaataactagggtgatgattattgtttgagaatttaaaaaatctagtaatcaatattcacatattgatacataatagaagtgaagccttgtgcctggaattacaaagacattaagagattgcgcagaaggcactgtttctgttacaccatagtttctaagcttgcaactaagaatttggaaacagttcaaaagtaaggtgaatattttatgaagttgcactttgcatatcttttttagcagttctacaccaattttttagtgcaggatttcccctaggtgttctgaaatgtggagactgtagaggatctggaattacatcgtttcagtgatccttctgaccaaaaagtactaatggcacttaagcatgctttcagatgtttctctaaagtatcaagaaaactcattaccagtgcattttctgtgatgtgtagttactctctcatatacatcacttacatgacaggagaaattgccattttgtggctattttataagaaggtatcttcagtgcagaaaatcctgttaggcttgaaactaataaaagtacactcagatcaattgaaagatgaaaacaaagtaagaaatagaatgtggctagagcctcagtctcttcctgtcctgtttccaaccccttttactgtctctcaagaacaagtgagaacagatgtgaatgcggtagcagctaagtggtgcttattttaggtgggtaacgggtagattgcattttgaataagatttttttgaggggactggatatttatgggcctctatcatttatcttgctactttgctgaaatctagatgaatttaggtattaaaatgtatgtactcgttaaataggatactttagttaattcttatatttaaagatatggtgtcaacagcaaatttacattttgatattggaaaagctaaaaaggggaaagagatggggtaggcaggggtgaagaatttggattttcttgcagtgttgattttagaatctacaaatataacagtgctgagagatcttttcaaagaaaggatcattttggacattgctcaattttgtagtccttgtttattttttattttttatgtttttgagacagaatctcgcctgttgctcaggctggagtgcgacggcgtgatctcagctcactgcaacctccacctcagggttcaagcgattcttctgcctcagccttctgcagttgagattacagtctcctgccactgcgcctggcttattttgtattttcagtagagatggggtttcgctgtgttggccaggctggtctcgaagtcaagtgatctgcccgcctcatgtagtccttgtttatataatagagaaatgaagtgtttaacccatctgatggaagtaggacagctttttatttatttttttaagttgactctagccttagtatgcttatttcctcttctggagatacaatttagattataggaatatttgcaagtatttttcagattttctaaaaattgtaattacatgagtaatttgtttttcaatttttcatgtctcttctgatcttgattgcttaccatttattgcgatttttatttcattatcacagctgtaataataataatctgcctgctgtattgataaacactaaagtgcctgaggactggaacttgggtttaaccttgtttctgctataaacttaacatttcagtaaaactgtatcttaagctatgtctaagaccttagagtgttgtacctgatgtgcagctggcaggaactcagggccacagaacagagaagagccttcatccttgggggctgtggggaggagcatgggagagggagtgtcaagaggtaaaagggttagatttggcagtgagtaatgcaggatttgtgagaggggccacagttcccaaaacctcaagatggaaagtgtgacctagaggaggttttggatgtcactccatccagtgcttttcttttctttctttcttttttttttttaaccccctaactgaatcttttttgtttgtttgtttgtttgttttaattatacttaaagttctgggatatatatgcagaacatgcagtgttctgcatatatatatatgtgccatggtatacatgtgccatggtggtttgctgcacccatcaacctgtcatctgcgttaggaattttctcctaatgctctccctctccttgccccccaccccccaacaggccccagtgtgtgatgttcccctccatgtgtccatatgttctcattgttcaactcccacttaagagtgagaacattcggtgtttgattttctattcctgtgttagtttgctgagaatgatgatttccagcttcatccatgttcctgcaaaggacatgaactcattcttttttatggctgtgtagtattccatggtgtatatgtgccacattttcttaatccagtctatcattgatgggcatttgggttggttccaagtctttgctattgtgaatagtgctgcaataaacatatgtgtgcatgtgtctttataggagaatgatttatactcctttgggtatatacccagtaatgggattgctgggtcagatggtatttctggttctagatccttgaggaatcgccacactgtcttccacaatggttgaactagtttacactcccaccaacagagtaaaagcgttcctatttctccacatcctctctagcatctgttgttttctgactctttaataatcgccattctaactggcgtaagatggtatctcattgtggttttgatttgcatttctctgattaccagtgatgatgagctttttttcatgtttgttggctgcataaacgccttcttttgagaagtgtctcttcatatccttcacccagtttttgatggggttgtttgtttttttcttgtaaatttgtttaagttcattgtagattctggatattagccctttgtcagatggatagattgcaaaaattttctcccattctgtaggttgcctcttcactctgacggtaagtttcttttgctgtgcagaagctctttagtttaattagatcccatttgtccattttggcttttgttgccattgcttttggtattttagacatgaagtccttgcccatgcctatgtcctgaatggtattgcctaggttttcttctagggtttttatggttttaggtcttacatttcagtctttaatccatcttgagtcaatttttgtataaggtgtaaggaaggggtccagtttcagttttctgcatatggctagccagttttcccaacactatttattaaatagggaatcctttccccattgcttgtttttgtcaggtttgtcaaagatcagatggtggtagacgtgtggtgttatttctcaggcctctgttgtgttccattggtctgtgtatctgttttggtaccactaccatgtgtttttcaaactgttgggataccacctgggtttgggccctagaggggacctctgggagggaagggaaagtgaaaggagtgtggcttctgcttcattcagtgtcacccagtgcacaactgctttcgaaaacatctattttatatgttgggattacagttgagaaataggttccgctgctaaagtagaaaaaaaaagtagtttgaagaccactatgttgaagacttctgattagattattaggtgatagcagaaacctcttataggagaggaaactaacgaacaagagacttctgagaagacgctgctgctacctaccagtggatccctgcttttctgcctcctgtctgtctatagtgcacattggctccagaaatccagcaagattaaggcatagtagtgatttccggactactgatatgaaaataggcaaaactgtccctatcaaatccagtacatgctattttataaggattaggtgacttgaattgtagagggttttggtcaaccaaaaggttcagatactgctgcattagacaggaggaatagattgtaacttcaaacagtaaaaaaatcaaaccaggctttgcctttttgataatcttttgacttttttagtatactaagttaaaggtaaaatgtggagttgaaaccaaaatatggaattggaaaatgaaaaataggccaggcatggtggctcaggcctgtaatcccagcactttgggaggcccaggcgggcagatcacttgaggggctgagttcaagaccagcctggccaacatggtgaaaccccatctctactaaaaataccaaaattagccaggtgtggtggtgcacaactgtaatcccagctactcaggaggcagaggcatgagaatagcttgaacccaagaggcggaggtttcagagtcgagatcgcaccactgcactccagcttaggcgacaaaatgaggctccatctcaaaaaaaaaaaaaaaaaagagaaaaatgaaaaatagaatgtttgtagtcattaccaggcaacctgtttcccttcatttgatataccaactattaccaactattttgggagtaaactgagggattatattttatgctttgatgtagtttgctttttaatatttagaatttttttaaaatttttgttccaagacttgctgaaactgttttttttaactgtgtacttaatgttgagagagaaatattctttatgtttaaaaagaattgtatgatttctgaattgactgatgttcttatgccaggatcctgatcatttgagctgaatttatttgctagttctgaatctattttcattagctaagctgttgccagaaaaggccccatgggaagaacaaaattagtttaataattttgctcattcatccatgcacatgtgacacgactgttttcatttctgatattgcagttgaactggatcaaaagcaattaattttcacatcctctgagtacgtctgtgtctcctgtcactctgaagtcttttctgtatatctgttttcttctaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcaggtaactctgggatccttccctctgcattgttggtgatttagagtccaccacctaaatgagcaatgtccccttgagtccaccaccttagagcagaggtcacctagagtttcctggaataaacagatagcgatgtattggtatagctccccagattttttgtgtgtcatgttattaaggctggtgtctgaaagtgtggaatgaaattcatcacagtctctgcctatactgaagatgtattctaggctaggttagagtgctgttaaaactgcccacatttgatttgtcctttactgggtgaccatttcctagtgccaggcattagcacatattgtaaggagagacagacagacagtttctgtcttcaaagaggtctttatataaagaatacaggtaacgaagcgcaagtgcttggtgatagcacagtatgctaagtgccacagtagaggtgagaccaccatgtgtctggagcagagaagaggaggtgtttaactttgcctcagaaacacacactaaagggcggcatagcatttctgcaaggagcatggactccagagcttctgtcactagccagctgtgtgacctggggcgtgttccatgacctctctcttcatagtttccgcatatttaaaatgggataattatagtgtccatttcaataggtcgtgtgatgactaaatgagtttctctgtttagatagtggttagaacagtgcctggtgatactcagtgctaaaaaaatggggaatgcacgtggagattggaggatgagaggaggtactgctaagtagttttgacctttttggaatttactttcaaattttttgaggcaggtgtgtgtgggagaagggaaaggaacatggaagggggtggttggagatcagtgggactgagaaaaattaattgttgtatgggagaaaatgaaatgcatatataataggtgagcatatacagttactgagtttcacaacacttgatcacagatgcaagaaatcttggtgtattggaagtgaaggatcaaattcataacaggacaggaaagagaggaagcatggtgagaggtaggagagatgagaactgaagattaggttaaggaagttaaagaaaatggtatggtaatacagtacatggaaaatgatgttggtagaatgtagattgacggggaagtgattgattgattaagacaaataggaacattattaatagaggtttgatagaagtaaaagaaagggaagaagtaattttcatagccagatttgggaacaattggacaaagaagattataatgatgacgggttgtcaattaaataagggatttgtgaacagagtgactcacgttgggaagagaaggtaggatttgagatcgatggaatgagtgacaaggcaagggaagtatttagcctgtctgagggaggtcggagggagaatgagtgactgctgacatttattacacgtccaccttgtgccaggtccagtggcgcttcttctatggggagcatccaaaaaggaaaattacaagagggatgctaggtctaaatgcatagagcttggaatataaaagagcccagatacttcagttgctcatgttatatattcttttttaaaaataaaactttatgaccaggcatggtggctgagcacttgtaatcctagcactttgggaggccaaggcaggaggacatcttgagcccagaagttcgagaccagcctgggcaacatggtgaaaccccgtctctactgaaaatacaaaaattagccaggcgtgatggtgcatgcctgtaatcccagctgctcagaaggctgcggtgggaggatcgcttaagcccaggaagtagaggttgcagtgagctgtaatggtgccattgcattccagcctgggggcaacagaatgagaccctgtctcaaacaaaaaaaaacctttaaaaaattttatttaagaaccccatgtttgttctaaataattccatataaaagtatgtgagaacccagtgaaattctcttcacctgttatcccagttaatcatgcactccttctcctcctcagaggttctgattaacagccggatatactctcttacagaccttttttgagcatcacatatatatgtgcttgtgtatatatatagattttttttttaagtcatgaatggaaggagcagtgtaattgccctggacttgctttttcctgacaacttgtcttagaaatctttactgtcagtgttataagctctagcccactctttttcaaggttgcatgaaagtccatgatataattatgtcacagtttccttaatccttctcttcttgatagacgtctagcagccactatctttctgtttctcagtaatattttaatagtcgtctcctccgggaggaagagagaaaaagaaccatagtccctagatcaggattggcaaatacatttcatctcaagtgccagttcagattgttttgccgtatctgctgctttgtggattgctgtgttgagaacgatcctgaggctcagtccaaacgcctaggctcatcagcacatcctgccatggctataggaagtggagcaagggtcaggtgccaagcatattctccttgccttgaatagcacacctgagttttgttacacttgcatgaacacagtagcccttctgtggctactcctatttcctactaaaaatcttggaataatttggcacagtgtagaaactgcattaaaatgaagagtcagatgccctgtcaagtgctgacttgctgttgacctagccacccaattcattgaaatcatcaaagccatcatatgggaatgacttcatcttccctctgtagtctctacacaccagcctctgtccccatttcctccttcactctattacaagggaacaaatggtcccccctcattaaggccatctcttcctcatttgttctggtacctgtctccttgtgacttctcaaggagacttttgtttagttattgcttccttcacctacactttcaatattgtataactaaatactaacttgaaattcctgtattagtctgctattgctactgcaatagatcaccacaaacttagtggcttagtagacaatgcaaatatattctgttacagttggtggtcagaagttccaacatcaaggtgtccacagggctgtgtttcttctaaaggctctagaagagactgttgccttgccttttctagcttctagggacctgcctgcattccctggctcaaggccccatcctccatctggaagtctctctctgactgcccgtgactctggccttgctccttcccttttataaagacctatggcattacgttggacctactcagatgatccagtataatctccccatctcaatatacgtaacttaatcatatctgcaaagtcccttttattaatgaaaggtaacatattcacaggttccagagataaggacatggacgtcttggggaagcccttgtgctgactgccacagtccccaaatttatatctccagccttgatctcttgctagagacttacatattcagctgtcagctttatgtataaaaaacaaatgcttgctcttcctcccagatactatttctcctggaattggcctcatttttgtaaatggcacctcttcatctcctaaagccagaaactaggagtgattcgtgacatttccatgagacatagaatcgaggcctggccattctgccttcaaatcatatcttgaattcatctgtgttttactaatggagggtagcagttaaaagtataggtactcaagctgaaggctcttgcttagtcaaagctctaccattcccctactcttgggaaagttacttcactttcctctgcctcatttcttcatctgcaaatgggtcataggatcattgcaaagaattaactaatacatatttgtaatgtacttaaaacagtgccaggcacactaaggggctagcagatattagctctcattatggtgacccgcactgcacctactttcctctagcctcttaactgatcttggtgcttccagccttggcctgctgacgttcatcccgtacacaccatccatggtgatcctttgttgacaatcacatcatcgcattccctcacctagaatttttcagtggtttctcattgcacttaaaatgaaactcagatgccttcacggaccttcaaggctctcgacatgatccagaccctactgcctcttcacactcactttgtccccttgttccctccacttactataccagtgcctcctccaggcctcagatgcagtagtgatgtcaggcagttggatgcacagttagtaaagagcaatgaaaagtatacaaacctccacttcatttgaagcttaattttaacaactaaatcatgacgatagatgaaatcaagcctatcctgatattgagaaggtatgaaaaaaaaagatttttcaacttactcttcttaaaagatttaaaaaatattttcactaaatgtttaatcttttaaaaagttgttaactcgtgttactttaaaataaagggataacttcattagatctaaagtccatgtggtttcctgtttccctttatcatatccctttaagctttttcagataagcaagatcaatggaaatctactcataaggtgggtgaagcaagccttggtgcagagccagcagtgtaagagaggaatttttccagccccctggcgtcccccctgggatcgcttgagaaaattatttttccagtaagctcagtgacgaaacatttcataaaactccataaagcacacagatttttttccccacaaatttgattaaattccattgtgtaaacttatttaaaaggagataaatttaatgaagcctcacattttgtcctcattgcgtgtgtgggtgtgggagtgggtgtgtttaaggaatgaaatggttatgtcaagtgaaatttcggatatagctgtaagggaacacttcctgggaaaagggctagacattcatgcgcattgaaacaaaaagatatcatgagaaaccactgtggataaagtattcttcaaataagcttatagaaatgctttatagaagaagaaagtggttcttcatatatattcatatatatttctaccctatcagtgttgttttttctttttgctactttgtccaccaaggctctcaaatacctcttctcctgggtagcctttcctgactcctccgggcagaattagtttctttttttgtgtttccttcagtttacatctcttttatagcctccttgtgttttgtttgtaagataataggaccccgcagaggctcacacctgtaattccagcactttgggaggccaaggcgagtggatcacttgaggccaggagttttgagaccagcctggccaacattgtgaaaccctgcctctactaaaaatacaaaagactttatccgggcatggtggcacatgcttgtaatcccagctacttgggaggctgaggcaggagaatagcttgaacctgggaggcggaggttgcagtgagccgagatcgcgccattgcactccatcctgggcaacagagcgagactctgtctgaaagaaagaaagagagagagagagaaagagagaaagaaagaaagaaaaatataatagggaccatatctgtttacatccctgaagtacgtagcacagaatcagagttctctaaatgcttgtcgaatgcaggttgttgaagaaatgtcattgatgtttctgtcctccctaaaaatatattgttattcaataatgagcctaagataatcaggaatgcatggtgattttatgcatctatattcaccactttggattctgcaggggagagtagggatgggtagcaaaggaggaaggagggatgagatagtattgatattagaaaatgacatttgttcccaaggggtttacagtaaagttggagataggatactgctaccagggagggggcagatgaaaattagttaaaggagagaaaactaaaggtacatgactttaggaatctctcataatcttctaaggagttgtttttgaaacacttattactggttaaataactaatttcatggtggtttttctttagtaactagtctgagagcagtttcacggaaaattcctgctctttgaatattgtaggttcagaacgcattacttttcttactgtgtgttcattttccttttgagaaacatgttgagatcagttgctctagaaaggctttcttgctaagcgttccccttaatgctattttggttgaaatgtgcatgaataatgcataaaatccgatagcgtagatgggcaaaaccaatagatagttatatcatgaaactgaaaccagttttagcatttctcagcagatgtaagagtacatcttttaaatcttgaacacttggagggcaccagccatatcattcatctttccaaactgcttcagcaacttgcactttacctgatgtgtggtaggtacttagtaaatgttgacttattacatcgaagtcacatgaaaatactttgttttctaactatggattattctgcaactggcctttagttctagaattgttttctttgtagagttaatgcataatgtgaccttcctaaaaataatgttgagaaacaagacaaattgggaagctctggatttggtagcccaaaatagatccacgtaagatttccagtagcccacacactacggtttgtataactcctcatgttccattacatgtgcagatgttacaaattgtagaaaacagtagtagatttagttgcttggggatgagccggtacttttaagaaactctgtcacaagcaataccctaccatttggctaattttgaccttggacatcattcagagaggatctgtctagaatgtctccgactcttgttgcttgctgccaagaatctgtttcaagcttttgtcacttccttagtaaattattgcagcagtctcttggcagccccctctggactcatcccggttttcagtttatgattcactttaaatatgttaggttgtgtttactttctttgtgttcttcatatttactgtgctatttctgagtttatgcagttgtacctcaaggctaaataaaaatttggcactgatattttaagctgtaccttgggttgctttggacattttcagaacatgcctggtacgtgggaaaccgtaaacaataaaggtattaaattaagcatgtgtgcgtttcctggctgttttctgttaccttcagtaacaggaggaagggtgacttggacattatccacagttcttccccatcttgctgctttgtgtactatttgttctcaggctggtttccaaaggtcaggataaaaaagtgcttatcaggataacttacaagaattgttggcatgtttatattgtgaactttatggcctcttctttcagccttttaatagtaggaaaaattaacaaatcaactcttggaaagttctctcactcaattacaaaaaggagcatagcggtcaggatcttaattctagagtaaagttaaagtcaccataagccggcaatagccattcattggcttccatgctattttgatgagaaaggagactgtgttcaatctgaatgtgtttaaaataattctgagttctaacatggacagaactttaaagatcttaaagcaggtgcagtggcttacacctgtaatcctagcactttgaggccaaagtgggtggatcacttgaggtccggagttcaagaccagcctggccaacatggtgaaaccccatctctactaaaatacaaaaatgctgggcgtggtggtgggcgcctgtaatcccagctactagggaggctgaggcaggagagttgcttgaatccaggaggcggaggttgcagtgaactgagatcacgccactgcactccagactgggtgccagagcaagagtctgtttcaaaacaaacaaacaaaaagaactttaaagatctgggccattgtcgacccataacattaaagcaaactttgtgagattttacattttaattctattaatactgctgttttaattgaggaactaatcaggtaaagattctgtccaccttcaatgcttctgtaaactagagcattttatcttgtaaaatatatgtttttcaaggtgttattctgacacttcttaatgtttttgagagacagggtctcgctctgttgcccagtctcaaactcctgggcttaagtgatcctccacctcagcctgccgagcagctgtgactacaggtgcacaccactgcacgtggcttgatggtttccctataaaatataatcatcgactgagtcacctgaatccttttggaactagatgggagtaaacacacccacaaataagtgcttatcaagagtattccatttcccgtcattactcagggctgcacagattttcctaagtgctcatcaaaagttcagtaaataatgtagggctatttcataaatcttttatgctgtttttcaggggtcagaagtttcctaaaatttttgagtggttttgcctgttatagaaacgtatatgtttattaaggagaaaatggagtgggaaataaaaagaataacgacaggctgccattgtctgaagtctagctatgtatattgtaaaaataccttccttctgctgcattaaaaaaatatggctctagaaaaatcaaccagttttcctggcaatgaggtaagagttaaccagaccagaatatagtccatgcatccaacatgatagctagctcattggcttttagggacaggtttttgtgtgtttgcctggtttttgtttgtttgttgttgtttttattgtaaaatatacataacataaactttccaacgtgaccctttttgagtgtacaatgcagtgggattaagaacctttactttcctatgcaaccatcaccaccatctctctccagaacttttttgtcatcccaaactgaaactccatccccattaactaccaactccccattcctccctcctccctctccttgtttgtcctgaaagcctgagtgtcgtggcctaaccctactgcaagagagcactgcaaccagcacatgggaggcaggatgcacctcttcccttcatgctttctactaaggcattaatatattacccactaacattttgatgtttatatgtgggggaacattgaagaacccagaattttatgattgaattattggtggggcgtggtggcccatgcctgtaatcccagcactttgggaggccgaggtgggcggatcacctgaggccaggagttcaagaccagcctggccaacatggtgaaacctgtcactactaaaaatacaaaaattagccgggcatggtggcgcgcgcttatagtcccaggtacttgggaggctggggcacaagaatcacttgcgtgagggaggcagaggttgcagtgagccgagatcgtgccactgcactccagcctgggtgacagagcgaggcttcgtctcaaaaaaaagccaaaaaaaaaaaaagattgatttatcacttcatagataccaagatgtagcactgatttgttttacagggagacttgaaaataacttctatggataggctttgactttcatcagcaacctccacagtggctatgccctctttggtattgagctaaacatgtttaaactgaaatatctatagaaccatgagtctccacatgaaacgatgctgtactagcgatagattggtgtgaccaaggctttgaaggtataatctctcaagaatggttctctgttactgacagagtaagcccaaactatttcacacagtatacattccacatctctctattcattgcactagaaatcactgagctttggcttttaagcaactagtttttatttcacaggcactgtaaatcatgtaattgatgtttacttctttgcctttgaaactacaaagctcagagtttatgattcctctctagtgagtatacagaacctcatgacatgtatcgggagactacctcatccctagcttcattttatatttcttcccgctacctacctttttcttttgagacagagtctcgctgtctctcccaggctggagtacagtggttcaatcttagctcactgcaacctccacctcctgggttcaagcagttcttcctgcctcagccttccgagtaactgggattgcaggggagtgccactatgccgggctaatttttgtatttttggtagagatagggtttcatcatgttggccagtctggtcttgaactcctgacctcaagtgatacacccacctcagcctccccaagtgctgggattacaggtgtgagccaccgcgcccagcctgtgtttgctttttatttatcctatgtagtcagctttaagactgactcacagtctcatgtctgcccgttctgtgccttccactgccatctcactgcacagtgcattcctcgctgtgttggccatggtgttcttattgcttgggacagctcctgtattgtaactgtcctcatccccactcttactccttgtcagcgaacgcagctcaatcatcagccacagttctttcctgatacaacattctccactctgtaaagttgactgatgcctcctttgtagcccgctgcccccattcagactcctgtgatcacctagagaaatctactgaactcgtttgttcacaaaacacttccccgctgctgggccatgcgcagggaccagatcttatgcttccttcacttcacaggccttgcaagatatgaggaagggaggaatgaattcagcagcatcagatgtggtggatgagtcaaaataagaattgaaaaatgaccattgtactttgcaatgtggaagtaattagcgacctttcttagagccctttaggggaagggtggggatagcctgactatattatagcgagaggtttgagagcaaagtatagaggaggagtaaggaggggggtgaggggagggggaagaaagaggtggaggcacagggagacagggagaagagtaaggacaaagagggggcacagagggggtgagtcgggctgctaatcacagaggacagggtctgcactgtcatctgatggagcatccctaggggtcagtgcagtggtcccacgcaggggttctcagtgtgactgatgagtttgtgggtcgtagatctttatgtagtcactgagttgaaatcttgttctgcgaagtccgtctttgcttcatagaagctcttactgttccgtgtttaatgtttatgtctgcttttgctaaaaaaaattctttttaggtgggtaagtccctgccttatgattgatgtctcttaaattgcaaacacacaatcctgtgcataaatgcttgaggtattttgcttcattgctttatgattttcatgacttctaaatcataaactaatactgtgtcttaaataataccagtacagacgaaattattttgattttttacattttttttctcaagtgaaacaaacttcaaaatgttggagtggaaccacccccaccccaagatggctgttatcatccctgatgcaggtcttgttcctgccgcctcctggagcacctctctcacctccgcccgagcaccaattccactgtttcaaaatttgccgttgtgccatctctcctttgcagcctttcctgacaaccctgtgcctactccagaaaactaactgatctctttccacacgtgccctaaacaaacttctgtcattgtattgctcccatgttttcagacatctgtttacctgaaccagactggcctttcttcaatgcagagaaattatttctttacttgtattttagagttgcaaagcattatcctgggttttttttgtcttagcattatgtatgttaaaaacaatcttttatttcattaagttgttcttgtaaacataatgttaataacttatttcatctgacaggcaactgtccccctcttattgactatttaggttgtttttaattttttttcaatgatagtttgtttccttctgccaaaattgacaaagaaaaataaatgtctctttaaatgtattattaaaatgtccgtttctggccaggcgcagtggctcatgcctgtaatcccagcactttgggaggctgaggtgggcagatcacctgaggttaggagtctgagaccagcctggccaacatggtgaaaccccgtctttactaaaaatacaaaaaattagctgagcatggtggcgcatgcctgtagtcccagctactcgggaggttgaggcaggagaattgcttgaacttgggaggcagaggttgcagtgagccgagattgcaccactgcactccagcctgggtgacagagtgggactccatctcaaaaaaaaaaaaaaaaaaaaaatctgtttctttgttatgaggtataggacagaacaaaactatattttcagaaattttactaaagttatatttacagaaaacaaaactttcccaacattaaaagcctttctgcaggtaacttagatcatttatagggtccagcgttgagagccaaaggtgcattatctaacctgcacttgggctggtccaaccgtcgttctcctaagtcagcctaatgtggtaacagtaaggttctgtgatttttgctgaattatgtaatgcagtagtggaaaaagaaagcactaaaacgttgttatttcctgaccagtttagctataatacaaatttagcagattgttgataaatttattgaaataggaagtttgctggaatgtgtatcagagcctttcttagagctgaggatgagggaatggcttgtcctctgcttaagatgggaagttggaggtcgtcgtgaatttccattttaatgaaaaactcaggcaccatttaaagtttgatggagactgagtgactgctgttttgagccaaaatacataaaacattaaacaaggagtcagaaaacctgggttcaaatcctgtcttgcccactcacaagccatgagagaccattagcatgcttgttaataaccacattgtcctacctcacctccactaaagcatccttttgatgctcaaaagagatgaagaatgtgaaatgcctgaaaacgctactgtcgtgtacaaaaatgcgttgtcttcttcccaaactggcagatggcaccactctgaatatatagccaattggaaatgtgacctttccatcctaagaatgcctgcctgacaattactatagggttgcttcgggcttttgtccttgagaatttaaatattatcatcctggaaaaagtatttttaaaagtattttatttatttttgtatagagacagggtctcactctgcccaggctggagtgcagtggtgtgatcatagctcactgcagtctctcaactcctgtcctcaagtgatcttcctgcctcagcctccccagtagctgggactacaggtgcacaccaccatacctggctgttatttttttgttttgaaactttttgtagagatgaggtcttgctgtcttgcccaggctggtcttgaactcctgtcctcaatcagtcctcccatcccagcctcccatagtactgggattacaggtgtgagccactgacccgacctttttaaagtatttttaaattactttacttttatgtctacagtattggatgtaatttaaacttctcataaggacagctagctactacagctttttcattatacatgagttttaaaaattaaaatttttttggaagttatacttaagatgctttgtgagggaagaaagaggtggaaattttgggggcaaccactgaatatgatttcgtaaagaactgagtaatctttggagatgtcttttactatgtgagatctgtttacttgtaagcttatgtaagtgtacctctgtttgataaatccacttcagccttatattaggtgcaggttctgtgaaatccctgaggaggtagttaacagatggattgttgagggacaaagtaggctgcttaggtttcaaagcctgaggcatgaagggagggatccattgttacggaagcctcacacccaagttcaattcattaactatgaacctgctctgccacagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacaggtaggatcgcctctgacagttgtcactgctgcgtttttacgataaagtacatttggattcataaagaaatatatgtcttgtcttcatttttccccgtgtaggggatttatattgctatatcacctcaaagaaagcatttaacttaagcactttttcctctgtccatttaagagaatcatctataattgtaggaacagagcacatgggcttagcaatcatgttcttagaggggcacataaatcctttagttggtgatttagaaaggttattcagaactacctgttaaaactgatcctatgtgccctttctcatcatacatcttttatgactctgccttccattgctattttagtttctggccatttgatcttctagttggttttattaagaatgagtggcaatgttgccagtctgttgatgcaatttagttaaatttaaacaaagacttttattaagacccaggacttgctgaacatacccattttatactgtctaataacattagtatgtttttatccccttaatggcttggtcctagagattgtcccgaattaatgagacgtaatagatacccacagttctctgatttcagcccaagtttagagagacagtggtgtatatgcatgctagtgttcatatagtaaaatattttataaaatgatcagtgaaggatgtattctgttgtcattataaaaattactttttgggtaaggagttattaatggtaattgctggaaaataattttttgtttaatatttgtaggttgtgtaactctaattccatttctgtactatgattctggccacaatggttttgactactgttctagaaaaaaaaagtgtgcatcacttctctggcttatgtgtattttccctttgttaacaaaaaatgtctcagtttgtatttatttttaaaagattagtgagttttaggtaaccaactagataaaaacagttttcttctgttgggttagaggttgtcctccaaacatgcttataattgcaaattatgtgtccagcagtgagtgtctttcccgattccctctgtagttactatcagtttctttggagtgcagtacaaaattctatttaagacatgaaatacttaacagtaaacttggcagacctaccaatctctaaagagaagacagtctttaactatttaacacatacaccatgccagtctgatgagaacacaggtgaaatctttggaaagttcaaagaagcatgcagatattcagtattattaatatcagaaaaagcattgtgcttagatgctgtcctctgctgtagctacaggggatttctttattgcttgtcaggactcagtagttctttcgtatgtgtgctataatcatgacagtagttattttgcatttgacagaattatattataccatattcatacattctgtgttctaaagtcaaacccagaatggtacaaatgtgaaagttaagatgagattaaactttcaaaaacaaatgcagtcaggacaggtcactaaggaagaatacaaagaaatgcaagcaggtgacctaaccagaaaagtgtaactgataaatgagatgcaacttactaaacctataaatgtagtatgacgttcttcagttgttcaaagtgaaagaggaaaacttaggaaattgtcagcagtgtaatatgtgggaatacgtaattcctatttttaaaaagtagctttcacaggagttttttaaaacccttttttcataaagttcttctctaatcaaatagatagagcatatgccacagataatttaaaagtttaattttagaataggaaacaagagtattcagtgctatcacatccctcttgcctgcaccctacattgcataataaataatctatgattataatagtttttatattgatatcaagaataatttgtattcatagtagtttgggttgtgttttagaaaaacaggcatatgttgctacatgacctgggggatcagcctgaagtgaccaaaaaatttatttgaagtcttgtgttttatctttaaaattcatgtgaaaattgtatttgacctcgtcgtagatttctgttttccttactattaaaaaaaaatcatttacttatgatttatttaactttcccataggaaccttgcatttctccctcaccccataccaccagtagtaccccctgggaaatacataaatttagggagacatgggaaacatacggattataaactattttttaaagagagactgtgtattttttaaaatgagaaaagagaatattataaattgtagttcacatagaaagtattaaatcccagcttaacttttgcttgtaaaatagaacaagcgttttcaacctttaatttcttttttagccatggaactatttgtgcaacagaagtttaatgtggaagctgttaaaatctcaccaccttcatttctgtggtactttttttccagaaaatatcaagttgctttgtggaaaattagtggacaccgtagtgtagtcaggtttatatttacagagcttattgccatcttggccacattccgtgggagcaattctcaaagcttggacctaatttattatgtttattttgagctctaatcttctaacttgttagcaatattacccaacttattatatttggtaaagatactgatatttacttcaaccttgccgccaaatacagggtagatgatactaacagaaagcaaattagtcagaatctgaaactgttggatccatgttatgattctgtaaatgttattcattatattaacatgaatagattaaaggagtaaaccatatggtcaacctaatagattttaaacatttcaacaaaattaaacagttattcaaaatgatcaatacatacattagcaaatcacaaatagaagaaaacttcatctggttaaaacttaaactacttgataataacatattaaaacagttcttatcaggaataagatgcctgctgtcatcttttttattcagtattatttggaggccacacccaaacacacacacataaaacttagaaataaaaaatatgatgacatcgtcgccgtagaaaacttgtagaagttattagagtaagaaagtttggctaggctgccatatacaaaatcagccaattaaatttccgtggaccattaacagacagaaactacaattaaaactgagggagaagatatttacagtagctttaaaaaagtcacatacctaggaataagtcttgggaaaaaaagggtgtaataatgaaactttctgaaagagataaaacttactgaaaatgaaaattcattgtcctggtatatgtaatagagctagcatagcagattagtgagggaaagaatagatggtttggtaaattgtgcttggataatcatttaatatggaagaaaaaaagaaaatgggtctctttcataaatgtaaatacgaattctagatgaatcaaacacttaaatgtggaagttcgaaacttaaatactttggaagaaaatgtacaatatctttacaagtttaagatagggaaggattttttataacagaaatatgatagggactttttttctgtctgattctaattacttgcacttgattagcttgaataaagccttctgtaataaatgtggctaagaacctgagaggtttattttgctgaagtggtagattaggaccccaggtgattgcttagtttattcacccttctgattgctttagattctagttcttagccgcaggaaagaggagtgtaacataacagttgtcactgcacatgaagcatttacacaaggaatgcacccacgaattgaaggtaaacaaagaggctgaaaacgtaagctaagaaaataccttccaggaagtaagattatattgagaaaatgttgttagtggtaaataaaaattatttaacatgaatacatttaatcactagaataaaactaccttggttttaaaacctcattccctaggccaggcacggtggctcatgcttgtaatactagtactttgggaggctgaggcgggtggatcacttgaggccaggagttcaagaccagcctggccaatgtggcgaaaccccgtttctactacaaacacaaaaattagctgagcgtggtggcacacgcctgtagtcccagctgcttaggaggctgaggttgcagtgagccaagatcatggcattatacaccagcctgggtgacaaagcgagactctgtctcaaaaaaaaaaaccaaaacaaaacaaaatctcacttcctaaagatacgggatagatgatctgggctcagacgtcattagatcagggaatagagttagcagcaagtcaccccacccagagatcctctggtgccctgggtagaaaaatactctgtctatcaggaaatatttggggtaattcctcatcatgtagtgaccaggagcacttaagctacacctttgattttcagagaacccaggagcagtgagcagtaaggaaaagagcaagagccctgcccagaatgagccagatttgtggtgagggctgggggctggagggaacagtggttccccaagacaatgggagcctgtgctctccttttatctcccggctccctgcctagagtacttgtcctggaaagtagagggttgcaataaaaagaatgagtagcatcactagaagcacaagcagctctgctgtgaagcccacctctttcacaagctggacacaagcctatctcaactctcccaagcgagaaaagagaactagggaccaaggagcaggcaatgagaagctttcagaggaatagtaaaggaagaagatgcttggtattctaaaaggcatgtaggtcagacgagggcaccactgtgctgtggtgtaggcggactgttggcagtcctgccacggcaggtgtctgtcatcagaggccagtggagattggacacctggaacagattggcaagttgaatggcagcagctgaagcagaggactaaaagccagcaggccactcattacgtgtgacatccatctctcccacaaaagtgcatttggagacataataaatgagagggagtgccagcctggcaggaggagactagagtggttatccagcgaatagggctccaatttgaaaacctcatccaggactaacaagctgctaggccatggggtcacttcaagtatactaggaagaagaaacaaggcagcctgagtctagattcatgagaattaccttcacaaacccaagttgagttgcccagcttattgccaggaattactctgggaaaactgtgaggcatctttcctcaggccattgacctcatcctgccctagtttaaagagcagataggagttgctcttttggagacgggctgagactctttagaactgcttccagttctagcattttctaagcaaatgatggtgagacatactttcaccagactccaagcgcttgttctcatctagtctagatgagtgattattgtaggtaaatcagagcagttttctagggcagccataatctgtaaggctatgcttaaatcaaccaaatagcaaagagctaagaaacttatgtacgaagagaaataaaaaatattttcagatgaataatcccatttctaaaactttttattatggaaattttcaagcatgcctacaagtagaataatataatgaacccttgattcccatcattcaccctcaacatttaccatgtgcccaacttggtttcatctataaaccaccacatcaatgttctgatttatttttatttgttgtgagacagggtctcaccccattgcccaggctggagtgcagtggtgtgattatagcttactgcagcctcaacctccttggtctcaggtgatcctcccacctcagcctcttgagtagctgtgactacaggagtcactagcatgcctagctaattaattttttttttccagatatgaggccttgctatgttacccaggctggtcttgaacccctagcctcaagacatcctcccaccttgacctcccaaagtgctgggattacaggcatgagccactgcgctcggcctcctatttttaaagcaaatccaagctataccattttatctttattttttttagggacatagctttttaactaacaaaaattgtatatttgtagtgtacaacatggtgttttgaaatatatataccgcacattgtgtaatggatgaatcgagctaatatatgcatacctcacatgcttattttttatggtgagaacactttaaactatactctctagtgattttcaagtatataatacattgttagtaactatagtcaccatgttgggccaggcgcagtggctcacgcctataatcccagcactttgggagaccgaggtgggtggatcacctgaggtcaggagttcgagaccagcctggccaacatagtgaaacccccgtctctaccaaaaaatacaaaaattagccaggcgcagtagtgcatgcctgtaatcccagctactcagaaggctgaggtgggagaatcgcttgaacctgggaggcagaggttgcagtgagccgaaagcaccccactgctctccagcctgggtgacggagcgagactccatctcaaaaaaaacaaaacaaaaaccatgttgtacagtagattacttgaactgatttctacaaaaaatatgggacacttcatgaatttgcatgtcatccttgttcaggggtcatgctaatcttcgtatcatttcaatgtttagtatatgtgttgccaaagcaggcactcatttcatcttttaaataactcagtatgtatctctaaaacagtgggagtcttttttgcttctaaaccacagtactattatcatgtataataataatttcttaattatcatcaagtatttagttagtattcacattttcttgattgtcttgtaaatgtcatttagtaattggatccaaaatggtatttagtaataggatcccaaagttctacatactgcctttggtttctatgtctcttaagtcattttactccaggtttcctcttccctcccccattttttcttgccatttatttttcaagaaacctggtcgtttgttctgtagagtattctaccatctggatattgctggttgtattcctggggtatcattccacatgttcttttactcctgaatttcctgtggactgatggttatttacaaaggtgtggccagatttatgtttcagttttttagcacaaaattcataggtacacaaaccataggtacttcctatgacatcaatcagagagcatttgctctctgattctcttctttctgtaatggtgagattgattcttgggtttagtcattgacaatctgacacatccatgataaagttgcctgacagtctttcacctaatgatttagtggttgatcattgtcttcatctttatttctttaggtgctgcaaaacagtagtctttcaattctgtcactccttctacatttattagctgaaaatctataaagaagagcttctgacagggtgcagaggttcacacctgtaatcccagcactttgggaggcagaggcaagtgtatcacttgaggccaggagttcaagaccagttggccaacatggtgaaactctgtctctgctaaaaatacaaaaattagctgggcgtggtggcgggtgcctgtaatctcaactacacgggagactgaggcaggagaatcgcttaaactcgggaagtggaggttgctatgagctgagatcacaccactgcactccagcctgagtgacagagcaagactctgtctcaaaaaaaaaaaaaaaaagagcaaaacttgtctcaaaaaataaagaagagcttcctaacacctccttataaaatgatctatatattggttccctagcatcctacaaaggtaatatatgagcccatgggttggatttgtttaaatctattacagtatctttccccctctttggtcagagtaagcccctctgggtcagcttctgtgtccctctgacaggaccctcattggtttctctggtaattttttttatagatatttgtaggcaataactccattgtctttgatagctgccttgctttctgataagaaaaaagtgtttcaggcttacatcatttgtttcctgccccagacatagagtcagctatttctctaaggagccatatttcattttagtgggaaataatatttagaaataacaatctgagtggtaaggatgttcattgctactgcattgaccgttgtttgtagtcttattcctcggagacagctgaaacctttcctcccctttaaaaaaaaaaataaccgatgaaccctaaacaaaaacaggtaaataaaattgtttttgtccttctttttaatttatatgaaaagatgtttgagttttggaagtttgtattgtcctttgaaactggaatttaagaaagaggtagctgaaaagaaagtactgatcttagaataacattgttttctattggtaaatgtgaaataagaaaaattgcccatatatttaaaatctatgaacatggttttcctttttcttttttcttctggagacacagtctcgctctgtcgccaaggctggagtgcagtggcactatctcggctcactgcaacccctgcctcccgggttcaagcaattctcctgcctcagcctcccaggtagctgggactgcaggcacacgctgccacgcccagctaatttttttgtattttagtacagacagggtttcactgtgttgcccaggctggtctcaaactcctgagctcgggcaatccacccgccttggcctcccaaagtgctgggattacaggtgtgagccactgcgcttggccagtttttcattttattgagaatacaaaggcgtgtctggtctctacaaagctggttgtaaagttacattgtcaaatgtaaacaagaggtgacgagaggctgtaagctctgttatttgtacctgggtcccttgatactactttccccattcagaggtctcgttattttctccttttgatccctggactttttcaatatcttaggtaaatatccaatttctatttcaagtttactttacaaacacttataatccccaggatgtcaacagaaagaagcagttaaatatttattaaaacgtatattcttgcttggcatctcgatctatttatccaaagatgtaccctcttcccccaaccctcccattcccaacacacgtgaacacaagattttgagtgcctaggaaatatctttcacagtaacagccttttaatggtctgccttaacctgtttcttctgcccacatcttctaataaatcatagattgggtatcttgacttctggtgacttaagggatttggtctctacaaatacactgaagtgtctgttttcctttggagctgtgccaatctaaattttgcctaaaggagaaaatcgcctcaggggacacggagttctttggccttatttgctttgcttggtagcttaggaggaattttcctttttcagaaaacaccatatataataataaaaaaattgcaaggtaaataaattaaggaagtgattgttttaaaaaccacatagatccttaacaggttggttggttggttggtttgccttgtgttttagaatcctcagaaaaatttggtttatacacagctcttttcaaaacacattgattgcataaaatgtgatatgttctcattgtctgggctatgacctgctgttgtatcatgttgatacagcacagtgttcagccaggatttgaaatttagcataaagtatccattttaccatagtaaatttcagatctgattgtgtgttttaggacattgtgtaatctttctcagcagaaaaaaaacctgctttaggaaaggggaaggatgcagtcctttgcaggacaggtattttactatgctcagagcaatccaaaaggaaacagaagggaaaataacatacgtgtcagagaaccctggagatattatgtgttatgtatcacagagcaggaaggaaccagaaactcaactcccttcctagaaattctatccctctgatggtaagcaatcaaaagcatctcagatcatttataaacagagttaaatcaggctgtggaagtagctaaagcaaagcacaaacaaattgttatatttattctgaaaaagtaggtgtggtttgaagggaagttagtctggaaagttcagagccatgaaaagcaacacagtcatatttgcagaagggcacttctgttattcagtccatctctgcttcgttttttgtcttctcttgttgtgaagtattttttgcacagttttccccaaacccttgttttggtgatcagaaatccttgtctgcagtgttccagataacatacagcctattaaaaacagccttgctccagagttacattcaacgatcaacaatttttatcaagagttcaaacctacattctagtagagaactccaggtctcaccaaacagcctactgctaccatcagcctcctaatccaactggaggtgttcaagttctgagacatgacctttctcgatagagagcccaagagatttctatgatagtcaagaagggcttctttcccctccccaaccaacaaaattaccagtaataagacagctttggatcctttttggaatgtggagagatgttagtagatgtgtgctcaccaccttgaagcctctctgctccttagagagctccacactgcaggagacctagttaatcctttagggatgacggtagttagctctgatctgtgcagcattcaccatgcattgcattaatctctctgttgttcagaccgtttcctttaggtcctaacgaccgtgatctactctcacttttcacttaatttcaatgactttacatccgtctgttccagcacctgttgtatgaaatctaagttattcttagagataaaggtgagcaaagaatagtgaccttgtccctaggttaaggtctgccttcctgtttcatctttccttccccaggactgtgctgaactctgtgaagcaggcctatagtaagggaatccagctgcctaaaatgacatcttcttagtaaactaaaagcctgattcagagatattttttcatcatttcctttttgctttcaaatgtgaagattctgtaagcattcctgttaatccagttatggtgataaactgagaaataaaaagaaaatgtactgtgttcttgaagcttgacaacaaattctaaattttagaaatccattgtgaaaatcagtttaaaattgtgtacatacaattttaacttattaaagtcaaaacaagtaaaacctcttgtaaaacaagaccaccctaacctttttattgtgtagagccagatttgttaagtggcaatcatagactatagataagtaatttaaaacatcaaaaatgaaaaataattttaagttatggaaatattagcaaaattaaatagtaatatcagataattacatcagattttattattattattatcattttgagacagtcctactctatcatccagcctggagggcagtggtgtaatcttggctcactgcaacctctgcctcctgggttcaagcagtagaacttctgagtagctgggattgctgggattacaggcctgcgccaccacacctggctaattttttatatttttagtagagacaggatttcactatgttgcccaggctggtctcgaactcctgagctcaagtgatccgcctgcctcggcctcccaaagtgctaggattacaggcgtgagccactgtgcctggccacatcaaattattaaacttaaaataggaaaccaagtcattggattttttttaaagattcataactaaaaaaggtatatgactagccttagagctcttgtctgagacttgtactgacctgcttctaagacgctacgctaattttagttggagaggtctaacagcaggttaaatacccagctgttgagtcaccctcgtctctgactaagttgtaagatatggtgctcatttatactaggcttcagaatggcattctggatatacagagagaactttgtgatgactgtatttgtctgaattcgaacctgaaactaggtacagggtacattataataacagtcatgcaggaagagttttaagtgattggcttctttaagaccagcctaaattctgcttctgttgaaatggggatgggcaaatttcaggaatttaattgtatcggtaaattttagacactttgtgttgatttctgtatattaaacttgccaagtatttcatatataactttgaagatcttgaatcttcatgtacattacaactaaagttttaattaatagtacacaactgagaaaaatagtatttttatgaccgtggaatacatcttatcacctttggagggcaaacattttcccttgtttgagggcatcattttcattgtgataaaatcaaattatatcaacttaaggtgagattctgtgagttgtgtgactaaaaaccagtatttactctcagatttaaatgttaagagaatatgaaaaatcatatcgaacttttaggcagtcaggtgaactactaaagatgagtatgttggttgaaatttttgaattctgtcttattaaaataaggttatatttgtttcagactatcttatttatttcaaatatttttaagcccacttagtggaagtgccagagttttaaagtttttgaaggccgggcgtggtgtctcacacccgtaatcccagctctttgggaggctgaggcgggtggatcacgaggtcaggagatcgagaccatcctggccaacattctactaaaattaaaaaaaaaaaaattagccaggtgtggtggtgtgcgcctttagtcctagctactcaggaggctgaggcaggggaatcgcttgaacctgggaggcagaggttgcagtgagccaagatcacaccactgtactccagcctggcaagagagcgagactatctctcaaaaaaaaaaaaagtttctgaagcagattccagaaatgaaataacattttgaaacagaattatctcaattgtaaatattcctcgacattttatttatccagcttcctaatatcctcaaaaccttagagtagttgaaatgtagttaatatttgttgaatgcattgatttttttttttttgagatggagtttcgctctgttgcccaggctggagtgcaatggtgcaatctcccgagtagctgggattacaagcacatgccaccacacccagctaatttgtgtattttagtagagacaaagtttcaccatattggccaggctggcctcgaactcctgacctcaagtgatctacccacctcggcctcctgaagtgctaggattacaggcatgagacactgcgcctggccgaatttttttttttttttaactgccttgttccaaagtttcttaaatctgcactgggaaaaaggaaagtccttctgctgtctatgccagtggttctagaaagtagagattttggactcttgtggtggggagtaggggtcctcaaggccctttcaggggacaaaaaagttacaacagttttcattatattactaaaaatgtgcctttttcctatcattcacttaaatgtttacaataaagtttctagactacttgatgtaagaaatcgcagattgaatgcataaacagttatgagaatccagttatcctttcttaatcctgacatttaaaagattgcaataatgtaaaacagtgctactcttctaactgtttttgttttggaaaatacagtctttttctataaaaatgttatttagggctgggtgcggtggcttatgcccgtaaatcccagcactttgggaggccgaggcaggtggattgcctgaggtcaggagttcgagaccagcctggccaacctggtgaaaccctgtctctactaaaaatacaaaaaattagctgggcgtggtggtgggcacctgtaatcctaactattcgggaggctgaggcaggagaatcacttgaacccgggaggcagaggttgcagggagccaagatcatgccgtggcattccagcgtgggtgacagagcgagactccgtctcaaaaacaaacaaacaaaaaaaaaaagttatttgggttaacatatcacttttacttttattaaatgaattaataagtcaagaaattattttcagctttttaaaaatttgataaatagcaatagataaaatccacattaaaagaaaactataccagatacgatggctcacacctgtaatctcagcactttgggaggccaaggtgggaggatcacttgagtccaggagtttgagaccatcctgggtaacatagggagaccccattgctaaaaaaagaaagaaaaaataggtgagtatggtggcacttgcctgtggtcccagctacttgggaggctgaagcaggaggattgcctgagcctgggaggtcaaggctgcaagtgagtcatgatcgtgccaccgtattccagcctggatgacaaagtaagaccctatctcaagaaaaaaaaaaaaagaaaaagaaaaggagagataaatgaaagggaaagaaaaactaactcttttggggtcttcaataagggttttttttgttttttgttttgttttgtttttgagatggagtctcactccatcacccaggctggagtgcagtagcacaattttagctcactactcacgattttggcaacctccacctcccagattcaagtgattctcctgcctcagcctcccaagtagttgggattacaggcccccaccaccacgcctggctaatttttgtatttttagtagagacggggtttcaacatgttggccaggctggtcttgaactcctgacctcatgatccacctgcctcggcctcccaaagtgctaggattacaggcgtgagccactgcacctggccctggggtcttcagtaatttttaagagtttaattgatcttaagaccaaaagtttgagaaatgctaatctatagcaacaagttacattacattatagtttctttttgtttgtttcgtggttgcagtataatttttatatagtgaaagtaacagatcttacatataaatttggtgagttttgtcaggtgcatggacccatgtaactaacatcccattcaagatgtggaacatttccatcactccaggatgttctccctgactcctttcagtcgatcccccactctccgtagacagccactgctctgatttctgccactatggattagtcttatcttgaactgcattataaatgaatcacagtgcgtgtgctccttgaatgtggcgttagtcactcaacaccgtgtcttgacttccattcctattgtatatatcgttgctctttcctttttattggtgaatgctctgttagtttgaatatcccacagtttggcttatctgtactcctgttgatggaatttgttttttttccagtttggagttatgaacaaaaaagcttttataaatgttcttctagataccattctgcagacatgtttcattctcttcactatgtaggagtagaacttttgggtcatcggggagatgtgtgtttagctttgtaagatgttactgtactgtttcctgaatatgtaccattttgcactgcagtctgaaatacgtaagaattttagttgctccacatcctcaccaacatttgatgttttgtaggtatgacatggtaccttgttctgtggttttaatttatattttcttattgattttgaatgcttttgcatgttttccttagccattgtttttgtgacgtgtctgggagttttgcccattttaaatttgtttgtatgtctttgtattattgatttgtagtaattctttatgtattctggatactaatcctctatcaaatacacgtatcatgagtattttctcttagttggtagcttgccctttcatttctttaataatgaacagaagtctttaatttcttctttgtttgaacagagtctttaattttaatgaagtccactttgtaatttttctattatgttagtgctctcttgggggttctaagtaattgttgcctaccccaaactttcagccactgccctggtgctctctggtgtatcaccagtggtgtgttcttgaagttaacttggtcagtgtcttttgaagagaatgacagaagaatgaaaggtatttagagcacatcagaaattcagtgatgcaacattttaattcctcagagtaaacaatggccttttgttgttgatactatggaataattgtttctcattgtaaatgtgcgcgggacagtttactcattctagatccctaattaatagaaaatcatctggcataaagttgatctcagcaatgtgtgctaagtacctatattacaggttctatgccattcactgcaggttcaacagggcttggaatctaatggtaataagagtttaattaagtaagtaaatctgccacagcaactttacatgttcttaagaaattggtggtaggtgagtaacagtgtttgtaggaacttttagcctttcaaatggagagaatgtgttgcattctctgtggttccttatgccccaaccaggacaaagaaggagtagagagatgagtgttaaatttctaacaatggaatttggtacttttcaaatgacttgtaagtcagaatgtatttatccagtggtgagattgctaggcttttctgctcatcatttgttttcaaccattgtttaaagaatagacttgtgagctgtatcccagatgaactatgtaaagatttttttcaagcaagattatgcatcatttgtgaaaatgaagtgagactttttaattactacagtaatttactctctaacataattttaaaatctaattacttttgtgaattcaagtttattttatagtttagctctaatgacttcctaatttggaagactattttgctttgagtgtttagtaaacttcagcagagcaatagaaattaaagatacaagctgtgtcattaaattatatttaaattgggacttgtaggcagggcgcggtggttcatgcctgtaatcccagcactttgggaggctgaggtgagtggatagcttgaggccaggagtttgagaccagcctgggtaacatggcaaaaccttgtctctgctaaaaatacgaaacgtagccagtgttgtaacacacgcttgtagtgccagctactccggaggctgaggcatgagaatcgcttgaacccaggaggcagaggatgcagtgagccaagactgtgccactgcattccagcctgggtgacagaggaaggatttggaggaaacgataagaagtctgatagttgagaagagaggtgataagtatctaatagctgtaaatagttatacacacacaagtgcaaaacacacgtataacagtatacatgtatacatacagattgtcaatgttgtagttacagatgtgttgaaatctgtttctctgtggaatagttttcttagatttttagttcattctttaatctggaatcagaggtaagaattaagttgtttctcacttttctaaatatacagatcaatattctgctacctaaaattatgattcctacataatacttaataaaaaatacttatttgttaagtgcaagtgaaaatgtgtgttaaataagttggttttgaaaatattcttttaagtgacataagaggctgagcgcagtggcttacgcctgtaatcccaacactttgggaggccaaggcaggcagatcacctgaggtcaggagttcgagaccagcctggccaatatggtgaaaccccatctctactaaaaatacaaaaattagccaggcatgatggtgggtgcctgtaatcccagctactcgggaggctgaggcaggagaatcgcttgaacctgggaggcggaggttgccatgagccaagatcgcaccgctgcactccagcctgggtgacagagcaagacggaaaatgattgttgtgttcttcatacctcattgcttacttatccatatcattttttcaccgtttttctttctttggctccatcgtaacttgagacattaggtaaaatcatttattttaaaactttgagcacctgtcatatgcaaaatattctgtaccctgaaggacacagaggagaataagacatagtctctaatctcagagtctcagagcggagggggattacactctgagtggcagatatgtaaaaaacagcagagggaatgaatgaaggtagggaaaataaagaattgtgaaatttaagctgagcacggaactagccaatttcattgttctaaattagaacctttgagttgctttcaaaatcccattgctgacatcgtggctgactttgagatcattccccaaggctgggtgcagaagagaagcctgaatggaggagcatgctcgaagtctcccagagatagattgggagaggacgtaaccctcggatctggatgggaatgagttttaataccatctaatcatgtcaatggaatgtttaaggcgcagtaaaattgtttgggatttattagtatgttctttcgtcattttaattaaatgaaaaatgttaattggacggaattgtcccagcactttcactctggtcatatgacattaaaacaaagaataccaatgaattattaaatggcagaaaagaaagggacatttccaagtcagagtccctcctgagttgcttcattatgtcttaaccacagtctctgcttaaagattctttgtttagcattctgcagcctcctaaccagaagctcttagaagggatagttcattaatttgaaaaatctcttccatttgtacctgtatctggtcccaggtgacagccattggctggcattcaccatccaggtataaagccttccatccaggtgtggtggctcacacctgtaatcccagcactttgggaggccaaggtgcgaggacaatctgaggtcaggagttcgagaccagcctggccaacatggtgcaaccccatctctactaaaagtacaaaaattagccgggcacggtggcacatgcctgtagtcccagctacttgggaggctgaggcaggagaatcacttgaaccccagaggcggaggttgcagtgagccgagatcacaccactacactccagcctgggtgacagatcgagactctgtctcaaaacaacaacaataaaaaaggcttcctaggggaaaagaagcacaagtggtgaaaaccatttcattttctgcttttctccagggcaatagaaacaatttcattcctctttctctgtgaaaaccttaatgtagttatgaaaattgtttaataaataaccatttttagatcatcttttgaaactgtaattagtaaatttttcatccaaaaagtaatagtagttttaaatctttaacaactcaggcaggaagatgaaaattttccctgaaattattgataataacaataatatcaatctctacttcatgttgaaggttttctacctaccaggcactgggctgaatgttttatatcactgaccaatttccatatttaaaataaaattaaatttgaccacataatgcacacatatggggtgaatgtgtattgttgggacagaattttcattaacaatacctacccttgccagatgagtttgatttcattttttaaaatgctggttatattaccattaaattgagtctatagatcagaatgaatggggcctaaagttttaaaaacactctctgtatgcattgtttcatgggaactccaccacggccatatgaaacactagtattgtcattttctaagaaaaaccgaggtttggaataggttagttacatgttcaagttcacacagtcagtaagtggcagagttctgaaagccaggagtgacggctgtggagttaaagaatccattctactaattcaatatatgaccatggacaagttatttaataccagtgcttaataagattactttgaggattaaatgaggtgatacacattaagtgattaacacagtctaaactggagcaaactctcactaaatgctagccattagtattcatccacttcatcttagtagaactctttaaagctagcctggggatattttgatttcacagcatttgtgaaagtgttgcttttttaaaaacgcctgaactttttctgtcttccctgaaacatacaaatcaatgatcaagggtcttttgaaccgagatagaagctggaatgaagctaaataaaaatatagactattaagattcctggaattgcgagtaagagaagtgttggagagagagctcctctgtcttaggagaaagggaatagggccactgcacagaccctgtttgtgaaaggcatagagggcacgagaatcttagtctcaagtggccccagatgagcaaacaaggacataccccttaaagagacctagctatctttatgtagagttatggacttgagagagaagaaatatatatatatcatttagagaatgggaacatcatgtttaaaaaaaaaaaaaaagaaacagctttagggtgggagaagccttcaccaagatagaaaacacagaagctagttttaaaaaggagacatacttgtttgtaaaagttttttgttaacctgcagatggtaccatgtacaatctaggtgacaaaagattaatagctatcacatacaaaaaaaattcttactaaataacaaaaaaatccagcggtatagatgttataaataggcagttgaccatctgtgaattcagatggtcattaagcatatgaaaaatgttctaactcactagtagtcaaggaaaaacaaagtaaaataacaaggtagcatcattaccgcagtcagacccaaaacctaaaaggacaagaacacctgttaacaccaactctttctggtgggaagagagtgctcatagactgctggtgagatacgaaattgttaaaagcttctccaaaagcagtctggccgcatctgtggatatgtgaaatagagatactccttgacccagcagttttaaccccggtgctctgccccattaaaatgaaggcatcagatttaaataagaatacatcatatatcgaaatatttttgttgcattgtttcttttggcaaaagaatgaaatggtaaatgcctttcatggagaatgacaaaatgtattttgagatatagtattcttatggcatattatacattccttaaaataattagtataccatttgacatcaacaaatttgcgtgcagtattgacaagcagaccatagagaagtgtgtataattagtaccctaatttggaatatgaagggcagcacacccctttgtgtgtgcacacatgcatgctctacatgtggctctttgggaacatgtggaaaagcacagaaaaatagatgccagcttcttaacatggattatagggtggtagagtggtggtggagatggaggagtggggtggcaagcaaaaagaacaaagcggggaaagactacattaaaaataaaaccagcgtgtgtgagatgctacctacatacgtgtacatgtgcctaaaggtattacaaagaaagatatacctgtgtctgtcgatgtgaaggggagtgtccttgatatttcgtgaaaaagcaatgtgacctatagggtaatatttcaatttaaaaaatgcacatacctgtatacccttgtttgtgtgaagagggggtgtggaaaggagcacttgtgctgttactgttggtattggagagtgcaggaggagaggtctagcttgtcctttatctgtagatcatttcctttgttatataataatatattttggccaagcacggtggctcatgcctgtaatcccggcactttgggaggccacggagggtggatcacctgcggtcaggagttcgagaccagcctggctaacatggtgaaaccccatctctactaaaaatacaaaatgagccagacatggtggcgcatgcctgtagtcccagctactcggatggctgaagcaggagaatcgcttgaacccaggaggtggaggttgcagtgagccaagattgcgccgttgcattgcagcctgggcaaaaagagcgaaactctgtctccaaaaaaagtaattattttttaatttgaaaaataaccacatactccatccccctctaatttagttgtatttactaccatttggcatatgcccgagaagattgttttaattatgtgtgttgttttggttttgacatagaacttgaattcctaaaaatttaaggtcaagattaccaagcgttgtgaattaagaaatttaccttttgttctggagtacctgttaataatgaattgcttttttcttgtccgttggaaaaataccaaatgttgtgaattaagaaatttaccttttgttctggaatacctgttaataatgaattgtttttattttgttcattgggaaaatactgaatgatagctgtttatgtttcacatgtagattatgataataacatatgtagccttcccaggtaggtagatttggtttagcaaatcataccgtaaacagaatcacatgaccaatgttagacttgggataagttatctgtaatgcaggtggtgaatgaaatatctgtaatacacaaagagctcctacgtagtgagaagataatttagtggacagatgatgtcaccactgacaatgagtgtttttatcttagtatgtttgtactttataaaaataacaatttaaaaaattcttaaaaactgacatgtaggtaagaagttgaaccttcatttctgagaagccttaattgtcctaggcattttccttagtgcagatctagctgccagcagaaggagaattgtacagctgtgtagcttcgacttgcaagatttgccccaggttacgcagctgggtggtagcaagagtttgcactgtagctctggtttccattccacggttcttttatagcctccatgaaagagatgacacctccccgacctcctgccaagtataaggatgtctcagtaaatatatgcatgcacacacacaagacccagaagagctcatgtgtgtctcatgaaaatcaggaggcaaacctggaaagcatgaaacgcctggcagccaattccagatgaagcttaattttgcctacctttgtgttatcatcttgttctttttttcagagggcctctatgagcaaacagtgttgagtgtctagcctagcaatccacagagcagatgcaggaggtgggctcagtgtccagcgggtagataaaggagatctgtgcagttaggtaaatttgtgaggctcagcttccaaataacatacaatttctttcttttttttttttaatggactcttggtctgttgcccaggtgggagtgcagtggcacagcctcagctcactgcaacctctgcctcctgggttcaagtgattctcctgcctcagcctcccgagtagctgggactgcaggcatgtgccaccacgctcagctaatttttgtatttttagtagagacggggtttcaccatgttggccaggctggtctcaaactcctgacctcaagtgatctgtctgcctcggcctcccaaagtgctgggattacaggcatgagccactgtgccgggcccaaataacaggtaatttctgccatccaaataacgtttaaagattttggagatcgtgatctcttgaccttcacaactttcagaacaagggggattcaagcacagcatttgttagtcaacacttctttaatgaatttggttctttggggtctgcctacaatgctgtgtagcagggaaataatggtgtgctagcaggcggagccgtttgcatcacatagatgaaaccactgtgagactcttcatttaaaaaccagttattgtgctgttgtctagatagtcgtaatgtcatctgtatggttgaaaatagaaccaggacatatcactgccagtccctggtacagggtgtgttctctctgtatgaagagaaaaaggaagcatagaatgcaagataatgaccctcagataaactccaccgagagagaatcactgagctgtgctttcagcctgaaaattctgattgctgctctcgtctgttcttatttctgcctggagtaacactgccatccaacaccattcgggaattctctcttctttttttcctggcagagagagtgaaatttttaaatatggaaacacatccttttcaacacaaattattttttttaactgaatctcctacctaatttttttttaaaatttctctactccctctgcttcttcaaataacactgcagaagatttagcattttcttgatgattagactgtggactattttttgtctgttcttgactttagagtcataaaatttttgttccccacgctattcttgaaacaatacaacccttttgttttcagaagtaatcacagagatccattctgtccagtacagttgccactagccacgtgtggcttttgggcccttgaaatctgggtagtacgactgagaaactgatttttttactttttttttttttttttttgacacggagtctcactctgtcacccaggctggagtgcagtgacgcaatctcagctcactgcaacctccgcttcccaggttcaagtgattctcctgcctcagcctcccaagtagttgggattacaggcacccaccactgcacctgctaatttttgtattttttagtagagacagggtttcaccatcttggccaggctggtctcgaactccagaccttgtgatccacccgcctcagcctcccaaagtgttgggattacaggcgtgagccatggcgcccggcctgattttttacttaattttaattaacatcagttgtaaaatgaagcagaaactgttcttccattaaaaacgactgttaagactagatttcatgttaactgtttagtagcttaattgagatatgctctaaaagtgtaggatacacactggatttcaaagacaatatggaaaaaagtataacatcattttttgtatgtatttatatgttgaaatgctaatattttggatatactgggttaaataaaataaattactaaaattagttttgattttttaaaatgtggctactacagaatttgagattatacatgaagctctcattgtatttctctggctggatttcttgaccctggcactgctgacgttgtaggtgggtaattctttgttgtggagcctgtcttgttcctggcatgatgtttagcagcatccttggtcgagctggggtgcctttctgtgccctgactggtggaatcctccagcctctgtctgaaacccttccttaagaggcctctctcatctcctatttttagaattcattgtgacacaggtctttatattagccaccctaatataagcattcacctgcagtaatagtccttctctcttgagtagcacagaataaactaaattctttacaaaagaggtaatgtctaataggtcgtatacattccaaagcttctgccacaaatacttaaactcccagttggtgctagccattgtcctaggcaacagggccacagcagtagacagaatatgagttctcatggagtttacatactgtttgggggtaggaggtcatcaacacatcagcaagagagtgtaccttatgtcacgtcaatcagtgctgtggagggggaagatgaagcaggctgaagtgcatagcagctgggggagccgggggagctgggggcaaggatgttattactcctgccatctcaggccctctctccgatattccaagaccccccttgtgcccactgttcgccacacccccagcttttgtttctctagctttgcacgtcccttagcactgcttgtaagagatgttttccagacacctttgcctcgcctcggatcagtcctcctgcgtggcggtcttccaatttcttttaaaagtggcacctgggccaggtgtggtggctcacacctgtaataccagcactgtgggaggctgaggtgggtggatcactgcatgtaaggagttcgagaccagcctggccaacatggtgaaaccctatctttactaaagataacaaaaattagccaggcatggtggcgggtacctgtagtcccagctactcgggaggctgaggcagaagaatcgtttgaacccgggaggtggaggttgcagtgagtcgagatcataccactgcactccagcctgggtaacagagtgtgactctctctcaaaaaaaaaaaacaacaaaaaaaaacaccaaaacaacagtgacacctgagcctgagtcccagctcaggttgccctcgggaacgctctgcctgctgccccattgtggcagtctgagattgcacctgtcttcttggcagcctcgtcatgctatgggcttagactgtggtcagcaactgagaggtcatttactaagccatggcttgtgtgctgcgtgggtgtctcgtgggccggtgtttctcttgctgcttcccatcagtttattgcacaaagtgtggtctcagtgaggcaaggctcttggctctgcgtgtcctacggaagaaaataacatgggctctgtaacggctgtttacctttcaaaaccccttcccctctgctttctggttatgttctgaataggtaatgaatgttgcagataatctgacttccttataaatgagtaatgattacattctcataaaatcacagaaagttttgtgcataaaaatgagtataggatattcccaggtgggactcttggctgacagtcctctgacaatttctaaactgaggataattacaaagctcgaatgtctctcatcttctgcctccaagatatttgttgttcttgcctttctgctattcttgcctttagttagaatggtagcacacggtctatacatttaatgtcagcgtttgttgggggtgaatgacagccctcattccctcttcacaagcttctttcaagctcataactctctaggtatgctacactttggatggacttttccaagacagtagaaggaaaatttggctgggcgcggtagctcacgcctgtaatcccagcactttgggaggccgaggcaggtagatcacctgaggtcaggagttcaagaccaacctggccaacatggtgaaaccccgtctctactaaaaatacaaaaaattagccgggcatggtggcaggcacctgaaatcccagctactcgggaggctgacacaggagaatcgcttgaacccgggaggcagggttgcagtgagctgagatcacaccactgcactccagcctcggcaacaagaacgaaagtccatctcaaaaaaaaaaaaaaaaaagaaaagaaaagaacaaaatagatggaaaatttaatttacatacatctctaaaactatattatacatgcaaagcatagataatggcagggattcttattcctggtatctattattcgtgtcacagagattgatagtcttggatagtggggaatgtgatttaaataccatctgtggccacttatccagcagattggttagatggcatatctgccaaatgagcagtgtgtgttcctaaaaaagaaaaagaaactagaagaattccaccatggattattgacttaaaaatgtaaattgtattaacttctataatccaaattaattagtttaatttagaggttcttcagaagataatttttaaaatatctaatattttagctacatggatgtatttcagaaggcaactggaaaaccttttattattttattattttttagtttttgagacagaatctcgctctgttgcccaggctggagtgcaatggcgtgacctcggctcactgcaacctccgcctcacgtgttcaagtgattctcctgtctcagcctcctgagtagctgggattacaggcgtgcactaccacacgtggctgatttttgtatttttagtggagatgggtttcactatgttgcccaggctggtcttaaactcctgagctccagtgatctgcccaccttggactcccaatgtgctgggattacaggtgtgaaccaccacacccggccagcaactggaaaactttcataatagtgttctggaaagttggcctgggcacctcttgcaccacccctcattcctgatggtgctgccattctgatctgtggaaatggggtggctccctgcccaccaggcctgactctgatgtgctgcttatccaagccacagaccttcagccccaggcagccgtcatcccttggctactttcgaacacctacagaggcttcgaagatgctctttctgtagaggttaatttgttttccagtctacccagaattgctaaattttgttagtgttagtctccttggggaagtactgatgtatgttacagggcctaaatactttttactttttatttatttttactttggcttttactttttaaaaatactttggcttttatgaaagttttctattttccatttcatttcttaaaaacctgtatctaagctttgtgatggcattttgtttacatcatttagcggctagagaatgataatgtattaagtatcagaacatggtaggtgtgccataaatccaacaacagggtcagatgtgccataacgtgaaagcatagtggatctctgaggtggtccaaacagctggatcccaaggactgggaggactgagttcagatcagagcaatgctgaagacagaggagcagttgattgctacagaatctttcaggggccaaagtaggtataggtgaacaggtgcaaccctagattagccctgcttagccctgtctgtgatgacacacatttttaaagggtctttctgtgcctgcagctctcatgtgaatgaaagcagttcttccctcctgctgacaatggcattagaatgaactttatgtttttcttttcttttttcagaacaagtttgccttctcctatgttttccagaaatgacttcagtatctggagcatcctcagaaaatgtattggaatggtaaattaatggttttgtcatatgatattaagcagatatgtttaatcgcatattctttagaaaggaacctaaaagtttgcattaaagtggtgcacgacaacgtttatgggaacgtacgagaatcataaattgtgaaaagtcgtaggtgacttttttctgacaagaatttgagctgctctaatggctttagtgtgcatttttgatgtaaaaaaaaaaacaaacagaaactgaaaatgccgtgtttctgttgacacagcacatttatattgccccatagacttacctagaaactctcagaaagaacagacaaccccacagtggagaacagaatttcacttacacttctgtgcacagagcaagttttcgtatttggaatttgtaagtgtggtatattaaatatttggaatatgtctctgcttagttatctgtgcaggtggatctgatgtggggggaggtagggagatggcagcatttcctttcatagaaatccttggattcccttgaaggtagtagtcaacaccaccaccctgatgtcagtcaggctaggattctgggtaaagttctcataactcttcctagtgtgaccttggaccaccgaacatgtaagtcatgtggcacaaaagaatctgcctggacattaccttttaacattttgcaattgaatgtgtaccctgggagcactccagaactttccctgtgctgggaagtacagtcacctcatgcacacttcattctgtggcttgaaatcctgtccgctgcagagatacccactttggcatttttcttttcattttctttcttttttcatttcatttcttttcatttttttgagacaggggctcattacccagactggagtgaagtggtgccctcatggctcactgtagcctcaacctccccagctcaatttatccgcccacctcagcctcctgagtagctgggaccacaggcgcgtcgtgccacacctggctaatttttttgtatttttagtagagaaggagtgttgctatgtttcccaggctggtctcgaactcctgggctcaagcagtcctcccacctcagccttccaaagtgttgggattacaggccttagccaccatgcctggcctctggcatttttccaatgtctctcttctctgagtggataatgaaatctgaaacttcctaaatgtaatttccaaggaacaaatttcataaacattaattttaaacaaatattttttgactcctgcatggagagtaattcatctaaatttcggagcctgataatgtgggatctaatccccgctctcccgcttcctggctgtgagaccccaagcaagttgcagttcctacgtgagtagcattccatccagtgtagaactagcatcataatttgtaccttagaggtaggtgtattgagcgataaataatttatgtaaaatgcctggaactattcctggtttaacgttgcgctcaataaataatagttcatattatcattaatcacagctgagaatgagacttgagctctaattttatttcaattctattaggattcaacaggacaaagcaaatgtatatagacagatgacagtaacacacgtttgtctctttggaactgaaaatttcaagataaaaattagtatttatttgtattctgcagagtcagtatttttcaaacccttagttaaatatgtttacctttatgatccagtatgcaaatatgtatatatgcatgtccttaaaattaaaatcagtttcacaaaagaatgctcatcattactacaaattgtattttctattatattaaagtaacattgattccagctcgttacatttattttacaacttgttaatgaaccagacccaccatttgaaaaacactgctctgagttactatagaatttgtactgtatctttgtaaggttatttggtcaaaggagtttgtatgaacatttcagatatggtttagtctttttggccactttagaatatacagttttctgtatttctgttgactgattcctttctcctgctctctcctgtttcactgggtgtcagctgtagtgttggtgttatgaatttgttcatgaaggtgactagcaatctgtctagtttacgtccaaatcgagactaaccattcttttaaaagataggagatgatgttatgttggattgcacctgctatgttctgaaagatactctgtttctctagaatgcggttttacttttatgtttaggcacataacttcttgtacaagtaaatgcttatgctgaatcataaataaaatacaacaaataaacatagagctgtttgggttgaaagggttccatagaatgttctgaatcatatctctagaacttactgattcaaagcatagagagagagcttcaggggaagtcgtgtttttggaaacttctttctgctgaggttcataggagacaaatgttctgaaagaacatttttattaatgtggattgaaaggagatcacctagcttttggaaatattgttctttgggcactgtctgctgtaggaccttctctcttaggcagcagacacaatcaaggtataagcactaagcgacagtaaagattaaaaatgaggagtcttgagagagaaatacaaatattaccactttttttttttttttttgagtcggagtctcactttgttgcccaggctggaatgcagtggtgcagtctcggctcactgcagtctccacctcccgggttcaagtgattctcctgcctcagcctcccgagtagctgggactacaggtgcatgccaccatgcccagctaattttttgtacttttagcagagatggggtttcaccatgttggccagactggtctcgaactcatgacctcagttgatccacccaccctggcttccaaaagtgctgggattacaggcatgagccaccgcgcccagcctgcatgtttctgattctatcacattaatccaaatacttcacttcgtgtcctttttgtgggggtgaaactgagttctagaagccatgtgtataccttcagctatcatctctcttcccttacctccatttacccagcttcttaatttgttaataagtcctaagagtggaagaggaaatttgatactgagccttagctcttcctgctctctgttgttgtgaggagcgtgccaggacagagtgcggggtgtaagcatcctgcgggtgacagccccacaattccacactcaaccagagtcctcatcccattttttccgtaacaattaatgccccagatttgtatgctatgatgatatcattttatggtgtaatgctattattattcaaaatatgtggcttttctaaattcacagtacatattcttatctgccagatatggtctaggtctcactctgtcttaggaaggaaaggaagaggttcttctccatgcatttgtcatcttggccccccgtgtctgcagccccatccccagccgggctcactctgccccatctcctccactcccatgcacctgcacgttgtactttacctttttccaaatagcatttagccactttgatttccaatactgatgacatccttcttttcttctcccagtctgttttgagcaggattatgttatcaaaatgtcagattatacaatgtgaaatgaatactttacctaactggaattcaaccctaaatctgtttgtggttgaagcttttaccaaacaaacaaatctccggctcctgagaactaatcctgacactgcttagtcatttgaagcctttgcttatttctttctgcttgtttcccctttgtcacaggactctttaatccgaaagcctcatgtcctgtgtgtaccctgtttccgtcctcctcttctcctccatccctttgctccagtggctttctcagcagggctcagccagaggttaggtcgttggtgttcatgctcagtgacttaggcaaccagccccaggacctcagcacaaaatttgaggaggtacttgagctcaaggccatgtgcgtgctgcccttgtgtgtgttcaaatgtcttggagtaatagaatagtcctggattattgcaagaggtgacaaaggtctggtacatcaggaataccgactacttaaagtgaaagaaaagtgttgtatcattcttttaaaggtagctagtggaatccacataccatcgagttttgattgccactgtcattctgttaaataaatacatgagcaagctattcttcagtcattgaaaagcttatacttctatgtctcctttaatttgtatttccattttatccttcctataggataactcagttaacttcgtgtcctttttgtaggggtgaaactgagttccagaagccatgtgcataccttcagctatcatctctcttccattagctccatttaccgagttaactcaattgttttaatctctgagggtcttttatcgattacttcatcatacttcattactgcagaaatatgtataaaaattaaaatttaaaaagctatattctataagactttagtactaaaggtttctttgcattgttataaatgttagtatttgattacaattgtaaacattataaaatttatgaaaatattaacaaaggtaaaatgttatgagtgaaaatttttttcaattggttttagatatctgagatgaatatcacttgctgctagaatgagacaggatcttcagtaacagttatgttcttgtttttgaatagatgccaggattgagagctttgctcatattaatagacagatgggagtaggagttttttgggtttttaaaaaaatgtccagtaatgtcattcagttctttgacccccttctccactagatgccaaaagtcagattatattacagaatttttgtgtgtgtgatttataagctaacaactcaattaggactcccttcagtgttactaaaaacacaactttgaaaaactctaacttgcacaaggttttgttacctttcattagtcattggcttcttggcctctgggaaatacaccagagaagcttttcccaagctctccgatctcaattcattgaactgtttttatcactcagttgtaccttgcaatactgagaaagggttgagaaaattggaataattttcactgaagtaaacctttgccagtatgtttttgataaaatgcttttatctcaccatgaatcttaagatgtttcccacaaactgaaggtttagctcattcattccagtacagaatgtctgctacatagccatagggccagacctcatgcccagacatatcactgggtcagagtaactgtcagaagggatgagatattatttctggaatcagataaacatgtgataccctatatgccaccatgacaacagtgctattcttgcattccaactctaagatagatgcggagctagataaggtttggagctttgccaaatctggcatgttataaataccaactagagcgacagaggatagaaggagcaagatagttaaacaaaatttggtatctctacccccacactctacagtggtctaagatcagaatgtttcaacctggggagaaatggcttgaagaccctatttctcatgtcgtgtctttctcttaactgaaacaggacgtcaaggagccctaatgtaagttaatggttcttgagtaaaagaggctttgctggtaacagtactgtatctaaacttccctctctggtgccctggaggttttcacatttccaggtataaatactatgccaagattcagcatggtaggagattaagtacttttttttttttttttttttttttttttcagtagcagagggcaactgtgaatggggaaatgagcaaagaggagcagcacggtccctccagtgcaggtgccatctgagacttgccagtttctaggaaaaaatgcatgtggaagtagattcccttaaagccacaaatgccgagtgatccagggcaagcttgcagcccatgcttccattgtttctccacattcctgtgtaggtgttgtccagcctttatgaagtcccctagcaggagggttcacgccacctctcagctctgaagctcttcagctcctaagcaggaagaataggaaaggaatatcattatgttcattagcattttccttagagcttttcttaccttcttctccacgttttctcattggttgcactgaggtgcccacactgtggttcagtaaacacatgatgaacacaccgccttttcccactccgtggcgccttcctttctgcctgcgtgtctttcactctggcccctgttgtcccccatggctggcctgtgaggactgaggacagaaggcacgagggcagcaggctctttttcaaactgcccatccagagcggccgcaggcagctatcccgggacaccttagagtaactcatctgcgtgtaatcggtggtattcagatggcaagaacctcatgcagtgataaactaatagatgagatgctaggcatcgtgtggagcggggggaactgagcagcatgagatggggaaagaaagacatttggccctgcgatgccctcaaatgtaagcacaatgaattttttcattatcggtagctgtgggaggtagaggtgtcatagaggaaacatccagtgccatcttcatcttgcaggaggcacggctctgtccaggggacagctgactgccgccagcccccggctgtcagtggagcgagccctggggacccaccagggcttaggtcacacacgcgggggagcaccctgcccacaagctgctgtctgggcaacagagcagacacacctagcctagcacttgagggaatttttctctctataacccaggtctaaagtagttgcacttctaccctgttacagtggttgactttacatttatacaatattttcaatttcagatgagctcaaacttggccttgctctcaggtttctctagtgctcaagtgaaaacacagccttctctccttcttctcagtttgtcagccaatgagcagttgcagttaggagtttctgcagtttcatcataggttgctattaatttgcatggataaatttaaactttgctattagctggaattgcttggcataaatgtttaacttttccagctgcctgaagctctcaatgatagaagtttctaggcagtgtttcttcctgaagcttggtcttcataatgtgaattgttgtttttcttgttattggaatatacacacatattggttgtatacattatctagagaatgcagcaccagacttcattggattggaagtgaaaatgatgtatcagtgaattttcaagaggtctaagagggaaggaaataaaatacaccttgtgtcagcgagtttttcactacctctctagggaactgtaggttttagcaattgaaataattgtaagattatttaaaaataattacagatgatggaggcaatacaattgcaagtaagttgctatattttaaaatagcatgttacactcttccaaggtccaggttgtttttatggcagtctgggttctgcctctccttccctctctgttatttgacccagccgtgtgcctttccattttcttgaatgcgttcattctgagttactaaaagaaatggaaagctgtttaaattattatagattacaacattttattaaaagaggcttgtagaattttagcagcttttcaaatgattaaaaaataaatctacttattgaattgatgataaacccacatcctttgtgccttggtctccagagttcacaccaccctctttgtcattggcttcaagcccctggaaagcccggtggctggtgttgaggagcccgtggctgtggacagctgcctgccccatcctgccgtgctgtgttttcccacggagctggatgtggagaaatggcagtgcacgcagcattgctttagagttgcaagattgcatccctaggccagtattcctgagaaaacaaagcagaatctctttgagggaagaactcctgtcttataaatactaaaatgtcatccctggtccatctattccttcctcaatgagtatgtgatagtccttaagagtgtttttcaggaaaaacaaattcaaaatcagacttacaggtaaagctcttcctttctttaatgaataaacttttaaagtttctttatgatcaatcccaccctgctgttgtgtacaataaagggaaatggagaaaacaggaagggagctgagccagaaatggcatagcctgtgtcacctactggctgtcactggttgccactgcagtgaacccctgccatcctggtgtttggatccctcctggcccaggcttcaggaagggcagcaccctgtccctcactgcctcaccttttaagcccaggtccctatgccatgctgcttctgtagcttctctgcagctcagctgcccctgggtcagggcaaagtatcccagccattgagtcgtacttgctttcctgcaaccttggaggacttggagatcttgtctgcattattaataacagtgataatagctagcatctattgctcacttaacagatgcctggcactattctgagtgctttatatgaatgaattcatctcatctttacaagcctggtgaggtatgtaatgaaattgtccccactatggggagaggttagggacttgctggctgccacgcaagcagtaggtagtacagctaggatttgaatgcaggaagtttgatctcagagctcatttttttccccttggttttacaattatggcaaaatatatataacaaaaaaggcaccaccttcaccatttttaagtataaagttcagtggcatcagtacactcgcactgctgtgctaccatcaccactgtccatccacagaactctcttcagcttgcaaaactgaaaccgtcccctcgaaacaccaacttccctacttccccttcatcagcccggcaaccaccattctactctctgttcagagccctttcttatttatttatctgtagcaaccttacccaagaagtaggaacctcttcttttaatttcctgtctctggaacttaggagtggactaatctgaatgtattttgttgctcttctttttccattgtattacttctacgccaatttttccttatccattttatgactagcatcagtgcaaatgtgtgtattgtaaggtggaccagctgctgcggtatgaggctgttagtttccctggcctttccttttgcctgtctgaattttttttttttttttttttttttttttttgagacagagtcttgttctgtcgcccaggctggaatgcagtggcgtgatcttggctcactgcaacctctgcctcccaggttcaagcaatcctcctgcctcagcctcccgagtagctaggattacaagcacacaccaccatgcccagctaatttttgtatttttagtagagacagggtttcaccatgttggccaggctggtctcgaactcctgacctcgtgatccacccaccttgtcttcccaaagtgctgggattacaggcctgagccaccttaggttttaaagtaacatctcattttacccttgattagaagagcagtacatgttcattttaggaaatctggaaaatacagaaaagcagatggaaggttattaggattccatatgcccccaactcctagagatacccactattaactttttgatgttactatcttctagcatttgtttctatgtttataaaaacatatttaacaagattagaatatttttgaacatgttgctttataacctgtttttttcagattttaaggtgaatatttatttagaatgaggaaaaatcatcacaagttttgaagtgtaaatatcactattaccacagtaacattgtttgtgtctagtaccacaaacaatatacatccaaaatcattacaaactctttaattgccttaacattcttctgtactttttttgctactcttttttggctttacattctcttttatcacatgtgactgcgactatgatattttctgtagcaggactagaaagataatttgatctttcctaaagtatgattcatcaaaattcattttcttaaaattttattttattttttaagacagggtcttgctgtgtcacccaggctggaatgcagtggcacgaacatgattcactatagccttgatctcctgagctcaagcaagccttctgcctcggcctcccaagaagctgggactacagatgcacgcccccacacttagctagttttctaaattttttgtagagatactcactttgctgcccaggcgggtctcgaattcctgggctcaagtgatcctcgtgccttggtccccaaagtggtgagattacacatgtgagccaccatgcttggcctaattttatttttcaaaagacttttattttataaagtaattttcagtttacagcaaaattgagaggaaggtgcagagagttcccacacactccctggccccacacgtgcatagcctccctattgtcagcatccctcaccagggcggcccatttgttacaatcggtgaacctggatgggtgcagtggctcatgcctgtaatctcagcactttgggaggccgaggtgggcggatcacgaggtcaggagttcaagaccagccttgccaacgtggtgaaacctcgtctctactaaagatacaaaaaattagctgggcgtggtagcacgtgcctgtagtcccagctccttgggaggctgaggcaggagaattgctcgaacccaggaggcggaggttgcagtgagccgccattgcactccagcctgggccacagggcgagactcagtctcaaaaaaaaaaaaaaaaagaaaaaagaattggtgaacctgcgatacatcatcaccccaagttcatagtttatactagggctcactcttggtgttccgtgttcatgtaatgacatgtatccaacattgtagtaccacaccgagtgttttcacgccttaaaaatcccctttgctctgtcttttcattcctcccccttaccctgggcaaccactgacctttttactgtctccatagtttcgtcttatccagaatgtcatacagttggaatcatatcgactttttttcccttagtaataggcatctaagtttcctccatgtctttccatgacttgatagctcatttctttttagcactgaataatattccaaaagtaaccaattttttttactcagcatttagctgtgttaaccgcatgcattattaagcaagacctttgtcttcaaagagctctccattgaaggaggcgggaagtgcagtgtgtgacaaatgcctgaaaagggaaagctcacagggcagtgagaatgcagggtgggggcaatgagaatgcagggtgggggcagtgagaatgcagggtgcatctggggcagggcacacctgcagtgttcccctctctctgtgaggtgatgggggcatgtagatggggtataagatagtgtccgtttcccaaggaattgtattactatacatgtagcaagataagctggttaccacccatactataacagtaggtaatagaatctaatctctgatcaaattctcggttgtgagcagtacattttggtactctagcagttggaaagagtaggaaatcagtgagtgctacaaaacttgaggaggaaagacttgaactgggccttaaaatctgggtaggacatagaggaataaagggaagagagagcagggcattccaggttaagtggttgtaatggggcttttactgcagtacctggcacatagtaggtgttcagttaaatacgtgtttaatgaaagcataaacatgacagaaggaacaaattgggaataatacacctcttttagcatcagagatgttgactgtcatgcagcattggtggcagtataaattggttaaggtgttttggaaagcattcagcttggtagtatctaaaaaaataaattaattaattaaatgagcatgctcttgacccagaaactccactttagagaaatctacttgaaatccctatttgcctatattcttaaagatatatgattaaatagttcatggtatgtccatatatggactttgttttaaatttaacaagcacacatatagcattaccaatgtgcccagaattatgctttatgatagatactattatattagtacttagtacttattgatgagggaactggcacagggtttaacttggtcaaagctacacggctagtaaaggtgaacccagcagtggaactcaatctggttcagtggtctttagcattctactatcctgtgattagaaagaactggaaagactcgatgtatgtactttacatgtgtataacaccccgctaaaagatccccaaaacacagtgaaggtgtaatgagtcaatacacagagctgacatcatgcattaaaacaaacaaatctgggctgggcacggtggctcacgcctgtaatcccagcactttgggaggctgaggcgggtggatcacctgaggtcaggagttcaagaccagcctggccaacatggtgaaaccccgtctctactaaaaataaaaaaaaaattagccaggcatggtgctgcacgcctgtagttccagctactcaggaggctgaggcatgagaatcgcttgaacctgggaagtggaggtttcagtgagccgagatcgcgcctttgcactccagcctgggcgacaagagcaaaactccgcctcaaaaaaaaaaaaaagaaaaagaaaaagaaaaatctctctgtgtgtgaatataaatcaggagtatgtatgcatatgtgtgtaaatacataggtatgtatcccaaagtgttgctgttgttttgtctctgggaagaggagtgggaaagggaagtaaagagacattttcatgtttttatttcaatattattatattttatactaagacagttatgtatttcccagttagtttttttaatagaaaaaaacaataacgatagttttattgaaaaatagaaggccaggtgccatggctcacacctgtaatcgcagccttttgggaggctgaggtgggaggatcggatcccttgaggtcaggagttcgagaccagcctgaccaacatggtgaaaccctgtctctactaaaaaaatacaaaaattatccaggtctggtggtgcacatctgtaatcccagctactccggaggctgaggcaggagaattgcgtgaacctgggagccagaggttacagtgagccaagattgtgccactgtactccagcctgggtgacagagtgagactccatctcaaaaaaaaaaagaaaaatagaagaaagagagcctgggacacttcaattaagacaagccttagcagtcacagtttttctgacttgtccccagtagtgaatctctgggtttaatgagctcttagagtgtatgtagttgagccttttatttctctatatacattcctgttttccctcatctccccagtgatgcagcagtaaatttaccatttcttttcatcaggctgagctgttacatgtctgttttctgcagtattttatggtaatgaatgagcttattttctttgattgcgctccagtttcagttctttgcaggttgcattatttttaattgaaaatctcagtgggaatatggatatttagggggaaaagtcagaggtaagtcaggtggcattcagcctgactacgcacctcaggactgttcacccgcccacgcaaccagccagcaggcctcatgaaagacctgattcccaagggaatggtcgatagaagtttgggaagattgtcagaatattccggtaaataccaagataagtgtgttacttaatgaattttgtaaaggtctcaccagaatattgcttgctggtggcacatggtaaacagaattgaacagttgcagttgaggtcagaaacttcctaattgttaaattatttttgagagtcgcttgtgatggaggcattctggcagacagaatttaaaatctattctgtaaaatatgcagtagcctgctagtaccctagaccataatttatactagattggtgtgctcagataagctcggtgttgtcatatcatttcatttcatttcattgtcatttcaaaagctgtgaaatttcttttggaaaattactcacaaaaatggtatgtgtggttaatccttagcccgttgttacaagacaaatgtagacatattgaagttttaacacatatatttgaacagacagcaattcatgacttgaacagccccagacctgaagctgttccacactccactgagaaggcagcacactccactgagaaggcaggaaggggagcttttacttttataaggtgttctttgagggagccagacaaagaaagtgcattcatttggggaaagtgtaacattcctagatagaggttagtttggcagtttctgattggtgaggcttaagttaacaggggagagggtttcagcggtttgcttatgaaggaactcaaggcactggagccatctccagtaattaatggccctgcagttaattattttaacaccactatgaagaattttgttctgtctccattgcctttgtctcccatttcctaattctgatgtaaggcagactgatgaagagtcatctgctcatgctcaccagcaggtagtgagctccctggagccaaggagaatgtttgggcagtctttgtatttcctccttcaaggcctagaaggatatactccatggtattaggtgctctggaaagaatttgtgaaattgaaccaatattgatgaaatttcatgggttgctagtttctgttctgtcctttccaggaggatgttatgtaaagataacaataggtttgtttgttatgtatatgggacataacactttcaattttctggttaaataggaactatccaagatcacgatgccagttatatttaatgagcctctgagcttcctacagcgcctaactgaatacatggagcatacttacctcatccacaaggccagttcactctctgatcctgtggaaaggatgcaggtatgagccaagggaggaaaaggtctaactcttagagaccttgctaccaacccagccccgaacacacacacgttcacacaattagtgttaaattcaatgtgaggttgggcaattttatcaaagctcagtccgcatgtctggactgtcctctggttagggtgacaccattgtgcagagaccgatgagtattgcaggagaagcaggaggtggcccattaagcaaacctagatattagtgggttttgctaaatccttttttgtgtgtgtgtgagacagagtctcgctctgtcgcccaggctggagtgcagtggtgcaatctcggctcacggcaagctccgcctcccaggttcccgccattctcctgcctcagcctcccaagtagctgggactacaggcacccgccactatgcctggctaattttttgtatttttttagtagagacgggttttcacctgtgttagccaggatggtctcgatctcctgacctcgtgatccacccgcctgggcctcccaaagtgctgggattacaggcatgagccaccgtgcccggctggcttttgctaaatctttagttgagaaagtagcgttgtgttaggggaagaattcaacctttcttctttcagactttctcggggtgtttccaagaagaagttaacacatacacacacacacacacacacacaaaatagaaaaatatgtttgtgcttacttgtgtatataaatatatatacattgctatatgttaaaagacggcaaggaattgcactttttaatgttttagatggaagattgtatatgttgtacatggatggactagttagaggtagagtatagtggacacattgttctccttcaacaaagcaatagcattctaaactgagtctttctgtcctttcatctatataagtcagcattttccaacctcagtggacttaacaccaattaagttgtggagttttatatctctttccccaatcctggagtgtcatacttttaaaaatttttaaatgaattaaaagtaactttggacttgagggttttttaaaagtccttgagagaatttgtagcactgttagagtgtgatgaaaaccatggttgggaataacactgtaggaagcaactgaaagtaattttcattctgaatatccaagtttccatgtcccactgctagagccatattaaaactccaaagtaatgaaactcctcaaaataattctgtaaattactgtcttcagcaaaatttcagttcctaaaagaatgcggagcgagctcggctatttttgacttgttctcatgctctgtcccacagtgtgtagctgcgtttgctgtatctgctgttgcttctcagtgggaacggactggaaaacctttcaacccactgctgggagagacttatgaattagtgcggtgaggcctttcacttgcatgctttatacagcgttgcagatgaagaggagaaatacatacatattggtcatcacgaataacaattatataggactggagcaagttaacaattttgatgtttgtttctaggatagctattattttagagactgtcaaaaatactgaaacatatataaaaggtaccattataagaaataattgcaaagatttttgtattcctgatcacatgggattaatcaccctccttttttccttatgtagatcatgagacatgatcgagttttgttttgttttttttttttactttaagttttagggtacatgtgcacaatgtgcaggttagttacatatctatacatgtgccatgttggtgtgctgcacccattaactcgtcatttaacctcaggtatatctcctaaaaataatcatttaaagtttattagctgggttgtggtggcacaggcctatagtcccagctacttgagaggctgaggcagcaggatctcttgagcccaggagctctgggctgtagtgcactatgctggccaggtgtctgcactaagtttggcatgaatatggtgacctcccaggagagggaggtcagaaatggacgcaggtcaaaactcctgtgctggtcagtggtgggcttgcacccatcattagccactgcgctccagcctgggcaacagtgaggccctcttataaaaatatctctttattaaaaaatataaataaaatatattagcataagtatatattgtttgcatgaagccaatgactgcatctgtaagtgcagttctgtttgcttgagctagcctgtgtcttgtttatatatgattaagggactttatttggctttagtttttctatgcgttcctcctcttctctgcacaagttttgatctcatttattccctagatgtttgaaagtggacacactagatttctctaatgtaaaaggaatgatgtgttttaaatttacatgactaatattttttcatgcaaatcattcaaattcatctgggtgttctttgttttaatttgttcaagtagctagcattacaacattggatttggtggtttgggttgcatttgtataatttctcatatatgaagttgtttcattgcaatgagaataaagaattgttggccgggcatggtggctcatgcctgtaatcccagcactttgggaggctgaggtgggttgatcacgaggtcaggagttcgaaaccaacctggccaacatgatgaaacccccgtctctactaaaaatacaaaaattagccaggtgtggtggtgcatgcctgtaatcccaattagtcgagaggctgagggaggagaagtgcttgaacctgggaggcaggggttgcagtgagccaagatcacgccactgctccagcctgagcgacagagcaagattttgtctcaacaacaacaacaaaagaattgtttactttgaaagggcaattatgtacatgtttaatgatagagttaattataatgttgcttttttttttctttttttttttttttaaatcttaagagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgagtgagttctgatcaagccattacactcttttcatgtagacctgcctgtaagtgtagacatgcacactcagctgaccttactgttcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggtgtttggatctattttaagatcgatggagttaattgcttcatgacagttcttatgaaacatgcttttttatatccttgtgccaatgttttgtttacagatctttcaaaatgaattcactctgagaaataatgaaatgacaattgtgtggcacatgttaggcgttagataaattgggagttctcttcttttgtaagattagctttaaatccacaattaattccagttaggagagaataagcatacgataccctatctctttaacactgattacaactagataccccggacagaagacaaagcaacaacccaaagactctgaaaagtagatagtagcaggcagactggggagagaaatcaaaacctgaacaccaatatggcagtgagtttactggttttatatatttctcccaaatctggctcagaatcagagcagcaaattgcagaactggggattagaggccgaccgaaaaagttctgagagtaattctttctttctaattaaaggacctagaaagatacccttgcaggaagtagagaataggggaaatcctgttttaattttgtctcacagccttgccccaaagcaagcactagggtctgtagctacactcctgctgcgatggtggctgtggcaatcacacacgtacctcagagtccttctctttggccagagaaactgagtaaaggaacccctggggttcaaagagtgtgagagaattcctgttacttgtttttctttcttttcttttacccctttgccccagaagaagacctagttgtgggagatacaagacagagcagagaggctcaaaccccagcttgccagccggaggggagagaaagcgccccctggtgtctaagagtgttggggaaaccacaaagaggagggagctcaagaaaggggtcccctgaagctgcattatgagttcctacgctcatccctacacacatgcattgaaatgacccagaagggtacacaagggcctcaggatctgaaatgctgtgtggcctgagagccaggtccctggatggctattgaggggtggatctgagcagcactacagaggctttgaaaattaaactgacactggaatgaaagctcacaggaggagagtcaggacttctggcctgaaactctgttaattgcctactaaaaaaaatttttatcagtattctccagaagaggttaagaggacagagtcttacaatattcaggtgtgcagaatacaatccaaaatcattcagcataccaagcaacaggaaaatctcaacaaactaaaatagaaaaagacattttagccaaaaaaaaaaaatagaagtatttttggaaattttagtactaaaaatatagtaatagaatataataactgggataggctcaatggcagaatgcaaatgtcaaaatatgtaaaggatgtgtatgttgaaaactacaagatactgttgaaagtaatcaagaattacctcagtaatgcagagacacactgtctcgatatatttggaagcctcaattatagttaagatgtcagttcacccctcactgatctataagcagtctgtatgagcacagtccaaatcaaaatcccaagatgatttttaatagatacagagaagttgattctaacttacgaattctaagtttgtatggaaaggcaaatgacagaacagccaaaataattttgaaaaggaagaacagaattgatggactcccactacccaattttaaggcttaatgctaaagctgttgtaatcaagacagtgtggtggtggccaaactatagacaaagtatagattaatgcgacggggaagggaatccagaaattgacccgcagaaatgtggtcagttgatttttgacaaagctgcaaaggcaatacagctaagaagaatagtcctttccacagacaaccatctgtgctatggagacagttggacatctatatgttaaaaaatgaacctcaaactagacctcacgccttttacaaaaatcagctcaaaatagatcatttacgtaaaatgtaaaactaagggttttggaagaaaacataggagaaactcttacaactttggattaggcaaagaactcttatggatatgataccaaaattataacccataaaagacaaaaagtgataaattagatgttattaaattaaaaaccttatatcgaaagatactgttcagagaatgaaaagataaactatagaatagtaaaaattatttgcaaatcatatagccaacaaaggacttgtagccacaatatataaagaattcttaaaactcaacagtaagaaatgataaggtcaggcgcagtgactcatgcctgtaatcccagcactttgggaggctgaagtgggaggatcacttgagcccaggagttagagaccagcctgggcaacatagtgggatccttgtctctagtaaaagattttaaaaatagccaggtttggtgacatgcacctatagtcccagttgcttgggaggctcaggtgggaggatctctcaagcccaggagttcgaggctgcagtgagccatgattgcgccattgtattccagcctgggcaacagagtgaaaccctgtctctggaacaacaacaacaaaaaagaacaataaaaaatgaatagatacttcatatatatatatatatgtgtatatatatatatatatatatatatatacatacacatggcaaataagcacatgaagtcagctgattgcagtggctcacacctataattccagttacttaggaggctgaggcaggaggattgcttgaggccaagagttcaagaccagcctaggcaacatagtgaaaatccgtctctaaaaaaataaagtaaaataaatttagccaggcatggggacacatgcctgtagtcatagctactagggaagctaaggcaggagggtcacttgagccgaggagttcgaggctgcagtgagctatgatccaccactgcactccatcctaggtagtagaataagacctcatctctaaaaaaaaataaataaaaatttaaaaagatgttcaacagcatcagttattagagaactgcagagttaaaaccacaatgagctatcctatttatacctattacaatttatatttatacctattacaatgtctaaaatcaaaataattgtaaacattgacaataccaagtgctgacaaggatgtggaggagctagaaatctcatacaggttgagtatccgttttttaaaatataccaaaagtgttttggattttgaatattttcagattttgtaatatttgcaatatacctactggtttagcatctcaaatccaaaattccaaaatctgaaatactccagtgaccatttcctttgagtgtcatgtcagtgctcaaaaagtttcagactttggagcatttcagatgtccaagttttgaatttggaatgctcaacctgtgtattgttggtgttggaatgtaaaatggtagagccaccctggagaacagtttggcagtttctcatccagttaaccttatgtttaccacatgactcagcaatatcacacctaggtatttgccttagagaaatggaaacttacgttcatcccaaaacctgtatacaaatgtttacagtagcattattcatcatcaccaaaaactgaaaacagcccacatgcccttcagtgggtgaatggtcacacaaactgtggcatatccatacagcggaatcctactcagcacaaagactgatacgtagaacaacacagatgaatttcaggtgcattatacaaattgaagatgctaatctcaaaaggtaatctacatttatatgacgtctggaaaaggaaaaactattgcaatggagaacagatcagttgttggggataaggagtgagttggagatccagggattaggagtggagaaaggtttgactaccaggagaagtatgaacaaagtgtttgtgggtggaggagttgtttaggatcctgattgtgttggtggtggttacacagatctgtgcaagcataaacctgagtaccaacaaaaatgaattttaccttatgtaaattaaaagacacatatctaaggacaaatatatgaaggtgcagcggtggctcacgcctgtaatcccagcactttgggaggccaaggcgggtggatcacctgaggtcaggagttcgagaccagcctggccaatatggcaaaaacccatctctactaaaaatacaaaaattagccgggcatggtggcacgtgcctgtagtcccagctcctcgggaggctgaggcccgagaatcacttgaacccgggaggtgaaggttgcaatgagccgagatcacgccactgcattccagcctgggtgacacagcgagactctgtctcaaaaaaaataaaaagtaaaataaaactttttttttaacttttattttaggtttgggggtacatgtgcaggtttgttctgttggtaaactgttgtcatgcgggtttgtttcgtcacccaggtactaagcgtagtacccaatacttattttttctgatcctctccctcctccaaacctccatcctgaggtaggccccagtgtctattcatcccttctttgtgttcatgagttcacatcattcagctcccacttataaatgagaacatgtggtatttggttttctgttcctgcgttagtttgctaagaataatggactccagctcctccatattcccagaaaagacatgatcttgttcttttttatggcttcatagtattccatggtgtatgtgtgccacgtttgctttatccaatctatcattgatgggcatttaggttgattccatgtctttgctgttgtgaacagtgctgcagtgaacattcccgtgcatgtatctttatggtagaatgatttctattcctctggatatataggattataaaatcagagtttattcacatagatgagtttttttcctttggtgagctggagggtactttctctagaaagtgctaaatagactttttattttgtgtctctactttagctttttttaatgtttcatgacacttttgaatgcttaaaatgattatgtacgtagtttatttggagtttggtggaagtatagaattttttcttaagctgttactcccttttaagaaacaagaatgggcaaatgatcccaattttatggtgagttaacatcaatagaatttttaaaggcttagaacgtagttatctcaagcagcctggtttgttattctgagtaatggcatttggaacaagtgtactttttaaacaaagtgatacctctcacttatgcttctgggtttggttttgttttttagacacaatgaggcatatacatggacaaatcccacctgctgtgtgcataatatcattgtgggtaaactgtggatcgaacagtatggcaatgtggaaattataaaccacaagtaaggcaccttgggtacttcgtccattccttcagttttcatcaagcagttttagtggacatcagtttttttgttttgtttgtttttaaagaaaagctctagaacaggctgatgaaaatttaagaatcatgcaatatatctgggcgcggtggctcacgcctgtaatcctagcactttgggaggccgaggcgggtggatcacgaggtcaggagttcgagaccagcctggccaagatggtgaaaccccgtctctactaaaaatacaaaaattagccgggcacggtggcgggtgcctgtaatcccagctactcaggaggctgaggcaggagaattgcttgaacccaggaggcggaggttgcagtgagccgagatagcgccactgcactttagcctggatgacagagcaagactccatctcaaaaaaaaaaaaaaaggatcaggcaatataactaactcttgaatgactagaagcccatttatttaataaagagggttcattaaagtctctgattaaggaagactgggtgaacccagcttacccagcttctgtgaaccttaattccaatctcagctcattttgcttcctttgtttagtgggggccagggagacagggcataggagttactagaaagagctgggctcccattctactttgtgaccttaggcaagtcatgtattctttctgcccctcacataccttttctttatggtgggaagattaccaattgaggattaatcattatcactttagtatggagcctggcacacagagaaaatccataaacagtagctgctgctagaaaagtgatcacagttatttttctctactgctgctttgctaataaatgataatctgaacttagtattttctttataggactggggacaaatgtgtgttgaattttaagccatgtggcctttttggtaaggaattacacaaagttgaaggctacattcaagataaaaggtaaaatttctcttttaaatgttgaatagtatagattttgttcactagataaaatgtcggtattaaaatacattgtcggctgggcacagtggctcacacctataatcccagcactttgggaggctgaggtgggcagatcacgaggtcaggttcaagaccagcctggccaacatagtaaaaccccatctctactaaaaatacaaaaaaattagccaggcatggtggtggacacctgtaatcccagccattgggaggctgaggcaggagaattgcttgaacctgggaggcggaggttgcagtgagccgagatcgcaccaccacactccagcccaggtgacagcgagactccatctaaaaaaaaaaaaacaaaaaaaattgccataacctaggaaacaagcattctaataagttgaagaatctttcttctacaaggaagtttatttcattaaagaacctgatttggttgagcacagtggctcacgcctgtattcccagcactttgggaggctgagtggggaggattgcttgcagccagttcgagaccagcctggataacatagtgagatcctgtctctacaaaaaaacttctttttaattaggcaggcgtagtggcgcatgcctgtgtacccagttactctggaggctgaggtgggaggaacccttgagcccaggaggttgaggctacagtgagccatgattatacctctgtactccagcctgagtaacagagtgagactctgtgagtcgtacacacctttatagtaatattcaattgcagcaaaacagtctatggcgatgccaccctgaacacgcctgatctcatctgctcttggaagctaagcagggtcaggcctggttagtactcggatgggagaccgcctgggaataccaggtgctgtcggctttaaaaaaacaaacactggtttgttaactaaacatcagtttttcttgacagcaaaaagaagctctgtgccctctatgggaagtggactgaatgtttatacagtgttgaccctgccacgtttgacgcttacaaaaaaaatgataagaaaaatacagaagagaagaagaacagcaaacaggtgaacatcctgtaaggtggtatcgaaggaataactggattcttcaatgtgtactaatccttttggaggtggcctgttctagggtcacagtttaactttcttcttccttgttgctaatgcatgtcacttttctctttttaatgatcagacatttgctttaacaagtactcggcatagccttgtataggatgtggacacctatcagttttttaactgtggagcagttatatgtggagctttgctttaattcacatagctttggaatgttggagttcatcttaatgaaacattttcttttcctcctgtttatgtgcattgaaagttgaaattgttgaagatttaaaatttcctccaaaagtctctctgacattttcatgcttatcatcagttttgttgccttgttccttatcgtgaaattaccgaagttaagatggtcgtagttaaaggagtcatccctgggctgctttcctcttactaaactttcttctttgtgggatagttaaatcccagtaggggaggcacatacgtggcttcttgtcgcgtggtcccaaacaggctccagtggttagcaaactcctgccccttccctcctggcataaatgctcgaggactgcacctctttggacaggaaatatttgaggacggattcctttccagtaaccaagacaatggttccgagcacaaactctgggttagaatcttagccccaccggtgatgagcagtacaagccgagatttctcatctctctgcctcactgcctccatttgtaacacgggcactataatagcacctacttgttaaatgagttaacaaacataatgggctcagaatagtatctgctcatagtaaagactgataaagtcatttctgccaaaagtacttcctcggactggcatcttgagcatcatctgcgagctcattagaaatgcaggcggcccagcttcacctcagacctaccgaagaccagtctctggggctctttagcgtttcttatgcatgtgaaagttcaggaagccctaagatccctcaaaagcagaaggtgtatttatgagtgactttctttgtagacggagttagccttgctcccaaagtgaaaagaggtttattaaacggccggagcattctgctttcctgtggctgggactgtttctttctttctttgtttccctttagctgtgtgtgcacagttctgcttccctctttatatcccatgttcctgcccacgggaactgtgcaccaactgtgctctacagccagcaggaaactgatggggctgagaagggcatgtccaggattctgggacccccggcacaaactccttggcggcagctcctgctaataggaggcaccttgacaaagacgatctccccaacatgcttgccttccaacctcttcacagagtgcggatggctgagaatgttgctgaaattccagagaacattccttatattccctaaattcccagtcagtctgtgaaaagtatttttttttcccattggagagagcaggtattctcacacatccactgcttttctggtctctctcattcctgtgttcctgtcatctgcctaccatggatttctgacgttcctgaacacagacgctgcgggaagtttgtgtcattagcgttgtcacctctgtgctattttgtaaactgtatattcactgaatgtgtctcagccagtagttctagatttgttcactgtgtgatgctgggactatgacttacccttccaaagccttcattccatatgtctaaaaagcggtcgtgacctctcctcgagggattgctgcataaagactgcatacatacagcactagcatagctgggccgcggagaggggagcccgaggaaatgctggctccctgtatttcatctaatgaaaaattctcttttcatcagatgcattcaggatccctcctggttttgtggcatcgatacatttagttgacttccccaagaatgtaaccttttgttgttctcagattgttcctctctggtgtgtgagctccacgaaagtcaggtagtgatggtgcttctctagcaccccagttgctgggcctccagtagttccttagtagatactcaaatgatgctttgggaggctgaggcaggaggattgcttgaacccaggagtttgaggttacagtgagctgtgattgcaccactgtacttcagcctgggcaacagagcaagaccctatctcaaaaatattaaaaataaatactcaaatgaattattttgtctttaagaaggaaacagccttaaaaacataaaaccctataggaacgagtgatgatgataatgacttaaatgtggataacactaagtggcacaacacacgaagcttgtgagactcttagcacccactcgggcattcagcaggtatccgttggcttcccacactgtgttcaaagtaaggatataagaattagaaagtcacagtgtccctgccctcatgtagtttacattctagtggtgtgcaataaacgatgatttacaatttgtaagtgtatatgtattttcctaaggacagggatatgttctaagaaatcattaggtgatttcatcattgcgcgaacctcatacagtgtacttacacaaactaagatcgtgtatgtatttttatgtatatctcttttttcatgtggaaagccaaaagtcctaacaccgttactgagtatcggtcatttcccttacttgatccacagtgccaatatcaaatgccatatagcagatttctatacatgctccgctataaccttaggggactgccatcatatttacagtctgttgttgactgaaaatgtcattatgtggtgcttgactgtatcttaaaactttctacttaaattttgttcattgattggtttttctagatgagcacctctgaggagttggatgaaatgccagtgccggattctgaaagtgtattcattatccctggaagcgttcttctatggcgaatagccccacggcctccaaattctgcccaggtgagactgggcttgctggctgtggcctcactgtctgtgtttagcattgtggcgctctttcctggcacgtgtagggtcggcccaggcagcatggagacaggcaggttggcatcctgagcccccactggctcccgggtgctcccttcttgcctgagctcagcgcgtcgtaagtgcatcatgctgtccatccctctggcatctggctgggaggatgtgttgggttaggacttcactggggcttctttagtagctacttagcggtaaaactggtccttattaaatataagctggtgcagcctagtcagtaccagccctccagacccagcaaggaatgattttaatgaagataaaagaatgttgatttttgcttagagttctatttaaagttgatcatgatagaggatatttattctgcaaagcctgctttgagatttttttgagagatacccacagatggtgcagattttggtgaaaacatttagatacgtgtgatctgagaaagactgaccattgttaccatgaaagggagggggtcattgtcaagtcaaccctcttctactttcaggatgtttcattttgcattatgccttggcatattttaatttcttccttttgcttcttttcagatgtataattttactagttttgcaatggttttgaatgaagtagacaaagacatggagagtgtgattcccaagacagactgcaggttacggcctgacatcagagccatggaaaatggagagataggtaactagcatccgccaaagccaccagtgaagactcatttctcgggggatgatgctttgtttattcctggtgattgttagcatcattggggtactagcgtttttagtctctcttagagattaagtttgagttaacattcaatttaaattcagtaacttttattttaaatttggaaatctgcgcagaccttattagctcatattattgtggtaatactcccctgagaatttaatatactggagatggccagaggcatattccgactaataaagtcactgtctacttcagaatttacatagcaccttgtcagcctcagaggagagtgtggcctccccttggttaagtataacttacatgtttttgtgtgttggtataagtaggtgtatatacttatgtagtatgtgggatattttgatacaggcatgtaatatgtaataatcacatcagggtaaatggggtattacaacatttttttctttttttatacagagtcttgctctgtctcccaggctggagtgcagtggcgcaatctcggctcactgcaacctccacctcctgggttcgagctattcttgtgcctcagtctcctgagtaactgggactacaggcacgtgccaccacacccggctaatttttgtatttttcgtggaaatggggtttcaccctgttggccaggttggtcttggaccttctgacctcaggtgatccgcccacctcagactcccaaagtgctgggattacaggctgagccactgtacccagcccatttttatcttatagtgttaaatttcttccaactcagtggttctcaaaaggggggcatttttccccccaaggagacatgtagcaaagtctgaagactttggttgtcactttttaggagggactgctggcgtctgcaggccatggatgctgctaatcatcctctcccacactaggcagcctcttatgatagagccagcacatctaacatgttatagtgccacagtggagaaaaagtgagacacagcaacagtattttggaagacagtttaaattccttaagaatggcatctgaagaagctccgtgaggtctcctaagaattcagaataatttcacatttatttagtttttgcacccaagttttcattgaagaattttaacacagttgttttggccttaagaataaacacgttgttcttggccaggttgttaagagcataggctgtgaaagagatgctgcgtctgtgataccagctctgcctcttactagcccaggtatctgttaaaatttttgcttgatatttgattctggtatttgtgttctaataaaagggagataacatgtagatatggttcttttgtgaagttcttgtgcttaatactgtgcctggcatcctctgtgtagagtgttaatggtttgtgttgatgttcttattttagatcaagctagtgaagaaaaaaaacgacttgaggaaaaacaaagagcagcccgcaaaaacaggtccaagtcagaagaggactggaagacgaggtgcgtgcctgagtcagggggtgtggctgagccctcaggcaggctgctgtgtgcagacgaggcagggatgccagacactgtgaccccagagcaagggcctatctaacacaaaccctgccgagttgtcccaggcctgaaaaaaagttatttccactgacttttatccattcatccattgatggacacaggttgattccgtatctttgttattgtgaattgtgctgtcataaacgtggggatgcaggtatccctttgatacattgacttcctttcctttggatacccagtagtgggagtgccggatcctatggtagttaagtttttttaagaaatctctggcggggtgcagtggctcacgtctgtaatcccagcactttgggaggccgaggcgggcggatcatgaggtcaggagatccagaccatcctggctaacatggtgaaaccccgtctctactaaaaatacaaaaaattagctgggcgtggtggcgggcgcctgtagtcccagatattcaggaggctgaggcaggagaatggcgtgaacccgggaggcagagcttgcagtgagctgagattgcgccactgcactccagcctgggcgacagagcgagactccgtctcaaaaaaaaaaaaaaaaaaaaaaaaaaccaaaaatctccatactgttttccataatggctgtactaatttatattttcactacgagtgtatgagcttgctttttttgcatccttgccagcatgtttttctttttaataattgccatcctaactggtgtaagacgataatcttgtgggttttattcacgtttccctcataattagtgatgttgaacattttctcgtatcctgttgcctatttgtatgtcttcagaaatgtctattcatgtcttttggattatgtgtagcatggtgtattagaaaaatcatggtctttaaccttaaacctaaatttgccatcagttactaggttgggcaagttatttaactgcttggacattcagcttctcatctgtaaaatggaagtttaagagtttgaggccaggtgcggtggctcacacctgtaatcccagcactttgggaggccgaggtgggcagatcatgaggtcaggagttcgagaccagcctgaccaacatggagaaaccctgtctctactaaaaatacaaaattagctgggtgtggtggtgcatgcctgtaatcccagctactcgggaggctgaggcaggagaatcgctttcacccgggaggcagaggttgcagtgagctgagagtgcaccatcgcactccagcctgggcaacaagagcaaaactgcttctcaaagaaaaaaaaaaaaaggagtttgaagggcatttacactgaaccaggtgccttacatactgctgtgggtatgctgtaaatgttaatttccttatcctaatttattcccaactacttaaaaaaatgccttgtggaaaataagacccaggctagagggtaaacccgttagacaaatacattgtttcgagccaacctattagaagaccctgcttctgtcaagtagcttgctagatcctggtgggaaatccatatgccttttgcatggtatcattaccccttttggaatattattccacagacctgttccctacctaagcagaaatacagcatcacttcagcatctctttagaactatccctcactcacagaatgagttgctgcaatagaataatactgcaaactagtgaagaaacagcctgtgattttccatagtttcccctgtaagtcttgtcctttttcttttaacaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttcccc

SEQ ID NO: 36974 - DNA, 19307 bp, Homo sapiens
tcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacaggtacggggcacggggcctctgacgctgcggaacgccggagggaactgtagagggggatggatggagttggaggcggcgggaagcgggaagcgggggtctcagaggctgggaccttccgatcccctgggtcttgggcgatctgttgcgcgcgggagtgagaggaattccccatttgtgccggggagcgctccccgcgcccttatctggaagatagcaggaagtgaaactccctggacggtgagacccggagcggcagggagaatggaactctttgtggggagggagtggaagaccgcccgatctctgggaaaagaaaagccgggatgggacttgggcgcacccggggatttctaagttttggagtaacggggagagggcacgggagggctggatcagacgcttcctagagggacagagacgaaggaacaatgcctaggcctcgggtgggtgtgggactggggactccccatcccccgcaccccacccacctcccgcgggctccggattatacgtgcgtaagagtctggtgggatggatttacggacttgaaaccgacttctgctggcaggctttcacctggatgggatatttgggtggtgatgaggtctttcccgagacacttttggttcagtcatttgaaatgactttagagtagggtgaggtggtgggaggctgatggagatattgtgggggctttagtccctccatggcaaagcagttcaggcaaacaactccatggttttccctccaaattcaaaaggccccgggtaacctggaatccttcgtagtcggttttgaagtggggccttgggcgctgggggcatcaacatggccatctgggcttgcctgcccaggccacacagaggccccttgttgtgggtgaatggcaaagggaagaggggactggtgtggttcagaggccacaggctgggaagagggatggcgggcgagtccaaggaaactggccgtgtcaccgtgcacctgccacttcagccccacgggtctataaaatgggcatgattatcgtggctacctcactggtcctggcaattaaggaacaatgtgtgccaggcactctgtaaaccacatacttgcgagtgtcaagctggtgacaggtggcgttcctgttgaagcacctccctgagctcacagcaacccttgctgtctctcctcttgccctcagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaagtatgttgggcagggcagggggatgaggctgggcttgcccgggtggtgggactggcgtccttgtgcgggacctggagtccccatctgaaagctcttgagtgccagtgtctgaaaggaccattgaagggagcaattctttttttttttttttttgaagatggagtcttgctctggactccaggctggagtgcagtggtgcgatctcagctcactgcaacctccacctcccaggttcaagcaattctcttgcctcagcctcccgagtagctgggactccaggtgcgtgccaccacgcccagttaatttttgtatttttagtagagatggggtttcaccatgttggccaggctggtctcaaactcctgacctcaaatgatctgcccgccttggcctcgcaaagtgctgagagacaccatacccagcctaaagggagcgattctattctactattcttccttctgctaatccttccattctttaatttaataacgaagattttttgagtacctgtcatataccaggtgctgttctgggccctgggaatacagctgttaacaaaatcatcaaaccacttccctcgtggagcccacattgcagtgagagagacaaacacgacacacactctcaagtccttgaagataaagaaaactgggtaacggagagaagaggccagggtttgttctataatcattaataacacgagcagtaagaagtaaaatttatctaagtaacaacttataaagggtctactgtgtgctaagctctcatccaggttcccaaggattaactcagaccacacagtaattgaatagattctatcattgtcatcttacagaggcccagagagagaaagtgacttgcctagtgtcatagctggtaacggggctgggattctaactcagccactttgggtctagtggccaagctcctaatccctttgcttgcctagggtggtccgcagaggactcacagaggagatggcaggagtgaactgcaggggcaagagagcttaatggagaaagcctgtgacatgccaggaactgcacacatattctcccattgagtcctctcctctaccctcctgacagctgaggcacagagaggttaccttgttcaaatgggtgcataggaagtcaaagtctggagctggggtttgaacccaggcagccctgagaaccttgttctttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccttgttcttaactgtaatgctgcctcctgataggatgtgcctgttgggactaagtaaggggcagtcattcattcattcatttggtatttatcaagcatcgactatgtgtcgttggtgctggggatagaggtgattgggatggctgaagtttctgtcgtcaaggagatgacattctggtggagtgagactggcagtaaataagcagataaagaaagagtatgagaatttcaaagtctgggcacggtggctcacgtctgtaatctcagcactttgggaggccaaggtgggtggatcacctgaggtcaggagttccagaccagcctggccaacatggtgaaaccccgtctctactaaaaatacaaagattagccaggcatggtggcacatgcctgtaatcccagctactcaggaggctgaggcatgagaatcgcttgaacccaggaggcagaggttgcagtgagctgagatcgcaccactgtactgcagtctgggcgacagagtgagactctgtctcaaaaaaaaaaaaaaaaaaaaagactccgtcaaggtataagaatgtcagagagtactaagtgttgcaaagaaaataacaccaggctgggtgcattggctcatgcctgtaaatttcagcactttgggaggccaaggcaggaggatcacttgagcctaggagtttgagaccagcctggacaacaaaatgagaccccatgtctacaaaaattttaaaaatttaaaaattagctgggcatggtggcatgtgcctgtggtcccggctgctcaggaggctgaggtgggaggattgcttgggcttgagaggtcaaggcttcagtgagtcatgatcgtgccactgcattccagcctgggtgacagagtgagaccctgtcttgaaatgaaaagaaaataggctgggcgcagtggctcacacctgtaatcccagcactttgggaggccgaggtgggtggatcacctgaggtcaggagatcgagaccagcctggccaacatggtgaaatcccatctctactaaaaatacaaaatttagccgggcgtggtggtgggcgcctgtaatcccagctactcgggaggctgaggcaggagaatcgcttgaacctgggaggcgaaggttgcggtgcgccaagattgcgccactgcactctagcctgggaaacagtgagactccgtcttaaaaaaaaaagaaaaaagaaaatagcactgggtgatgtgctacatggaatgacttgggctgtgaatatgatttgaggagggcctgggcctgggccttacagaacctagaaggcagagaggaaggggaggggcagggtgccagggatgaaggctcacgtacctcatgtcttagtgtgtgttcactgtcttaaacaagaatttaaagttgggcatggggcagagcggggaagggagcatccctttgcagaccccaagaagccaggaactggagcacattctgctagaggatcgatgggaagcagggttccaggggctgagcctatgtcagtcctgtttcagaggaggcaccaggcttgcttgccctgaatttctgtgggcagctcagccatgagcatcctactgttattgaggtcacagggctgcttaggccccctcctctctaacccagggattgtgcctgcctggaccaggcgtgactgctaagcttctgccaggacaagccaaatactgagggtgcttcctctgctggacgcaaaagtccaggatgaccccccaggctctgtctcggggaaggggccctgcatgctccaggggcctcacaggcctgggtctttcaaaccacccccacctgggcctgtgtttgatcaaggccctgagtgtaaacatccattgtgtgtgtcctttcaggaaatcccatagccataggagcttcctctgtttcagctttgaggatggggaaaagtggactccccgtggtgttcctagggtcacccactgtgctggggtttttctgttgttgttgttttttttctgttgcccaggctggagtgcagtggtgcaatctcagctcactgcaacctctgcctcgcaagttcaagtgattctcccgcctcagcctcctgagtagctgggattacaggtgcacaccaccacacctggctaatttttgtatctttttggtagagatgggatttcgccatgttggccaggctggtctcaaactcctgacctcaggtgatctgcctgccttggcctcccaaagttctgggattacagatgtgagccaccatgcccggcctatcctggtttcaaaagtgaaaatagtcctggataaggtagaaggctgtccactccaggcatccctccggtccggtggctcattccctgctttgtccttccatgctttgggtgatggaccagcacctggacaggaggccctgttccacctcctcgggctccttggggtccaagtgcccccacctccagctgcactgcagcagagagcccatgggacctctgaaatcatgaaggtcacctttgcggtgtataaagaaggaaccagaggttggagatgtggaggaggcctggctgctgttcccactggagacctggcatcttctccccgacctaaaacaatgaaagcagtgctcagcccggatgagatcacggccagcccaagaccaggaacagggtacgccctgcaggaagaaggtgtgcccagaccttaggatggatcaaaagaagccggaaaactatattttttgtgagttttgaaaatgtcagacaggtcaaacaaaacacagtgaggtccagcctcggcctacaagatgccagatttcaacccctggcctatatgatctgtttgccatggcaggcggttcctgtccacctcttttgtttatagcagggaccagctcttgagctccagtgttgaagaggcacggtcagggtctgatctgaagacactggtggctcatgcctgtaatcccagcacttcaggaggccgaggcaggaggattgcttgaggacaggagctgggagaccagcctgggcaacacagtgagacccagagactacaaaaaaataaatttagcggggcatgatggcacaccctgctactctggagatgggaagattgcttgagcctaggagttcgaagctgcagtgacccatgatcgcaccactgcactccagcctgggcgaccaagctaggccctctcaaaaaagatacaggtggaaaaatgatggacgaagagggcattgtggcaaacctggggatttaggagaacctagtttggaattctatgaggattcaatgaaagaatgtgtgtagaggggcccagcacatagtaagagctcaataaacggtgggggctaggggcggtggctcatgcctgtaatcccagcactttgggaggctgaggcaggtggatcacttgagccctggagttcaagatcaacctggacaacaaagcaagatcccatctcaaaattaaaaaacaacaccaacaacaaaaaaacagtggcttagatgcctgatcattagggtaagtcgtgtcctcaaccccttcacatctgctctgaaggtcaccatatccggaagccttccctggcctccttgtttaaaatggcacagcccccactccacgcctggcactctctgctgtccctgattcgttttctccatacagcttatctttgtctgatatgtgacatagttaacattttatatttgtctttctttcctagttagaatctgaactctagaagggcaagggcaaggatttataactcaaaggttccgggcttaggcctcttttatattcttgattttgaggttaattaagagctcaggcctagcgaggtggctcatgcctggaatcccagcactttgggaggcccaggcgggcagatcacttgaggtcaggagttccagacctgcctggccaacacagtgaaaaacctgtctctactaaaaatacaaaaattagccagttatgttggcaggcgcctataatcccagctactcaagaggctgaggcaggagaatcgcttgaacccaggaggcagaggctgcagtgagccaagatcgtgccactgcactccagcctgggcaacagagcgagactccatctcaaaaaaaaaaaaaaaattaagagctcaaagagtttgttttcataggcagcagaatgagaaaagtttacaaaatagtttaaatgacaataaagtcattatagattaacataaataaaataccttttatgaaaaaaataatcattttctgaaatcagacaaaacattgtgaatgagaaggtggcatggttttatttttttgcaagtctccgaagcctggctggatagaagagcctggcttctcagagctgcttcagtctgttgtgatatctattgtatgtcacgtagcctctggaaaactccacagttagtattgttgggaaaataactttgacctcaggatctcctgaaaacgtcttggggaaccccagggtctagaggctgcagtttgagaactgttgctgtggtatcccaggtgtctcaaatactgcctagaacataggtggtactcagtaattattgttgaaggatgaatgaatgaatgaatgaatgaatgaatgaaagaaagaaagaaatgtgtctttgaatccagccatgtgcccagaatgatgagacagatgacaaaagctaagggactttagcatgaggagagggggttcgtttccttttttttcttttttttttgagatggagtctcactctactgcccaggctagagtgcagtggtgcaatctcagctcactgcaatctctgcctcctgagttcaagcaattctcctgcctcagcctccagggtagctgggactacaggtgcgtgccaccatgcctagctaattttttacatttttggtagagatggggttttaccatgttggccgggctggtctggaactcctgacctcaagtgatccacctgcctcagcctcccaaagtgttaggattacaggtgtgagccaccatgtccggccaagagggtgttcatttctgctccttgccaggtattgtgtcaggcactggggacccagcagtggctgagacagacagggctctgcctcacggagcccacattttcaccaggcaaaggatggtcggcccctaagctgggagataagacttcagcagttgggtgggggagccgtgggagaagcccagcccacagggggacagtgcaaatctagaaccaaggcgatggcaggggtgaggctggcacggtagctagagaccacgtcgtgccaagggccttggggaccatgggactatgggaccttagggaaggcgtctggaatgctgtagccagacactgttgcaaggaggatttttctgtagacatgaggccttccttatgaagaaagcaagggttctttcattcctgggggtgccaggtgctgtggactgcagcacgcgtggttgctgccgtcacagagctgtcatgcaggagggcagcgcgtccttgggaaggtggcaggcaggtcaggctaggaggaaagaggccgggaagctgagggcatttcctgcccgagatgcccaatgtagcctacttctgtccccagtggcttaaggcagagttgcctggtaggtgccctggtcccaccctggtgaaaggctgaaggtatttaattagtgcctgagaagcagagaggaaacaggatgtgccaaaacactttgatggatggtagagttaacaggctccttgcctgcagctgcttcagacaagagcgtccccaagccctgggcctgacctggaatgtggggatggaaggggagggggaggaaccaaggcactgggagggtaagtctctctctcccacatagacacacccactccttatgggtgcctgggcatctcctggtacctagaatctggcctgtttatctccacacccatccctggggtctacactaggccctgtgggtggcagttcacatcaggggagttctgactttggctctgagaggtggttcagagatggctgtaagttgagaagcacagactgctgggtgtggtggttcacgcctgtaatcccagcactttgggaggctgaggtgggggtggatcacctgaggtctggagttcaaaaccaacttggtcaacatggcgaaactccatctctactaaaaatgcaaaaattagccaggtgtggtggcaggtgcctataatcccagctacatgggaggctgaggcaggagaattgcttgaatctgggaggcgaagattgtagtgagccgagattagttcgcaccattgcatgccagcctgggcaacaagagtgaaactccgattcaaacaaaaaaaaaaaaaagctgggcatggtggagtgcctgtagtcctaactactcaggtgggaggattgcttgagtccaggaggttgaagttgcagtgggctataattacaccactgcactccagccagggccacagagtgagaccctgtctctaaagaaagaaaaaaaaaaacaacctcaggctccgagggcaccattactgctctatactgaagagctgtgcagcttttccagacccgaaatgtcatccacaaaacagaagtgataatggtcctgcctcacagacttcttgcagtagtccaggtgtttagaacggggtgtaaaaggccgtgtgcccttggtaggaatctttgcatatgcatttgatcatctgcagcctgcccagcccactgcttgccccctcctgggtgtgctgggaaggggtctttggccctccaggggttaggtgccccagcctccaaggtgccctcacgccttttcatcccgactcagatgctgacctgacctttgaccagacggcgtggggggacagtggtgtgtattactgctccgtggtctcagcccaggacctccaggggaacaatgaggcctacgcagagctcatcgtccttggtgagtgggcctgggaagggggaggcatggcccttccttttgtccgcttctgttctgtctgccctcccctgtgtccgccctctgccctccagcttaccctctgggctctgtcgcctgctctgctctcccccaggctctgccagtcacttaggctcccctgtgccctgcaccccaggcagggaccactggcccacagtgcctccaatcacccaagccaaactaagagaagagtggagacaattggagactctgccttttcaaagtctcatttttaaaaaaaatccagacttggggtccgggtgcggtagttcatgcctgtaatcccagcactttgggaggccgaggcgggtggatcacttgaggccaggagttcgagactagcctggccaacgtggcaaaatcccgtctctataaaaaatataaaagccaggcgtggtggtgcacatgcctgtaatcccagttactcagaaggctgaggcatgaggattgcttgaacctgggaggcagaggatgcagtaagccaagatcaagccactgcactccagcctgggcgacagagtgagactctgtccaaaaaaaaaaaaaatccagacgtggtcagagtccatgggcagtgaatgaggacagttgatggtgtgcaaaatcgacccacctcttgctacatccccaaggcctcatctcacccgagtccctcgccaaagcacagcggttttgccgtgtgccctgctgggatggcgctgcatggcacacacactgtgtaagtttgagtgcagctgaaacgaagccgattccagacacccaggggcagggcggggtgtccgtgtggctgggaggcctccttgtgttagggggatgttgccatcggccaggtgccctgctgtaagccaacacatggagtcttgtatgacatgtgctctgcatgagtgatgccgctgggctgtacactgccatcttcacatgtgtgaatgagcacgtgactggggggtacttgggctgcaagacagagttcatgtgtgggggatggaacacgtgcaccagtgacccaggaacctctgcctgttcttcggtaaaatgcaccatttgcatcagcagttcccaaaattagtctccaggtctatttacactctaaaacattatcgagggtctccaagagcttttgtttgtttctgtgggttttatgtctatctgttgcttaacatattaggaattaaaatggggagattttccttttttttttttttttttgagatggagtctcgttctgtcgcccaggctggagtgcagtggctcgatctcggctcactgcaagcttcacctcctgggttcacgccattctcctgcctcagcctcccaggtagctgggactacaggcacccgccaccacacccggctaattttttttgtatttttagtagagactgggtttcaccatgttagccaggatggtctcgatctcctgacctcgtgatccacccacctgggcctcccaaagtgctgggattacaggcatgagccactgcccggccttaaaatggggagatttttcaagcccaagatacacaaggaagactgggcaacatggcaagaccctgactctacaaaaaattttaaaattaaccaggcatggtggcatgcacctgtgagcccagcttcttgggaggctgaggcaggagtatcgcttgcacccaggaggtcaaggctgcagtgagccgtgactatgctactgcactctagcatgagtgacagagaccctggctcaagaaacacaaacacacacacacacacacacacgcatatagtccattaggcatcagggcgatgatggcatcagggagcctgggaaactctactggacattcatgggagaacaagtgaaaaaggcaaataacatcttagtgttattctaaaatttcttcttttggccttgtggacaggaccacgctttgagagctgtgactgacatgcctctgtcctgttgcgagggcctatagtgccaagtgcatgagctctggggagggcttcgtgggtgcagagctgggcctgtggaggcccctcagacacaacactggtggggctcagagctccaggggcactcgagggaagacaagaaccggctctgagatgcgtgaatgtgacagtgcatgagtagagatggagaccttgtgggtcccagaaccaggactgcatatgactttcatatgtgggtatttttgccttcatgggtcccttcctgttttaaaaaaaatgtgtgattatgttgtcacaaagagtttattcctgtatattgtgttaatttgtgttcagatttgtaaagtaaaattaaaccatttcagccaggtgtggtgacacatgcctgtagccctagctacttaccccagaggctgaggtgggaggatcgcctgagcccacgaggttgaagctgcagtgagccatgatcacacccctgcactccagactgggcgacagagctgagatcctatttcgtgggccctaggtccctgtgcctgctggaacaggacatccctatcaccgtggttggagccctttggggtgctaagacctatgaatgagggaaacttagggtgcccaagctgaggtagagccctcagaaccccctgggatttgtattggagccctcgtggcataacacaggtggattatgcaatgggagtttcttacctataagcacccacatgtgggcgggtggagggtaggagccatgcactagggcttcagcccccagccccttcccgcttcagggcacaccttgcacttggccagcctggagctgggctttcgggggtggcacagcctgggctggctctggccagcataatctgtttctcttttgtccctccagggaggacctcaggggtggctgagctcttacctggttttcaggcggggcccatagaaggtacggggggtggatcctgagttgggcttctcgggagctcccatacatcacctactgcttctgactctagttagtatccccttccccactaaaccctgctcactgtggacccctcactaacctggcctgactgtggctctgaggcatctagtggtctggcgctgggcctaggctaggctgggctgaggagagcctggggtgcaggccagggctctgtgactggcacctgcggtgctcttgagggtgtggcgtctgggcagctggctctctctttggtctgggggctgcagtctgtctccctctgtgcaggctgcctcgttttctgccttgtgttttttgcacctgggggagggccgtaactggggaatggccgggatggtagaatggggagtgtgctgtgcccagcctctggcacaaaaaatccagccagggctgcaggttccttggtgagctttgcaaatcgtccccgacctcagtgctggctccgcaccatgtacccctgctgtgccgttagccctgttccctcccaggcctccgggctcagggcctgttgtctttctgcagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggcccgtaagtgtcccgctcatggccaccctggtttgggcaacatcctgcatccaagggaaggaggtggccatccacctgcccccaggacagtggcgttggtctggagggtgtgaatttagccagtggggagaaagtaggctgaggagggtctgctgtttagattgtcgtttacttcctccaacttttagtttatttttatttatgttgttcttttcttttgtaagtataatccatacacatggtaaaaatgtccaacagtacaagatactagtcacatggaagtaaagccctctaaaaaaaccaaatcttggctaggcgcagtgattacgcctgtaatcccagcactttgggaggccaagacgagtggatcacttgaggtcaggagttccagatcagcctggccaacatggtaaaacccagttctctactaaaaatacaaaaattagctgggcatggtggtgatcgcctgtaatcccagctactcaggagactgaggcatgagaatcgcttaaacccaagaagtggaggttgcagtgagctgagatcacgccactgcactccagcctgggcgacagagtgagactctgtctcaaaaaaaaaagaaaaaaaaatgttaagtgaaaaagttaagaaaccaaacaaggtttacaacactacatgatttaagcaaaaaaaattttttttgttttagagaaagggtctcattctgtcatccaggcagtgcagtgcgatcatagctctctgcagcctcaaactcccgggttcaagcagtcctcccgcctcagcctctggagcagctgggactgtaggcacacaccaccatgcccagctaattttttgatttttgttttttgtagagacggggtctcagtatgttgcccagcctgatctcaaactcctggcctcaggtgatcctcccaagtcagcctccccaaagtgctgggattacaggcatgtgccaccatgctggccaatttttaaaaattttctgtagagacagggtcttgctatgttgcccaggctggtcttgaactcttgacctcaagtgatcctgcctcaggctcccaaagtgatgggattacaggcatgaactaccacacctggccttaaacttaagcaaatttttttttttttttggagacagtttcactctgtcgcccaggctggagtaaagtggcgtgatctctgctcactgcaacctccgccccccgggtttaagctattctcctgcctcagcctcccgagtagctgggatataggcgcctgccaccacgcctgactaatttttgtatttttagtagagacggggttttgccatgttggccaggctggtctcgaactcctgacctcaggcagtccgctcccccgcacccctaccttggcctcccaaagtgttaggactacaggtgtgagccaccatgcctggccaaatttaagcaaatgtttgaaaacacatacccacaggaatgctgcacattttacccagctactatgtctagggtcgtatctagcacaccagcatggctactgtggagagctgggactggatgtgagatgagagctaaaggggaagtaagcaaaccaagcaggggaaggtaagagaagacagaagacagagagagagggacctaactctatgagaggagtcagacatgtgcaattgaaaaagacttgctcctgtctctcttctgtgaatgtttgtgaatatcccaacgggacactttcacagaggagctgattgacgtggtcacagccatcagccttgggacaccagaccacagtgtgtacactaagtggcactgatggacacttcagcatccctctagctgctgtcccgtttcccctcctcggggaccacagctgttgccagtccttggtttccttcaggagggtgtctgggtagaccagcctgtgtgcacacagtccaagatacatgaacagtgaagtgccaggcaatccttgcaagcatgggcaggtggagagctgaggcctgcttgacaccttcctgctcagaagcccagtgagcagtttccctccctagggctcagtgtcatcccctataaaatggggcttatggcagagctcaccacactgggtgcatctggggatttggcgagctcatgtgcacaccattgagcatggggcccaacctatataaaatattctacgtctgtcagctgctgggcactgccactatcagcctcagtagtgactgagggacagggcaccagtcagagccctggtgcacacagagtgaccccagagaagcagccttccctctctgagtcctgtttccttctgttaggtcctgacttcatgggttgttgttagcattaaggaagtcgctggctaattttatagtcattgaagtcagtggtgtgcaacctggttcctcaaaggatcacttccctgaaaaaattccactgctccctggaggcttatgcaggccatcccatcccctccctcttgttgtgttcagctgacagctttttgctcagtgagtaagtgttaggtccatttcacagatgggctgcaaccaagtttgcagtgaacccactaagaccagagctagggccaggactaaatgctggtcccaatgccacattcccctgtccccacaccacatttcctccatccggagaccctgttaccccaacccagggccccattaactccctggcagaggccctgttacatctgctgctgccacagcctccgcccacccttcaggaggcagcaggtcccactgctgatgataaagttgcaggctgcctgagctaatgaaggggcttcctctaggctgtgcacttagtcttctgcttccaaaccaaatcagaggtgaggcaccctctctgggcccatctctctcctccattttcctgttggggtcccagggaggaagccacttgcctagggcccaggaattttgcaagcctcttgccctagggaggaaggaagggaggaggatcttaccttgaactgtcaagcctagagcctggtggggcaggcagaaatgggtgcagtccatgagttagaaacactagaggagacactttgctgcttggccggggcaggcaagttaattcccgaggctcctgccactgcatctcaatctggaaggtgaccaggtgggcaggacccacgtctcccagatgactcattttttctagaacaggggcttggctgccaaagaggatacttgatttcggcttgtggggacagtggtggacccagcatctgggctttatataaagggcagctttgttgccctgtaaacacacagaccatgggtggccacttcttccagtaagttagctggggagttggaagtttaggtaaaaccttttgattgacaaatgttggcgaattaccatgctgttaaatgaaacattgttctgccaccctggggctgtgggtgcctgcgtgcaccctctgaaaaatcacacaggaagtggggtggggtctctgtgaagctggtgtcccccagcctcagggatgctgcagaaatggaatgaggaccaacagggactcagatgtccaaggaagctctacagcggagaggacggcttgggaaggaggtccaggcccaggtccctccggaacccaatgggtatggggcagcctggctcctgcctcatcccccttctcctgttgattgtgtcctcacagtgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcaggtgaggccgggggaagcaggaacagctggtgggagtgtgctgggcatctggacactgaggggcaggggctggaaggaagagtgtcttgggagccgaggaggggctctgctcctggtgcgcggccactgacagccactctcccccagctggtggccaaggctcctatgtacccctgcttcgggacacggacagcagtgtggcctctggtgagaatccatcgtcccgaagttggatgtgcctgtaagggagaggggtgggccaggatccatcctcccaaaccgaccaccacccccctgtccctagaagtccgcagtggctacaggattcaggccagccagcaggacgactccatgcgggtcctgtactacatggagaaggagctggccaacttcgacccttctcgacctggcccccccagtggccgtgtggagcggggtaagcaggagccttggggtctgagggcttttaaggtgggggggtgaaacatgtctccctgatacctgccgcagggactcttggtgcaaaccctggaccccgggctcctccagcagtcagtgacaccccccttccctgcagccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaaggtgagggccgccctccctggcgtccagaccgtccctgggcccccagccggtccccgcggctcatacccttctttctttctcccttgcagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 36975 - DNA, 25667 bp, Homo sapiens
ctccgccgtgctaactcctcgctagctctccctctcacacacgctcacacccggctcgagatggcggcggcggcggcggcggcgggggactcggactcctggggtgaggagaagttgctggggcagggcccgggccggcgccggccccacgcagtggcaggcactaacacggctcgctttcttccgtagacgccgacgctttctccgtggaagacccagtgcggaaggtggggggcggcggcactgccggcggggaccgctgggaaggcgaggacgaggacgaggacgtcaaggtgggtgcgggctagggcgccgggcagcgcggaagcgggctggcgctgttgccggccgactctgggccccgggtcgctgccggggcctgcgggccgtgggtccaggcgcgagcatagggcctggcggtgctctcttcccctccgcttgccggccatgtgtgggccgaagactggcagcgtggcctcccggactccctcgccggttgagagtctgctctccggcgtggatcccacccgccggctggcgacgaaaggtgacagcatcggccgggtcggcccacgtgcaagcttcgcggtccggagcctctcgcaggaatgagaccgggaagttgggaattgagccttgtagcttatccatatggaaagccttgagactcgcctgtcttttcgagctcaagtcagcccagggccagtaactcatttatgaccctgaggtctacttatacagtttgttcgagggattagatgagtgaaatattgtagttgaatttcaacctttttttcccacacgagacagctagaaacagtaaagggaaataacttttggctctcccttcccccaccctgtggtaaaaagaatgaactgaccactgagatagcccgcagttagtggacagaaacccaggtagttcacaccgtgacctgagaaatggagagacgacagttactcaactacacacatacgacacctaaggaaatattgaagatttggtggtggttgtagatgacgggcccgtggttttttgttgttgttgttgttttgtctgtgccttgtagataatcatttttacctcagtcgtttgattttgaaaactccgaagggttcattatacagctgtaagtgacatttacttctacatggtttttttttttttttacagtagttacagaagtctcaaatccaaaatgttaagactcttattaacaaagttctcaaaatcttgttatatttgtgcagataaagttttgtgtgaaatggaaaatgatttttttttgtggttttgcctaatttagtgaatttctcctaatttataaacacaaacggagaaccctataaatcctgcctgggctgaaaagtttaagctagataatcactatgaacttaataggaatgttgttttgagtttttctgttctctccccagtccgatgaggttggatgtgtggatgtccgatttactgacagcctgaggttcaagaatgttgtgagctttgcacacattgaagttaataaatcgactggttattgtttgaagacactcagatgctttatttacatgttgtagaaacatgggactagattttgttaccagccgcattacaagatattagttacccctctacattgtagcagattttcagttttgagccttgggttcatattggtcctttcatttttttccatgcatataggaagtggcagttaagacatctgttatgaaatttgggaataaattaacaaatgcagagaaaagattagagatattaggaaagaagttgcagaaaatgaagttttaatggatagtctagactaatgtcatggaataacttccttgggattaagggatctaaatggtatcgatcttgatgaatataattctttttttttttttttttgagatggagtttcgctcttgttgcccaggctggagtgcaatggcgcgatcttggctcactgcaacctccacctcctgggttcaagtgattctcctgcttcagcctcccaagtagctgggattacaggcacgcaccaccacgcctggctaattttgtatttttagtagagacggggtttcgccatgttgcccaggctggtcttgaacttctgacctcaggtgattctcctgccttagcctcccaaagtgctggaattataggcgtgagctaccgtacccagcctctgatgaatataattctgatcacttggaacaagttttggatatttacaagttgtaagggaccacaaagattatcttgtccagttgctcttttttttttggaaatggagtctcgctctgtcacccaggctggagtgcagtggcacaatctccgctcactgcaagctccgcctcccaggttcactccattctcctgcctcagcctcccgaggactacaggtgcccaccaccacgcccggctaattttttctatttttagtagagacggggtttcaccgtgttagccaggatggtctcaatctcctgaccttgtgatctgcccgccttggcctcccaaagtgctgggattacaggcgtgagccaccacacccggccccagttgctgttttagtgctaaatttctttttcttttttttttttttttttaacttaaagcaatctatctattcatctaattttttgagagaaggtctcaccccgtttcccaggctggagtgcagtggcacgatctctgcaacctccgcctcccggattcaagtgattctccagcctcagcctttctagtagctgggattacaggtgtgcaccgccgtgcccagctaatttacatatttttttcttttttttttttttgagatagagtcttgctctgtcacccaggctggagtgccgtggcacgatcttggctcactgcaacctccgcctcccaggttcaagcagttctctgcctcagcctcccgagtagctgggattacaagcgcccaccaccacacccagctaatttttgtatttttagtagagacggggtttcaccatcttggccaggccggtcttgaactcctgacttcgtgatccacccgcctcggcctcccaaagtgctgggattacagacgtgagccaccgcgcctggctatatatatatatatatatatatatatatatattttttttttttttttgtagatacagggtttcgccatgttacctaggctggtctcaaactcctgaggtcaaagtgatcttcccgcctcggcctcccagagtgctgggattacagatgtgagccactgcacctgacctatttattttgagacggatttgtgagactggctaatttttgtgtttttggtagaggtggagtttcgccaagttgcccaggctggtctcaaactcctgaggttaaagcgatcttcccgccttggcctcccagagtgctgagattacaggtgtgagccactgcacctggcctatttattttgagacagatttgtgagactggctaatttttgtgtttttggtagagatagagtttcgccaagttgcccaggctggtctcgaactcttggagtcaagtgatctatcctcctcagcctcctaaaatgctgggattatgggcgtgagccagcagactcagccatatcaccaaatttctgaattcttatgtttttgtactttttatgaggagttgcagacaaggcttagtttccgtgaggtcttctgttcatgtcagcatctagtacttaacctttaaaaatacaggtttaatgtcatttgtaatgtcctgggaaatgaaaggaaaactgatgtttttgttattataatttgctccagcactttactctcatttagtagacttagtattttgctgtccttgacttttcaaatagctgtctggcagtggcagaagtggacttaggtgaaactgtacaaccgttaatatatatggcaagaaaagactatgcttttccccagttaaaaagatgagaactcgggagcatagtttcccatcaccctggctttatttaccttttttactatcctgatagttgtgcagaggtagtgggaagaattgttcacttggcatatatgactccttcctcattgctggtatgatatgtaggatgtgttgactgagaaggcagtgagtacctactggacacaaggacaacataacttttgctccattttactagtctcctagcatttcagtagaacagtttagaagctagatttattcaaagggtacagagtttgcagaaacttatagctgtgttcagccatctcacgcatttgcctctgtaaccatatagcatttcttttaaaagatcctgaagaggctgaggcaagaggattgcgtgagcctaggagtttgaagccagcctgggcaacatagcaagaccccaacacatttaaagagagagcgatcctgaagaacagatttagttgagcctctctcgtcctactcattcactctctgttaggatcctattccaataaatagtttgaatctaccagatagggacaattttcaggggttggaaacaacttctaaagaacaggatctgtattttacagaatgtgaaattactaggaaatacccagaaggtgggcattttgccagaaaatgggtattttgaagagagtgtgtgtatgtgtaacttaagaaaaattccaaacatgcagtagagagaaacatttaataaaccagtgaccagtcttgtctcctctgtatccccactttcctcctccaaccagattattttcaagaaaatctcaatcatatcatttcataccctgccacttttataaactagcaagttttgaattaggaagcatgtttgttattgaaaaatattttcttgtcatgatggatcattgtaaataaaccacttgtttagtgttcagtgtcttgatatcgctgagccagaaatttaaagtagattgataactgtcctgaatatgagacaggtaggcattgagatggaactcagctgagtgctgatccattgtagtatgttaaaagcttaatgaattgaattaaatgaagtagaatttactaaggcaggcaccttggcttctaggcacccagcatagttctgagatggtggaagaacattttggcttttaaaaaactgaactttgctgggaagtctacccttgccaagatctcgttgcacagttctgagttctctcagaactgcacagcttacagaacacaaattaaaggctttttttttctttcccagcaagagattatgttttacctaaaccaaattatttaaagaaaaaaggagaaggagtatatgttagttcctaggctgttgctatagggcaaaagagttttattgctcgtttgaagctacttctatttgacaatctataaatacatcttgcttaagttggaaagcattttcagccctaaatgtgttctcattgcatgtgacataatgtagttttatattatgaagacagaaccagctaactactggccacattgttagaaataaaaagaaagcaagatataaagttttctgctttgcttctgatacttagttgtgttcaattagggaagcaagttttaaagttaaaaagcagccatctctttcatagaaatagcttaaatgatgggtgtgtatctgcagggcaagagtatagataagcaagtagtttataaacaggccctattctaagaagctagccattttaggagagcagcctgggtgattcttttgaagataaattggatattatagttgaaagattaattggctaccaaaaataattgggtaaaggatttaattggatgttcataggtagtctcttgaaccaaataaccatttagggctctttgaagtgagttgtagacttgctccctattttaagtgttaattttagctgtttctctaggaagcctttttacattttatctgaatttgctgctggaatttacaaacttctaatgtttacaaaaaattgggcatattttttgaagcagcgtggtgaacattctaccttaaatctacttttcagacacttaattttataactatggaaacaaaaactctaacttcctggggaaagctacctggccttttgcttttataattacatctgtttggaagtgtgaccagtctctttttgctgacacttactatgctcctttctttaggggcttagtgctagtttggtagtaacttcagggcagacttgtaagcactttggggagagagtgacagtcaaggtttggatggtccttttatgaattgaggagcagatgtcatggctcttcttggtacatgttgataggaaccactttttttttttttttttgagatggagtttcgctgtctccaggctggagggcagtggcgcagtctcggcttactgcaacctccgcctcctgggttcaagcgattctcctgcctcagcctcccaagtagctgggactacaggtgtgcgccaccacacccagctaatttttgtatttttagtagagatggggtttcaccatgttggccaggatggtctcgatctcttgacctcgtgatctgcctgccttggcctcccaaagtgctgggattacaggcatgagtcaccacgcctggccagaatcacttcttttgctactaaaatccattctgtgatggagtagggaatgtctaggtagcttcattatgtctgcattgatgtgtgtctggggtaaggtttatgctttgatgggagaaactagggacagggatagaggtggacatagagttggtgtgaatgtactgagggagcagtgatatgggtggggtgggggttatgtttttctgggaagggtaactgaagagcatcaacattaaataaaaatgctcctgtgttgagtttgtttctttaccttggaggtattgagatggagctccttattttcagccatacttcttccttcttgacctcttactaccagaggcttgcagaccagtttttttcttttttcttttcttttcttttcttttttttttttttagacggaggccttctctatcacccaggctggagtgcagtggcgtgatctcggctcactgcaacctctgcctcccgggttcaaagtgattcttgggcatcagcctcccgagtagctgggaccacaggtgcacaccaccacgccctgctaattttttttgtatttttagtagaaacaggggtttgccatgttggccaggctggtcttgaactcctgaactcaggtattccacccaccttggccttccaaagtgttgggattacaggcgtgagccaactcatctggcccagtttcttaaattagtagaaaactggccaggcgtggtggctcacacctgtaatcccaacactttgggaggctgaggtgggtggatcacctgaggtcgggagttcaggaccagcctgaccaacatggagaaacccatctctactaaaaatacaaaattagccagttcgtggtagcacatgcctgtaatcccagccacttgggaggctgaggcaggagaatcgcttgaacccaggaggcagaggttgcggtgagctgagatcgtgccattgcactccagcctgggcaataagagcaaaactccatttaaaaaaaaaaaaaaaaaaaaaggtgggaggggccaggcacgcctgtaatcccagcactttgggaggctgaggtgggtggatcacgaggtcaagagatcaagattatcctggccaacatggtgaaacccggtctctactaaaaacacaaaaattagctaggcatggtggtgcatacctgtagtcccaactactcaggaggctgaggcaggaaaattgcttgaacctaggaggcggaggttgcagtgagctgagattgcgccactgcactccagcctggcgacacagtgagactccatctcaaaaaaaaaaaaaagatcagtagagaaccactacaggcaatttaaggtgagaagtttggtaaccagtatacctctagctgggcatatcttaatatgtgtaataatccttctctttatgagattcccagagttcccaggagagggacttagttcccagttagttattttatacttcaggactcagggaagaagtcatatttactataatactatttttatttttattattttgcattggaattgcattggaattgctttattccagcgaattaaattgtttaccagactgtgaattttgtaagcaagtgtttaaaacatgctttttaaagaccttccttaacattgtgtttaaagccttaaatgaagctgtttacatgtatacatttaaaggatgtatctcagcatgttactctaaagatgtgttgtaagctgctttattacagtgaattgaactctactaaaccgtgaactttgtaagcaagtgtttaaaacatgctttttaaaaaagtaaatcattttattttcaataaaaaggtcagtcaaatgtttagttatttaaaacttttttaaaattagtttttataattggcaaataatgtacatatttatggggtatattgtgatgtttcaatgcatgtatacattgtaattaccatttcatcactttaaacatttatcatttctttgtggtgttaacattcaaaattttcttatggaactatcttgaaatatataacattgttattagctataatcaccgtactgtgtaatagaacaccagaacttattcttctaactgtaactttatacctatgacactttaaagaactttggtccattcagagcaggtcccttagtttttcactgagattgtgggttggctatgtctgggcctgggtttccttttctttaaaatgggggaataacactaccttcttacaggactgttgtgagaattaaccttgttactacacctgtttctcagaagggttttaaatatgcatcttctggaagtaagcaaatggtcctcctatctgaaacactgccccctatcactcacagatccagccttcctgtgttctgtgaagatttaaacaacaaaaaatgcctagtaattcacttttatttttagctctttggttccttttgtactgtgatgtatagcacttagcaaactaacggcgaaatacaaacgtttgatctctaatttctaactctagtatcacagttactcaaataatgactagctggtttgctttcaatctgttaaaactgcgagctgtgggttaaattgctgaagtaagatgaatataaaaatacacttactttttaatacaaagttcctttaattatgcttgcagactgtatgacagccttaatcaggatgttgaatttttaatttctttactggacttagagatttttattaagaaccaaggcttggttagtttatattcctagactgatacaaatttgtgatctgtcgtgttatgaaaccagaagcttggtgtcatattgtggcatattagtcatactagtcagcctttgcttctttagtagcatcagggcctcttgccctgcttttgccatcttgccactcagcttcaaatggcatgtcatagtgtgcctggtggctgctgagacaatggccaggctacctatgattaaagccatctttaatcatagggctgtgtctgtccctattaaacttgagccttctaagttctgtggagcttttagaaaattgtgtttgataattggtttatatttagctcaatgattgagttaggcatagaaaaaacagagtatagatcttttttttttttttttttttttttttttgagacagagtctctgttgcctaggctggagtgcagtggctcgatcctggctcactgcagcttcgcctcctgtgctcaaatgattcttgttcctcagcatcctgagtggctaggattacgggcgtgcaccaccatgcccacctaatttttgtattttttagtataaacggggtttcatcatgttggccaggctggtctcggaactcctggtctcaagtgatctgcctgcctcggcctcccaaagtgctgggattaaagtgccctgagttagagagtgggatccatgaaggcttgattagctgttgacttttttttgtgagacggagtttcattcttgttgcccaggctggagtgcaatggcgcgatctcggctcaccacagcctctgtctcctgggttcaagcaattttcctgcctcagcctcccgagtagctgggattacaggcatgtgccaccacacccagctaattttgtatttttagtagagacggggtttctccatgttggtcaggctggtcttgcattcccgacctcaggtgatctgcctgccttggcctcccaaagtgttgggattacaggcgtaagccggccttgattcttttttttttttttttttttttttgagacgaagtctcgccgcactgtcacctgggctggagtgcagtggcacaatcttggctcactgcaacctcccactcctgggttcaagtgattctcctgcctcagcccccaagtagttgggattataggtgtctgccaccacgcccagctaattttttgtatttttagtagagacagggtttcactatgttggccaggctggtctcaaactcctgacctcgtgatccgcccacctcagcctcccaaagtgctgggattacaggcatgagccacgcacccggcctgactcctttttaatagtgggctttagaattatatagacttaattcattaaccaggcttatgttgtatggaatactacttgaaataaatgagctattggccagagtataggatgctttttacatttggggggaagtaagaactataaagttctctcagtttttatttattaataactgaatcactttcagagaggctattgatttcagctaggttgtcctaactgctaatggagaagctttcttatgaagttagataagttgatatgagggttcatatggaaaaacaaaacatgcaagaaaggccaagaaaacactaaaaaatctgaaaacctacaaggaaggactagctctagctgacattaaagtaaagcctctgtaattaaaacagtaccggctgggcatggtggctcacgcctgcaatcccagcactttgggaggctgaggatcacctgatgtcaggagttcgagaccagcctggtcaacatggagaaaccccgtctctactaaaaatacaaaaattagcccggcatgatggtggacacctgtaatcccagctactccagaggctgaggctggagagtcacttgaacccaggaggcagaggttgcagtaagctgagatcgcgccattgcactccaacctgggcgacaagagtgaaactccgtctcaaaaaacaagaccaaaaaaacccagtatggtaccgttatatggagagacagtagactagtgggataggatcaaaagcccagaaatagaccaagtacatatgaaaatttagtatatggtaagtcacaaggtatcttaaaatgttttttgctgcaatagaatgcaatagactgggtattgtataaacaacagatttatttcttatggttatggaggctgagaagtccagtatcaaggtgctggcatctggcgagggccttcttgctctattatcctggggcagaagggcaaaagagcacaaaggattgcaggaggtgtcagaactcatccttttatcagatatctactcctaatataaaggtattaataattcattcatgagggctttgcctctaatcatttctaaaagaccctacttctcaacactgttggattggagatttcatcacatgaactttggaggacacattcaaaccatagcccagggaaaaaaaccattatttattaaagggtttttaataaatgatgctgtgacaactgggtagccatttgggaaaaaaatgaaattagatccatgttgcatatcataacacaagaaaaaaactccaaatcagagatctaaataaaaaaaaaaatgaaaccctatacattctagaagaaattgtgggtgaattcttaggtgtaagaaaagactttctggctgggcgaagtggctcatgcctgtactcccagcacttcgggaggctgaggtgggcggatcacctgaggttgggagttcgagatcagcctgaccaacatggacaaaccccatctctactaaaaatacaaagttagccaggcatggtggtgcatgtctaatcccagctgcttgggaggctgaggcaggagaattgcttgaacccgggaggtggaggttgtagtgagcctagatcatgccattgcactccagcttgggcaaccagagcaaaactccaactcaaaaacaaaacaaaacaaaacaaaacaacaaaaaaacaagaaaagactttctaattgacttgaaatccatccagaggcaatgaaagaaaagactggggctaggcacggtggctcacgcctgtaattccagcacttcgggaagccgaggcgggcggatcatgagatcaggagttcgagaccagtgtgaccaacatggtgaaatcctgtctatactaaaaatacaaaattagccaggcatggtggcatgtgctggtaatcccagctactcgggaggctgaggcaggagaatcacttgaacctgggaggcagaggttgcagtgagctgagatcgtccctgtattccagcctgggcgacagaacgagactccgtctcaaaaaaaaaaaaaaaaaaaaaaaaaaccatttctactaaaaataaatgagccaggcatggtggtgtatgcctgtaatcctagttactggggaggctgaggcaggagaatcgcttgaacctaggaggtggaggttgcagtgagctgagatcgtgacattgcactccagcctgggcaagaaactccgtctcaaaaaaaaaaaaaaagtctggtaaattttattgcataaatttgttgggatgcatagcaattcatggggaaacaatagaggcatttccatcaagaaagcaaggatgcccattacttctgctgctgttcaacattgcactagaggtttagctggcccaattaggtaaatcacttgtgagggcctaaggattggtagagaagtaaagctatcttttgtttgcagataaggtagcatacctgtaaaaccctagagaagcaacgataaatctaacttaagtgataaatgaattcagtaaggtagcaggatattaacatataaaaaagccaatagtcatttttgtttatttgttttgagacagggtttttatgatagtgagttgcctaggatagagtgcagtggcactatcatagctcactgcagccttaacctcctgggctcaagtgatcttcccaccttagcctctcaagtagctgagactacaggcacatgccacgttgcccagttaattttttaattttttttttttttgcagagactgggtcttgccgataggtttttatacacaaataatagccacctagaggacataataggaaaacaccctatttataatagcaacatacaagatgaaatacttaggaataaatctaaagagaaatgcgcagagcctctaatagggaaatcactttaaaacacttctgaaaggtacaaaaatgtacttgatcaaatggaaagacagttcttattcttggttagggcagctcagcattataagatgtcaattccccctacattaatttataaatttaatgcagtacaaaaaaataccaacaaacatttctctggagttagtcaagttgataataaagttcacatagaaaagcaaacatgcaagaattattaatggaagtccttttctttaggataactgggatgacgatgatgatgaaaaaaaagaggaagcagaagtaaaaccaggtgagccactggggcgcctccatttttgtttttatgtcttgctgagcatttgtgacttgtattaagacaaatgacagaacgctcacaaaatggaacattttggtatttagaaaccaagtgtccttccattcccactttattctgttttccctgcaacttttctctatcgcctcaaaatataatcagattagatacttgctgtatttctgtatgagtgcttgttagtaggaaagggtagaggttctggcattaattatagttgaatgatctaagccctgcctataggacggtggggaaatatgaagagatatttggatcttaggggtcacattagagaggagaaggaagagtcccagaagtttcccattatttgtgagaaaaatcactgtttgaagctgggaaaggtttggtctcttaatagtatacaagtatcatgtctgtctcatccataaactggaaaatactcagtataactgaataaaacttttttttacttttagaggtaaaaatttcagaaaagaaaaaaatagcagagaagataaaagagaaagaacggcaacagaagaaaaggcaagaagaaattaaaaagagggtaaattctgttttctaaaatacagaattctcacatcggtagtggtatagtttctaacaggctgcaaatattacctaggaatttgaagggctctgtgaagactgtaaatggataccataagataggtaaaatccaaaacaaattgatttgtggtttttgcaaaaacagaacccagttttatatatgagtgtcttttaagttttcacaaacattcaggaatagtcatgatagtgcagtgactacagtcagtgatttttgccagtgcctgtagttcattctagtcagcagtattagtttttgttgttgttttttgttttttttttttggagacggagtcttgctctgtcgctaggctggagtacagtggcacaatctcggctcagtgcaacctctgcctcccgaattcaagccattcccctgcctcagcctcctgagtagctgggactacaggagccacggcgagctaattttttgtattttagtagagatagggtttcaccatgttggccaggatggtctcaatctcctgacctcgtgatccacccgcctcggcctcccaaagtcctgggattacaggtgtgagccaccgcgtctggccaggattagtttttatttgcagtgtatatattgaacataatataaaaattgttcatttctgtgccatgtgctatataaatgtatttgtttttgattttttggcacaggatcagaaatatatgcttgtttttttttgtttttgtttttagacagagtctcactccgttacctaggctggagtgcagtggtgtgattttggctcactgcagcctccacttcccaggttcaagcaattgtcatgcctcagcatcccaggttggaattacaggcacacgcaaccatgcctggctaatctttgtatttttagtagagatggggtttcgccatgttggccgggctggtctcaaactcctgacctcaagtgatctgcctgcttcgacctcccaaagtgctgggattacaagcatgagccaccacgtccagcctattttctatttcttttcttttctttttttttttttagagatggagtttcactctagtcgcccaggcgggagtgcaatggcgtgatcttggctcactgcaaccttctcccgggttcaagtgattctcctgcctcagtcttcgagtagctgggactgcaggcatgtgctaccatgcccagctaattttgtattatcagtagagatggcatttcaccgtgttggccaggttggtctcaaactcctgacctcaggtgatccacccgccttggcctcccagagtgctaggattataggcgtgaaccactgtgcctggcctattttctatttcagaacacatttacatggttcaaaaattaaaacagcctgcgtggtggctcatgcctgtaattgcaacgctttgggaggctgaggtgggagtattgcttgagtccatggatttgagaccagcctggacaacatagggagaccccgtctctacaaaaaatagaaaaataagctgggcgtggtggtacatgcctgtagtatcagctgcttgggaggctaaggtaggagaatcacttgagcccaggaagttgaggctgcagtgagccatgactgcgccactacactccagcctaggtgacagagcaagatcctgcctcaaaacaaaaaaaaaaagaagaaaacggccaggcgtggtggctcacgcctgtaatcctggcactttgggaggccgaggcaggcagatcacaaggtcaggagatcgagaccatcctggctaacacggtgaaaccccgtctctactaaaaaatagaaaaattagacgggcgtggtggcgggcgcctgtagtcccagctacctgggaggctgaggcaggagaatggtgtgaactcaggaggcggagcttgcagtgagcggagatcgcaccactgcactccagcccgggcgacagagcgagactccatctcaaaaaaaaaaaagaaaaaataattatattccagtataaagagaagatagatatacactaagctgtcaactgtcatgtcagagaagtgggtttgggaaacaaatgacatctactattatatctttaaaatttgttatagtggtaattttataattatacaatatgatgaaaaggggaaatgttttgaaccattctgttggacatttaggttgtctgtaaatttatttgaaattatgaataatactctaatgtacattcttgggcttacatatttgtgtgcatcttatttcttaaggtaaatacctggaagtagaatacttgattaaagcatgtaaaaatattatttaagacttgatccatattaccaagttgccctagaaagggttttccaatatagttttagtagcagtgtatgaaagtaatatttttaccttgtccacagtctcaattcctttttttaaaaaaggttatagaagtaaccccagtcttcctgggtacaaatctgtcacgttaccagctgttaccttctatttagttgtgggcaggttgtttctttgtgcctccattgcttatctttaaaattgggttaaggatacctaaagtggactgggcgcagtggctcacacctgtaatcccaacactttgggaggctgagatgggcggatcacttgaggccaggagttcaagaccggcctggccaacatggtgaaaccccatcactgctaaaactacaaaaattagctggatgtggtggtgcacgcctgtaatcccagctactcgggaggctgaggtatgagaatcacttgaacccaggaggcagaggttacaatgagcgaagatcatgccactgtgctccagccttggtggcagagtgaggctctgtctaaaaaaaaaaaaaaaaaaaaaaaaactaaagtgtttagaagaatgcctgaaacagtaattaccagtgttcacttttatttgttattatatacgcttatttaagaattcgtacaatacagaaaggtactgagtgcatcataatccctgtgctttttaaaaacttttgtctcattttagttagaagaacccgaagaacctaaagtgctaacaccagaagaacaattagcagataaactgcggctaaagaaattacaggaagagtcagacctcgaattagcaaaggaaacttttggtaagacgggattatgattgcaatacagtattaaactgttacaggtgaagacccagaaagttcagaaaacatctccttttcttaaaagaaacatactggctaatgtagatattagaaagcagtttttaatctctgtgtatatttgagatttcattacatgttcagatttttgaataattgttttgagtaaaagattattaagataagtcatttatagcaatgcaagaagggcaaaaaggagtagactcagatgaagtacactactgcatagaatatttttatcagctggatgaaatttgcatgaaatgtgaggtctgtagctttgaaatggactgtagggctgtcctgttgtcttaagacttagacagtaggatgttgctccaggtgagaggcatgcagcttttgctgtgccttcttgtgctcagtgtcatttccttctgcaacccttctttgcccttaccatgccctatctttagagggcctccatttctttgtgcggtgtctgcagctgtggttagtgcgtgagataaaagtgcaggatcctataaatagataaattcagagtgttccagagtaagagacatggctagagaaatagtcaaagccctcgcttcatttaaccaagttatcgttacctgttgagtacttttcagagtagaagatcatgttgaaacagttaaatcactgaaatttataaccaagaaggaaagctctagttattctgatacccctcccccactttcatactttctctactctgaaacagatcaacaggctgactgtagtgattgttttccttttcatgaggaagtatgaccttatctgtcagtggatctgtacaaataccaggagttgatgtgaatgctcctgtgcaccattgtatgcttggcaggtcttaactgcactcatctaattatagagagctcttggctgttaatatgtgtcttcctaggatggtaaaagctgcccatgtgtttattaaagaggcaggtttatgaagtgtgcataaagcctagcatgggacacctgttatagactaaaaggtaaaaacatgcattcatatagtcattgttaataggattttactgttgtgtttctcatactaaaataccacatgtaatattgttaataactaatctacttgacatggaggatacagaagcatacttatcttagtgtaaaactcatctaggccagatttttttttttctaacagggtctggctctgtcatccaggctagaggacagtggctgagatcggctcactgcaacctctgcctctgggctcaagccatcctcccaccttagcctcccaagtagctgggactacaggcgcatgccaccacgcctgggtaatttttgttttttggggctttttttgtagatacaaggtttcaccatgctgcccaggctgttgttgaagtcctgagctcaagtgatctgccgccttggcctcctaaagtgctgggattacaggcatgagccaccatgcacagcctaggccagatttcttctattgggatttaacatgtttacccccgcttagcttctggagttagacaaatactttcacaggatccatctttgtttcttattctttttgttccctctctccccactttactgtgggggtgttcttggacaagaacagagtatcccttttgtaatgtaatatgttgtgttttgtttttagagaaaggttcttgctcagtcatccagtctggaatgcagtggcatgaccatagctcactgcagcctcaaactcctgggctcaagcaatcctcccacctcagcctcccgggtagcgagggctacaggtgaatatcaccacacctggctaattttatttatttttttgagacagagtctcactctgtcacccaggctggagtgcagtggtgcagtctcggctcattgtaacctccgcctcctgggttgaagtgattctcgtgcctcagcctcccaagtagctgggattacagatacatgccaccaccatgcctggctaatttttgtatttttggtagagacagggtttcaccatgttggccaggcttgtctctcggactcctgacctcaggtgatcggcctgcctaggcctcccaaagtgttgggattacgggtgttagccactgcgtctggccacacctggctaattaaaaaaattttttttgtagagatgaggtcttgctgtgttgcccaggctggtctcaaactcctggcctcaagcgatccttcctcttaggcctcccaaacaaaacactgggattacaggtgtgagccactgtgtctggccttgatatattgtttttaaatgaataaaatacttatttataaagaaaacctgttatatataaatagatgtcaaaatactaaaatgacaaatttgtgatacagaattatatgcttccttatcgatgcattaaatcaggtgtagtggcacgtcaaataatgtcatttgagagtaattatgactgaacaatattaatattgtaagatatctgtaatggcaggagagtgtgatctctcctggtaagtcaagttttgctaataccactgtgatttgttgccagtcaattgaaactgaaggaaatgctgaattagaggttaataaagatgtaactttttttctgatttaagtttgtaacccccctcccccctcacccagccattctatccagtgactccagtggctccaggttcagagcccctgctttagaatgaaacgacagggttattcagatagctattggctttgtaaggtttcatttttaaaaatcctaacctcctgatacttttcagtgcttcttttctcctacaggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcatgtaagtaattctaatttctagcccctctgggtagatttttagtaggatgttctcttcaggaggttgaaggttattttttattttcaaggatactataatacagactcatgatttgctgtttttagcaattaccttgtgaatgttgttctgcagatacagtgaatttgagtgctggatctttttgtttgtttgtaggggtaagaggacttcttgttttacaatggcttccctaagagatacctgggcttgtcagcaaagcagctaataaaacactggcctattctttttatctgattatcacttgagaggggctgggaagtatcttttgagggaaaaggtctctggcactgtaggatttgggttgggtgagacttcagccactgtcttttacaaatcagaattagacagggtgcaagttgagtgacagggctggcacctattctctgggtccgtggttgtggtgccacaccttgataggagtcatacatttcagggcagggtgaatgggagtgacagccatgggtggtgaagcaggaatgtatggaagggactggttttgctagtatttgcagtttttttgttgttgttgtttttgtgatggagtcttgcattgcagaggcacgatctcagctcactgcaacttctgcctcctgggttaaagcaattctcctggtctggcgcagtggctcatgcctgtaatcccagcactttgggaggccaaaacaggcggatcacgaggtcaggagattgtagaccatcctggctaacaaggtgaagctgaggcaggagaatggcatgaacctgggaggcaaagcttgcagtgagctgagatcgtgccaccgcactccagcctgggtgaccaagtgagactccgtctcaaaaaaaaaaaagcaattctcctgctcagactcctgagtagctgggattacaggcgcctgccaccacgcccggctaattttttgtatttttagtagagacggggtttcaccatgttggccaggctgctctggaactcctgatctcaggtgatctccctgccttggcctcccaaagtactgggattataggtgtgagccaccacgcccagcctatttgcagtttttaagatggagaaaaaggaatcctacacaatgaattgggttttctttgataaattatcactaagctgagggttctacatttgattggtaatgtgcccagagttgatattttattctgcatgtactaatttttttctggtttttggaggtgttctctaaccaaaactgaacactttctggtagctaaaaactggtgtctctttccagcttcatatttttataaggctgataatgctgtccactgaacaggactatttcttggtaggacatagagatggtcactgttctcattgtagttcccgtgcaagaaaatggagacatcatgggatagggtgttgtcattgtaggtttaagaattgtcattctggccgggcgtggtggctcatgcctgtaatcccagcactttgggaggctgaggctggtagatcacctgaggtcaggagtttgagactaaccttgccaacatggtaaaacctcatctctattaaaaaaaaaaaaaaaaaacacaaaaatcagctgggcatggtggcacgcacctgtaatcccagctactcgggaggctgaggcaggacaatcacttgaatctgggaggtggaggctgtggtgagccgagatcacgccactgtaccccagcctggtgacaaagcgagactctgtctcaaaaaaaaaaataaaataggccgggtgcggtggctcacacctgtaaccccagcactttgggaggccgaggcaggcggatcacgtcaggagatcaagagcatcctggctaacacagtgaaaccccgtctctactaaaaatacaaaaaattagctgggcatggtggcgggcgcctgtagtcccagctactcgggaggctgaggcaggaaaatggtgtgaacccgggaggcgcaggttgcagtgagccgagatcgcgtcactgcactccaacctgggtgacagagtgagactccatctcaaaaaaaaaaaaaaataatagtaattgtcatttcatgtttatttgtctgttctccctgattactgggggtgtgttaatggaagggcatgttatcctcccccatttgtttagactgaggaaggatagtagggagcattgtgagctataaagacagtttctctttggttgagcaatggtgtgttggtgattacaggtcgtcattataaataaaatgaattttgttttcaagagacagggtctagctgtgttgcccaagctggtctcgaattcctgggcttaagtgatccacccacctaggcctcccaaaatgctgggattacaggcatgtgccactgtgcccggccaccttacgtttaaagaggagaaattcatggtcctttcaaagttactgaagtttaacaatgaacaaattggatttctcataacacttttggaatgtacattttgggatatatagatatatatggaatgtacatatttagctttaacttttcaaaatgcttaaaaattcaagtttaatggtatgcccttttttttttaagtggaaattgatgacttgaaaaaaattaccaattcactgactgtgctttgcagtgaaaaacagaagcaagaaaaggtaagagcaagctgtgtagggaaatgggtattaaattagagtggggttataggtctaacagtcaacaaatataataggagcctgtcctaattaaaagtcaagcaactcactaataccatttaagttagactagaagaggagtatgggtgctattactgtccttttgtttccagacatgttccccttttctgagttaatagaaattgctgaaatcacagactgggttcaaatactagcactgctacttaataggtataggtaaatcagcttttctaagcttcagtcttctcccttctaaaataggaacaataatactcactttgcagagtatttataagagtaaagtaagagaagtatgtcaagtaaaggttagagctttgtgattttaaattggggggtacttatccacacttttctaaatttgcttcagtgaagttaaggctgtctaccaataacttataacccctgctggtgggctaggtatccagagcaggaccaaggacccagatcaagttttggagagactgactctgggagacctgttcaggtccaaaacatgtaggctcggatgtcccttacagaactagtgtttctgggaccaaaggtttttgtgtgtttgtttatgagggttgctgtaccagataagatgcccatagcacactaaggttcatgaattaactctctttcatctttagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 36976 - DNA, 10867 bp, Homo sapiens
ccagccaatgggcagtgaggcctgacgcggggggcggacgctggggccgagggtagcttgagcgcggcggcggcgttgttcagtcagagcgagaacattccagaggtgagtccggtgaaggggcggccccctgcccggtgcttcccgccccctcgacccctcgggccgctggctggcggggaaggtgcactccccgaccgcccacggctcacggcgccgtctctccgcgccaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacggtgagtcgcgggcgcggcgggccaggagatggcggccgcacaagatggcggcggccgccgcgtgaccccgccgcggcgtgtggcgcagtttgggcggacggcgggcgggcgcgggcccgggcgccggccgccccctccccgcgcgctccccggcccggcctcgccccctccccggcatggcgggagcgcgtcgcgcgtgcccgccgctcgggctgactcaggcttcagctgctgcatttgtgagtcatcgcgcgctctggggcgggggcggcccgatcccggcacccctcggccgtgtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggtaataaactgctcttcaatttagttgatagctctttttgtagaattttgaagtttgcatttgtcaggggaaactgcacaactaaaattcttatttcctttaggttgagggcaaaggcaatggaatcaagacagttatagtcaacatggttgacgttgcaaaggcgcttaatcggcctccaacgtgtaagtaaagcttggaaaagtccacagggcatattatggatagagtcttcaaagtctttgagctgcaaaacttgttctaattgtatgctagctaattaccttacaagttaagtgaggaaccgtggtttattggttgccatgagtttacaaaactaccaggggaacgcatttaaagagtggatggctgggcgcgttggctcacacctgtaacccccagcactttggaaggctgaggcaagcggatcgcgaggtcaggagttctagaccagcctagccaacatagtgaaatcctgagtctactactaatacaaaaattagccaggcgtggtggcatgcgcttgtagtcccagctacttgggaggctgaagggggagaatcgcttgaaccccggaaacggaggttgcagtgagctgagaccacgccgttgcactccagcctgggtgacagagtgagactcttgtctcaaaaaaaaaaaaaaagtggtgttcgtacaaatgtgagtgagtagccagagatctagttaactgtaacgatccaaactcctttttcattcaaatagatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacatttgttatttttttggcagcatgtcaatccaaagaagcaaacaataggtaattcttgtaaagcctgtggctatcgaggcatgcttgacacacatcataaactctgcacattcattctcaaaaacccacctggtgagtcttccatgatgaactcctaagatcctaagataagttactaactgttgggaacaaaatagaaggtttttttgtaataggaatgtaagggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaaccttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtctaacctattccggtgttctctctcccatgagacaagccgttatatagacttaaacagtgttccacctgttggctaaagctgggttgagttaatgactttgttcatgagggatgacagggatccttagggccacctctccctagtggaggcatcatcacttcatcttactctttcttagcagttacaatacccctaatattttgtgtcactccattcttagactaacattcttacgtatgaaatacatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtggaaatgttgaaactagccttcagtgtgtaatacactaatattgtggattccaagtactgtttgttgtttgaattaaggtgaacccaattttggatggagatggacttgatgccattaacttggcaaaatctgaacctttttgttgttgtttttaaggcctttgatcaagtagctctgttttcataaacaggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaaggtaaaacatttgcttggtctgtaaatcagcttcaacccagccttgtttgtgcctttagatatatgatactttagcagtgtaattaggattactctaatgcacgactttttagaactcttgttcatttaaatattttttgcgcgtgattccaggcactatgtgtcacaactgccaaattaggcaggaaaaatatgttcatcagagcagggactggctggtgtcttgagcctggcaaagtgtgcctccattgcactgaattgttttccttttctttgcagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaatgagattacagttgtgtggctttcgagatggtcatattaaccacttttgcttgtcctgtcatgcttgaaagtggggaaattgacccaccttacaagcctctgagtatctgaaagtgccatacctaggcccttacaaagtaacagggatgtttatgcattgacctttttgaacaactatggtatgggccatgcacttgcagacactcttatttgggtaatagagttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgctgagactaacgtgttcactgagtacattgattctgtttgaggattcagacttgttaggacccagtcccctcagctcagtaagggggattgtataaataatcaaaagttgttaaaattcctcaactaagagacttgtactcacattttttaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtaaacattgggggaggagggtattggatacagtgctggcatgggtgtttgagatttaaaaaggtttgtgaggagtgatataatggcagtttggggtaatttcaggtttagaatttaagatgcagtaaaatacagcctctcaataatttggaaaataatagaaagggtgatggaaactgtgttcctactcctacacattatagtctataaaaaaactttaaaaatgctcttagactggagcctgtgtaagagaacttgcagtgtttgcataacagagctgttccgtgaagaagaaatagctgcatctaggcagtttcctcctctgtgaccacaatttacattgatttgttttataaacagatttatcagcttatgttgaataaaatcattcctcttaacaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatc

SEQ ID NO: 36977 - DNA, 35350 bp, Homo sapiens
acttccgggcagaggccagcaaagcggcggcgcaagaggtagggagagaggagctgaggccccagatcagcggccgcgggcaaggtcgctcagcgggcacccggcctgggtatcggggcgcgggtcgggggcggggccggggctcaggggtggggccgggccgggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcaggtgcgggcgggccggaggcgggggctgccacgcgcggcgcccggaaccgggcacgcgggcctggggtctggaggcgggggcagcggtgcccggggaccccagtccccgacctccaggccacggactggggcccaggccgagtccgcacttcgtccttggagtctccttggagtgcgttcctgggggcttgcagcctcgccgggagtctcggccccgggtctgcttcgttacgaggaaaaacgggcccctccgtggggacatttcccctcctcctccccgtgcagctctggccatttgagcaggggctcctttcgcagttgtgaagagaggccttggctgacgcagcaagcgggaaagggctgtccctttccatccgctcctggccacatgagcttgggagcgtctgcagggcgggcagcccgggcgggggtgtttgagggagctgggtggaaggatggagacgtcgggcgtgattcctgcagaagacacctgtgcacgaccgggaagtgggaaggagtgtttgagcaaatcatgggcgggagtgcggccaagggagctctgatcactgatactggtggaggcgggggaggggagcgactgtggctccgggctagacgtcccgatggccatccctgtcatctggatgggtgcctgagtaacttacggcagaaagtggaagccctgggaaggggtggtcccccacttcagtccgggctcctcatccagggtctgcctgcatctacggtctgtgaggatggcttctttctctgggctgctgttgcagatcatcctggtgggccagcaggtgacagacaccaccactgtgctgggtggccgcggcccttgtggggcgtgggtcagggaggatgtttcttctgggaacagctcctgcttagggcatggctccccgctagggagaccagggtgtggtcagcagcatctccatctttctgcagcttgaccctcaacaccaaccatgggcatatcctggtggattactccaagaacctggtgacggaggacgtgatgcggatgctggtggacttggtaatgttctgcttggggaggcataactggtaaccgacagagtggtgggtgagctgggctcctgggagtccccaggaccttgagtatcttgagttcttcctctcattagacctcagtcacctcctctgtgctggtgaggcacctgtccctggcttaggttctaagcagcatcccagggaccccagtgtctgatgtctgagtagacccttcccagacagcaggggagggaaccagacagcagccgtctgtctgtctcattggggacagcaccaagccttgtgtttgggggctgacacttggggtggccagtgtgggtgggaccaggcctcagtatcgtctcttcctaggccaagtccaggggcgtggaggccgcccgggagcggatgttcaatggtgagaagatcaactacaccgaggtgagcaggccccacataccctctggggcctccttccttccctttggggtttatctgactgttagccgcatcaccctgtgtcttcaccccttctcttgggcaatgcttttgcttaatgaggggcctgaaggcctttttcctcctgcttgtagcagggctttggggtgtgccttccacaagattggtttggtgagctccttggaatggttcccagtgtctgcctgggaggagcatatctcatacccacagggagagtttctcaaggctgacattttcttggagaagttaactctaatatatcctcaatgcaagttttagtagcgacaagaagaatcttagatcaccaaagacttcagcctactcaagcagtaggagtcaataggaagcagtggtgaggccaggcctgggggcccctgttcctgactcagtatgggagcccagcctggaggtataatggacactgagcacccagactctgtcctcatgatgtcattatcctcctcttacatgtgaggagtctgaggttcagaggtcacatcacttatctaagatgtcatagctgtaagaggcagaatggagattcacactcaacctgtcttgcattgtgggtctaagctgagagaggatgcaatcaaggaaggctttctggaggagtgcatttgccaataaaatgtggcgcaggagtggggtctggcagggtgagggtggggtggcatgaagccctccaccttagcaagcctctcactgggtcggaatcccaagatgatccttttcctgcccacctggggtcgttagaccttccctcaaggactcctctgctgacttcaggccatttcactcacgtggctgggccagccgcctggcacccgtcacagacttcaagtctggtttggttcctggcagttggtagttatcgggctgcttggtgagggaagcttgagttgcatgccttgctgcaaatccaaggagctgaggacactgcctaaaacgtgccagcaaacaccatggacacacattgggaggatgaggttacttcaggcttcatgagcactcatcttcggaaagcgtttatttatttatttattttgagatggagtcttgctctgtcgcccaggctggagtgcagtggtgcgatcttggctcactgcaacctctgtctaatgggttcaggcgattctctgcctcagattcctgagtagctggaactacaggtgtgtgccacccccacctggctgatttttgtatttttagtagagacaggatgtcaccatgttggccaggctggtctcgaattcatgacctcaagttatccacctgccatggcctcccagagttccgggattacaggcgtgagccatggcgcccggcctctgaaagcatttattgcttgtttctgacatgtattgttgccattctctgcctttgctcactgttcctcttttctctcactgttcatgccctgagcatctctggcaggccttcggggcctgtcctaggcatatatgggtcccctcctctcctcctgactgtctgcagcacataagtccttggggagctcctactcctctaagcatacagtgggttcttggaacaaggttatggtgctaacagagacctcagggcctgcctgtctagtggatagagggccgagctatggcaccatgcccagctgggagcatggctgcctggggttggggggggcagtctttatatcctgaccgtaatccccagggtcgagccgtgctgcacgtggctctgcggaaccggtcaaacacacccatcctggtagacggcaaggatgtgatgccagaggtcaacaaggttctggacaagatgaagtctttctgccaggtaagtggctactgggccggactcacccttggccgtgtgtgtgagttatttgggaatctgggagccctaaggggcagctcttccctcttcttgtaggcaggactcaggttctcactgcagcttaagggaggggttgcctgtgtgatcgctgaccctggagtctctgctgaggcctgaatttctcctggctctgctctgaaggaatctgctgctggcagaagtggggccagtttctttcctgaattgtagacacctatggactcatggtgacaaaccacagaggcttcaaatgaaaagtggggcccctgagagacaggacagtcaggaaaggaaggagctttttcttttttctttttttttttttgagatggagtctcactctctcgcccagagtggactgcagtcgtgctatctcagctcactgcaacttccgcctcctggattcaagctattctcctacctcagcctcccgagtagctggaattacaattatgcgccaccctgctcagctaatttttgtatttttagtagagacgggatttcaccatgttggccaggctggtctcaaacccctgacctcaggtgatctgcctgcctcacctgggattacaggcatgagccactgcgcctggccggaaggagctttttctaatctcttttgtcatacgcccttatcacccagtctagaaacagataaaacattgtaaaatttcctcaaccctggctgggcgcgatggctcatgcctgtgattcctgaactttgagaggccggggtgggtggatcacttgaggtaaggagttcgagaccagcctggccatcatggtgaaaccccatctccactaaaaatacaaaaattagccagttttggtgacatacgcctgcaatcccagctacttgggagactgaggcaggagaatcgcttgaacccgtgcggcagaggttgcagtgagctgcgattgcgccactgcactccagcctgggcgacagagggagactctgtcaaaaaaaaaaaaaaatttcctcatccccattcccagctaaccctccagaagcagcctttgtaaagtttcctgtagccaggcgcagcagctcatacctctattcccaactattcaggaggctgaggtgggaggatggcttgagcctgggaagttgaggctgcagtgagccatggtgacaccactgcactgcagcctgggcgacagcaagatcgtgtctctaaataaatttaaaaaatagaaaagttttcctgtgaagtcttccagaaagttcctgtgcacatacacatctgtcatctcctctttgaaacacgtacacatgtgcacatgcacacaggttggttttctccctgctcctctgaagcttatttccacctggaagtatgtaagcagtgtccgtgtgtcagtgacagtgcatgtaacatgccttcttttccttgtgtgtagggtggtaggggttgcctcagagaccagctaagtttccccacatcaagcacttgcctcagtgtctaccctagcggtgattctgcaggggtgggttggcagacatcctcacgtctggagaacgagggtgatgccggtgtgcctgtgtgggctgtgcatgctacgagggtgatcgtccaaactcttgtcagctgtgatcatttgctgcttgtcctaggagcagtggcctccatgtgtggctggtcagagtccagttactttggccaagagccactttcagacctgaaaatgggctgggtgcagtggctcacgcctgtaatcccagcactctgggaggctgaggcaggtggatcatgtgaggtcgggagtttgagatcagcctgatcaacatggtgaaacgccgtctgtactaaaaatacaaaaaaattacctgggcgggcatggtggcgagcacctgtaatatcagctactggggaggctgaggcaggagaatctcttgaacccgggaggcagaggttgcagtgagccaagatcacgctactgcactccagcctgggtgacagagtgaggctctgtctcaaaaaaaaaaaaccaacaaaaaaaccaacccatctctggaaaaaataaataaatcagctaggtgtggtggtgtatcccagctacttgggaggctggggtgggaggattgcttgagcccgggaggttgagtctgtactgagctgagattgtgccactgtcctccagctcaggtgacagagtgagacgcctccagggcaaggaagttgtggggtcctgatgggaatctggatttcctgaatgtcacttagggtgatcagtccatgtgatggtctttgggtgtgtggcggggcctttccagccatctgctgtgagtggcagagctgaagtgcattaaaagcctagtgctgtgtgatcagtctgggtgtgctcagccatgccacatggcgaggatggcactgcaccgtctggggtgctgtttccaggaaagccttcccttaaagctggccactggagtacctgactcaggctgataaggtatttatagttcaaaaaaagttgctgaatggcagtaatcccctggtgaggaacattccccatggctgtgctctccaaagtttgccaagattgggtgaagacgttcactgtgaccttgattgtagtggcaaaacctgaaaccaagctgtactcatttgtcaggggacttacaaagtagagtcagcacatattcatatactgtcatcctgggcaccaatagggattagggagctatagttggattgatctgccatgctgttcaggatggactgggaagttgaaaaaggaagttgcagaattggtgggtatggtaaagactcatttggtcaaatgaaggctgggtgtaattgtaataaagatagacacatttggcttggtgcagtggctcacacctgtaatcccagcaccttgggaggccgaggtgggtggatcacgaggtcaggagttcaagacaagcctggccaacataatgaaaccccatctctactaaaaaaaaatacaaaaaagttagcctggcatggtggtgcatgcctgtagtcccagctactcgggaggctgaggcaggagaatcacttgaaccccagaggtggaggttgcagtgagccaagatcacgccactgcactccagcttgggcaacagagtgagactttgtctcaaaaagaaaaaaaaaaagacacatttttcctctgggatgcttcattataacaaacctttgacagtcgggaaaggagacttgcttttttttttttgagacagagtcttactctgttgcccaggctggagtgcaatggcgagttctcggctcactgcaacctccgcctcccaggttcaagcaattctcctgcctcagcctcctgagtagctgggattacaggcatccgccaccacacccagctaatttttgtatttttagtagagatgaggtttcaccatgttggtcaggctggtctcgaactcctgacctcaggtgatccacccaccttggcctcccagagtcctgggattacaggcatgagccaccacacccagccaagacttgctttttctaacctcttttgtcacacgcctgtgagggagggttgagaagttgaacaacttattttatttctttctgtattgatggaaattttcccatggcagtttatttaaagaaaaagtagggccaggcacagttgctcacatctgtaatcccagcactttgggaggcagaggcaagaggattgcttgaggccaggagtataataccagcctgggcaacataacaagaccctgcctttaacaaaaatttaaaaattagccagctgtggtggtgtgtacctatagtcctggctgcttaggaggctgaggcgggagaattgcttgagcccaggaatttgaagctgcagtgagctatgatcatactcctacattccaggtcgagcaacagagcgagaccctgtcgttaaaacaaaactaaaaaatacccagcaaggtgcagtggctcttgtataatcccagcattttggaagggtgaatcggatcactgcaggccaggagttcaagactagcttgggcaacctagaccctgtctcttttttgtttgtttgttttttgagacagagtctctctctttcacccaggctggagtgcaatggcctgatctcggttcactgcaacctccgcctcccaggttcaagcgattctcctgcctcagcctcccgagtagctgggattacaggtacctgccaccacacccagctaatttttgtgtttttagtagagatggagtttcaccatgttggctaggctggtctcgaactcctgacttcataatctgtccacctcagcctcccaaagtgctgggattataggcgtgagccaccgtgcccagcctattttttttttttaattaaaaaataatttatagtctgggtgctgtggctcacacctgtagtcctagcactttgggaggccgaggtgggcggatcacttcaggtcaggagtttgagaccagcctggcctacatggcaaaacccgtctctactaaaaatacaaacaaaattagccaggagtagtggcaggcgcccataattccagctactcaggagactgaggcagcagtatcatttgaacccatgaggtggaggttactgagagctgagatggcgccactgcactccagcctgggtgacagagcgagactctgtctcaaaaaaaaaaaaaaaatttataactgggcatggtggtgcatgccggtagtcccagttacttgggaggctgaggcaggagaatcgcttgaacccgggaggtggaggtttcagtaagctgagatagcaccactgcatgccagcctgggtgacagagcaagattccatctccaaaaaaaaaaaaaaaaaaattaaaagaaaattgctggatcttattagtgtatagtaattttttattgatgtgtgggaaattattccaaaatttagcaactagaagcaacaatcaccgtctctttatgtggggaatttgcagtggctgtgtttggtgtagtggctctgatattctaaggttgcagtcaagatgttggctaaggatgtggtcatttgaaggcttcatgggggttggagggtctgctttgaagatggctcactagcagtgctgcctttgggaggcacagacagttcgagtgtcctcatgacaaggcagcttatttctcccagagtgagtgatccaatagagagtaaggcagatgcctggaggtcttttgtgacctaatatcaggattcacattctttcttttttttatttttatttttttgagacagagtttcactcttgtcacccaggccagagtacaatggcgtgatcttggctcactgcaacctccggtccccggctcaagcgattctcctgccttagcctcctgagtagctgggattacaggtgcccgccaccatgcccgcctttttttttttttttttttttttaaatttttttagtagagatggggtttcaccattttggccaggctggtcttgaactcctgatctcaagtgatccgcctgccttgccctcccaaaatgctgggattacagggtgaaccaccacgcccggctacactctttgatttctataataccccgttggtgttacagatcagctctggtcatcatgggaagggactgcatcagtgggttaatgccaggagacaaggaccactggtcaccatcttagaaggtgggggactatcatagtcccgcttctggcgcctagtgattgattttgttccttccacacacagataccccactcactttctcctaagtccatattctgttacagtattagaagtctgttagaagtctagaacctcattttgtcaagtacaggtgtagtagtacctgcatttcctttagtacagttcctttcaatctgaagacatgagaatttaaagagacaaattacccctcacacacccagcatacaatggtgaggtgggcatgggatgactggtatgtatgggataattatttcttttcttttctttcttttttctttttttctttgttttttttttttttgaggtagggtctcacactgtcgcccaggctggagtgcagtggtgcagtcactgctcactgcagcctcgaactcctgggctcaagcaattccccacctcaaccttctaagttgctgggactacaggcacatgtcaccatgcctggctacttttttattttttgtagagatgacgtcttgctatgttgcccaggctagttttaaactcttggcctcaagtgatcctcctgcctcagtttcccagtaagtgctgggattataggcatgagccactgagtccggcctgcatatttaggtttttattatgaccacactgtacttctgataccaaaatctgtattagttatctatcattgtataacaaatgacatcaaaacttgggttaaaacagcaatacacttttttttttttttttaagacggagtcttgctctgtcgcccaggctagagtgcaatggcgtgatctccactcactgcaacctctgcctcctggatttaagcaattctcctgcctcagcctcccgagtagctgagattacaggcacacgccaccatgcctggataatttttgtattttttttttttagcagagacggggtttcaccatgttgactaggctggtctcgaactcctgaccttgtgatctgcctgccttggtctcccaaagtgccaggattacaggtgtgagccaccatgcccggcctagcagtaaacttttattacctctcacagtgtctgtgggtcagaagtttgggagcggcttagctggttggtcttggtttggggatctctcataaggctgtagtcaacatgttggccagcgccccagttatcggaagttttgatgggtttggaggacccccctctaaagtgtcccatacacaggaagcgagttggctgtgacttttggaaaaaggccttagttcgctgccgcgtgggcttctttatgaaactgtttgaatgtcttcacaacatgatagacagcttccccaaagcgagtcatccaagagagcaaagcagaaactgcacgttctctgaactcacttctgaagtcacatttcacccctttttgcagtctctggatgggtgcataggtcacccctcccagcacaggcggaagctatgcagaggcatgaattccaggaagcaaggatcactggtgtctgattggagactggctgcgggtctgatactcctttccccagcatagcccagtcacagttttcaacatttcacatctcttggtctctggcatagcagattctgccgagttatccctggttttgcaaattctgacagtgtcgctgtaaggtagggatgtctcactgttgtaaccaggaaagagtctagttggtggtgagtgtggcagggaccagtgtggtctccagagactcctatgccttgtgtagtggctcacgcctgtaatcccaacactttgggaggtcaagatgggaggattatttgaggccaggagttagagaccaggctgggcaacgtagcaagacgctgtctctacaaaaaataaaataggctttgcgtggtggctcatgcctgtaatccaagcgctttgggaggccgaggcaggtggatcacctgaggtcaggagtttgagaccagcgtggccaacacggcgaaaccccatctctactggaaatactaaaaattagctgggcagggtggcaggtgcctgtaatcccagctacttgggaggctgaggcaggagaattgcttgaaccctggagcctggaggcggaggctgcagtgagctgagatcgtgccgttgtactccagcctgggcgacggagtgagaccctgtctcaaaaaaaaaaaaaaaaaggctaaagcagagcattttgttctgtttttggagtcagggtcttcctctgtcacctaggctggaggtgcagtgttgcgatcttggcttgctgcagcctcaacttcctggactcaagcaatcctcctgtctcagccttgagccaccctgcctggcccctaaggcacagttttaaaaataagtaaatagcgaggcgcggtggctcacacctgtaattccagcactttgggaggccgagctgggcagatcacttgaggccagtaattcgagaccagcctggccaacatggcaaaacctcgtccctactaaaaatacaaaaaaattagctaggcatgctggtggcgcaggcttgtagtcccagctactcaggagactgaggcatgagaattgttagaacccagaaagtggagactctgtctcaaaaaaaaaattaaaaataaatagctgggtgcggtggctcaagccagtaatcccagcactttgggaggctgaggcgggcagatcacagggtcaggagatcgagaccatcctggctaacacggtgaaaccctgtctctactaaaaatacaaaaaactagctgggtgtggtggcgggcgcctgtagtcccagctactcaggaggctgaggcaggagaatgacgtgaacctgggaggcagagattgcagggagccgagatcatgccactgcactccagcctgggcaacagagcaaggcttcatctcaaaaaaaaaaaaaaaaaaaaaaaaaaaaaaaaaaaatatatatatatatatatatatggtaaattaaaaacaaaaaaatagaggcacctgcgagggcctgaaagctgggactgaggtaccaggacacggcagtaatgatgtttttgagcagcggattatgcctgggggtttgggctgatggcatcttcgcccctgtgccagcgtgtccggagcggtgactggaaggggtacacaggcaagaccatcacggacgtcatcaacattggcattggcggctccgacctggtgaggagaaaactgccttggggtagggtgggagtctgggcactgttggtcccactcaggtctttactttctccagggatgggacctggctgtctccacttttcgtgggccctgaattcttattctctgatgctatgtctccccgcagggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaaggtatgagtgccgaaaactgcccggcccctggccctgtgtgtgttggggtggggagggacagctgtcttgccatccccctggccattggtcccttttggtgggttccgagtgaaccatggtttgtggatcaggtcagtacagctgccctagactgtttccatgcctagcagcaaataaggttgactgatgaaatcctgaacacatcagtttgaacctttgtgtcctgaccacacccgctcgccttgcggcatctctgctcagcctgggactgctcgccactttcttacaaacctgtcctttatgcctgctccttttcttgttgttgtttttgagacagagtctggctctgtcacccaggctggagtgtagtggcgtgatctcggctcactgcaatctccgtctcccaggtttcaagcgattctcctgcctcagcctcccaagtagctgggactaggcacacaccaccacgcctggctaattttattatttatttatttattattattattttttagtagagatgggcttttgccatgttggccatgctggtcttgaactcctgacctcaggtgatgcacccccccttggcctcccaaagtgctgggattacagtcttgagccgccatgcccagccatgcttgctcctttctgatcccagagccatgccctgataatagaggggttttgtttgtttttatttatgttctatttactcacatgaatgtacataaaatatgaagaattccatctgaattctgagataccttccagcctgggccgaagagagcctcaggttgactgcagcccctcaggggagaagctgcggcctttgacctgcaggcttagggttggggggtgtgtttaccgtcccccctcctctggttttaaagagctggaatctcaggaggttatgtggcgtcactgtcactgacctgcaaatactgctccatgggacagctgggcattgccttggcctctactgctgaaccctggctcaaggcctgcacccacccctaagctcgggcgcccactgctgttctctttggttgcagacctttactacccaggagaccatcacgaatgcagagacggcgaaggagtggtttctccaggcggccaaggatgtgagtgggctatagggccttcctcgtggttagcctctgggctgggaagagcagggtgggcccctgagtgaccaagtctggccgtgtttctcctgaagttggaagtgaaggcggccttgccggtgcctgcctttgctagatgagatgattgttcatcttggctttgtcagacccagccttgcagatgtgacagaacctgctctcgctggctgacagcccttgcatggccctttctctgcaggcccttggcgctgcaggaactcttggccacacctattttataggggagggacgtccctgagccccgtatgcttgtaagatgggatgagcaggcggcctgtgacccgtctgctttcttgaccttgacctcgatgtgggccttctccaacagtctcagaaccaaggactgggaatctcagtcccatgcagggccttggttcctctagtgatgggaagtgactaccctttgtctccctgggctggctgtggtaacttggctctgtctcttgtagccttctgcagtggcgaagcactttgttgccctgtctactaacacagtaagtgcccccgtggtcccctgtactgccttcctgggagtgcccagcatgtccaggtcatggcctctcagagacgcggttcgtaggtctggtggatcttggcttggctgatggtatggaaggtttggttgcctgtgggctgcaagccttccttgccttttccgcatttacccattcaacctctgcagctttgaggagggaggcttggagtcagtgggatcacgataaccccttcttccgtctcccaggcctgactgatacacagaacccttcatacacatgaccttcctaggcctttgtgcccagcatctccccaaatgtgacatgctaggtaggggtagaggatgcattccatttttcacttaaggacataaagccccaatgaagggaggtgacattttgccccctacttagtgtgtgtggttttgttttttttttttttttttttttttttaagacagtctcactctgttgcccaggctggagtgcagtggcgtgatcttggctcactgcaacctctgccttccaggttcaagcgattctcctgccttagcctcccgagtagctgggattacaggtgcacgccaccatgcccagctattttcgtatttttagtagagacggggtttcaccacgttggccaggctggtctctgactcctgaccttaagtgatctgcccacctcagcctcccaaagtgctgggattacaggtgtgtgccaccatgtccagcttattttttgagacaaggtcactctgtcactcaggctagagtgcagtggtacgatcttggctcactgcaacctctgccttctgggttcaagtaatttttatgcctcagcctgctgattctgggattacaggcgcccactaccacgtccaggtaatttttgtatttttggtagagacaggttttctccatggtggccaggctggtctcgaattcttgacctcaagtgatctgcccacctcggcctaccaaagtgttgggattataggcatgagccactgtacccggcccacttagtgactgtatgagtaggtgatgccaggattagaacctgggtctcctgtctccaagttctcacagtctgcctggcctcgaggttgtgcaggctcagcagggcatgacagagtgagggatgctccaggagtgacagcagcagtcagccagtgggcactgtgctgtgtcagagctggggactacacccacatctccctcccaccccctccaccatcatccccacatctctgcctccagtgcctacccagctgcagcaggacgccataaggctggctaaccatagcactgttgcctgcctgcaactgactggtcagtagggcttctcctcctatgtggaataggtaaggaattgctggccctgtctgccctggggaccagaatacctgatggctcctcagagcttcctggtgcagtcaccctcccacacatgggaagggctgggtggctgttcagcctgtgtttgtttgcctggcctggtaggtggcccctgcccacacttgggtcccagtcctaggttcggttcccagatgtccaggggtatcatgctctggtgtcccaggcaggcctgggtgagagctgttgcagagcagtgtgtgggccaggtcctcacacggggttacagctgccctcagcagggggctttgcaggcacaacgtcactggcgtgctggtcatggactgatctggtgtccagcttggggtgggcagatcctgggccctgccctcgactcacaggctgctccagccctgccccatccctggctctggggaaggtgaggctcagctcacggagcacagctccctgcctcccggagctcctgttcccatcccgctagcaaatgcttctttgcatttctctccctttgtttttttttttgtagaccaaagtgaaggagtttggaattgaccctcaaaacatgttcgagttctgggatgtaagtacaagcacttctgcactgggtgaattaagtgtcctttgccaagtcatggctgttgagaggcccatgaggtcaggtcagtgtttattgagtacctgctgcatacctagcttggggaaaggtagagaggccctcagagaggcttggagggcaagagcaacccaggcaggatgagggctccacttccacctgagggcgggctgagcttgcagggccacatgacactcccttgggtgcctgcctgcaacacccactgtggggtaacccgagtcccccttgccacgctcacagagttgaggttgtgagttattctcagtgatgacctttctctgaactgcagccaccatctgtaaaggccaagggcagggtgaggcatgaggtatgaccgggtaggcctggaaaggagcaacaggagctgcaggaggagctgggggggtggcgtagaggaggcgccaggctggggcagcttgcagagcaaaccctgccttgagtgacagggctgccgacccctctgtagcaacaggtggtccatgggaccacctctgctggagccgagcagtgagccacagctttccttgtgcacttgcctgagctcagcagtggtgtgaggagggctctgactgtgaagcccagggtgcaggggtgcagtgcagggtgtgatgcaggcactgtgaatgctgtgggcatggccgggcttacgtgcagggctctaacgctgtggcaggcgcagcagagagggcattgcccatttggtggttttcccacctggggctgtctccaggcatttggaccagaggccctttgcttggtgatggcatccacagacataacctcattcctttgaaagctctaaaggccttttactaccagggtctgggagagaatgaagccctaatcccttaagccatccactgtgtataatgagttaacttctttctagaatgagactagttacataccatccttggaagaattgacgagaatcactcaagtcattttctgcatcctgtggctcagatgcggaacactggtcaagagagactgtgcggcttctaataaatgttgcatggctgataatggagggcaggcaccttccacctcctccttgggatctggagcctgagcaggtggtgggcagggatgtgtgggtgctgctgccagccaaggagccaagcagatcggggtgtccttgcttgtcaccacccagcatgtagagatgagttagggtgtggcttaaggagaggatgggtctggcctcccaggtaaggcctaggaatgatagctggacacaggaacatggggccagggctggctggtgagacctaagtggaggcctcctgggccaggctagacagcccacaacggctggaggagggacctgcctgagttactagagtgtatcctgctgaatcaagaaggtgatatctgaagaacccagggataggagcaggcgaagttcctgcaggtggggtctcgggtgagctacagccatcagctcaggcctagggatgcagtgccggccctcaggtgagatcagaagagtcccgtctggtaggggtatgtagaagaggtaattcttggtccgccagggccagttttgcggcagccatgggtgtcgggatcaggcaggggtgtggtgggaaaccatggggtctctcagggctcggccagggtcagcgcacgccacagggccagttttggctggagaggcctgaagcagagccagagcaggtccaggtgagttctgaagaggagccaggacaggagagggacccataggtctgtgaattccagaggagaggcaggtatttagaggtggttctgtcaggtgaagtctgaggagccaaagctatgtatgtgcatatgtcagccgggctctgtgggaggtggtgtagacctatggcatgggacaggtgtgcacgctgggatctctggccggttccgaaaagtgaggatcaggtagtgggtggctgattgcacaagtttagaacccaggattagggacacacaggtcagcacctgcttctcagcatcctgactgggtgtgatgggcagagctcagggcgtcagaggcctctgagaatttgtgactgaagtccaagtctgtggcatcagggtctgcagagcccagatgcgggagaggtaggaatgtacctggtgatatgaggcaaggacaggggagctggggcaggtgaggcaggcaggtggcatgaggagctgtgctgggtgggtgcggtctgagtggctcaggttgggtaaagggccagagacctgggtctacagggcagacatcaaggctgagccagtcagacagtgtttgtcaacactgggctctcaccaggctccctcaggccgaggtcagcagccagggatctgtcatgtgtgaggaaagtgtctgttcaggttaggtgtgtataatgcagcctttcagagccgcgtctgtctgaggtcctaggagctggaatcagacaggtttgtatggctgggtttctaggggaggcctgaggagccaagactgtactcaggtaggcagaactggaccagtctggtaaggacgttggagctaaagataggcagacaggtcgagctgggtctgacaagtgagggctgaaaatctgtgattgggtccaggttggagctgtgtccttgggcgatgtctgagcagctctggtgggtgagcctgggtcccctgggaagagaccagacaaagggatggggtcagacaaagggatgacgaaccgcatccatcagaaaggtggatgaagcctgggtctggtcgaggtacgtagagcagatctagcaggcgaggtttcaggggttaaggtgagacacaggtatgtatttttgggtctcacaggttaaggtctgagccactgaggtcaggctctggtttgtatcccaagaccgagaagctgtgttaagcatggtgggtagagtttgtcaggtgacatctatgaaaccaggagcatgcaaagataggttgaccggaacagccatggtcaaaccaattaaactgtcctgcagttgaggtcaggcacaggtagaacggatctatcaggtgaggcccaaggagtccggattaggctcatctagaaagacctggatgtggtagatgacctctgaggatatgaagtgaaggcaggtggatagagccaggtctctcaggaggtctgaggagctgggatctggcacagtgagcaggtctggatttcccaggtggtgtcaagacagatgggtaggccaggcacagtggctcacacctataatcccagcaatttggaaggccaaggcaggcagatcagttgaagtcaagagctcgagaccagcctggccagcatagcgaaaccccgtctctactaaaactacaaaaattagccaggcatggtggtgcatgcctacagtcctagctacttgggaggctgaggcaccagaattgcttgaactggggaggcagagtgagccaagatggtgctactgcactccagcctgggtgacagtgagactatctccaaaaaaaaaaaaaaaaaaaagcgggggttgggtgtggtggctcatgcctgtaatcccagcactttgggaggccaaggtgggtggatcatctgaggtcaggagttcaagaccagcctggccaacatggtgacggggtgaaaccccatttctactaaaaaatacaaaaattagctgggtgtggtggcacacgcctgtaatcccagctactcaggaggctgaggcaggagaattgcttgaacccgggaggtggggtttgcagtgagccgagatcatgccactgcacttcaacttgggcaacaagagtgaaactttgtctcaaacaaaaaacaaaaaaaaaaaaaaaagaaaaaagatgggtgggtagaagttcttctcctgggtgaggttgaggagctgtggccaggtacaggtatgtaggtatgtggaattgagtttcttgggtgaggtctttggagcctggcccaggtacatcttcgggtctatcaggtctgaagaacgggagttaaacacaggtgtgtagaacagggtttggcaggtaaggtctttggagccaggatcagggcagcttcacaaagctgagtgtgttcatgagacctaaaaagtcatagtcaagcccaggtaagaagaaccaagtgtgttggatgaggtgtaagcagctgaggtgtgaagtagaggtaggcagagctggcccacaaggtacaagctcaggaaccctcatcacatgcaggtagggggtgctggtccaccaggcacaagcccaggagccagcattgagcacaggtaggcagacttggcccaccaagtatgatctgaagagccaacatcaggctcaggtaggtagatctggcatgccaggtgtactccaaagagccagagtcaaacacaggtaggtagagatagtctttcaggtgtggtttaaggagccaaggtcaactacaggtaggtagagctggcccactgggtgtggtttgaggagccagggtaagcacaggtaggcaaagctggcccaccaggtatggtctgaggagccagggtcagactcaggtaggtagagctgcctgccaggtatggtctgaagagccaggatcaagtacaggtaggtagtctgggtcactaggtgtggtctgagaacccagcgaaaagctcaggtaggtagagatagcctttcaggtgtggtctgagaacccagggtcaagcacaggtatgtagagatagcctttcaggtgtggtctgagaacccaggttcaagcacaggtaggtagagatagcctttcacgtgtggtctgagaacccaggttcaagcacaggtaggtagagatagcctttcaggtgtggtctgagaacccagggtcaagcacaggtaggcagagctggcccaccatgtgtggtctgaggagccagggtcaggcaggtagacaaaactggtctgccaggagtagtctcttgaaggagagctgaggagttaggttgaatgcaggtagatagagttggctctttcaggagttggattcaggcacaggaatgtgcccctgggtgtttgaggtgaagcctgaagaaccagagttgagcctaggtgtatagagcggcctcccaggtcaaccccatagcatgggggtctctacaggcaggcagaacattgtgggtttcctaggaggtctgtggcccctaagttagacgtgggtaggtagatgtatctctctcaagcaaggactttgtagctagagagacatacagctggggtcttgcaggtgaggtcattggtgcgtggttctggcttagttgtgctgactcagtcttaggcctggggacagtgggttagtcacaagttggtagaactacgcatctcagctggggagcacaggtaggcagagatgttccatttgatgaggtctgaggctcctcagtgagctcattggtgctgacgttaagcagagattggcagcattggatctgtctgtgagacatgaaaagccaagccagacacaggatgtggactgccgaggccaggctcacataaataaagctggaccctgggaggctgtaaggaatctgagttgggcttaggcaagggaaccgggtctgtcagtcaaggtgtgaggggtcaggttatgtgaagcctggtctatcagctgagatgtctggaacccatctttgacaggtatataactctgtagcctgaggcactggagttggacacaaataggcagaactaggtctcccaggtgaaaccattgcatcgatgctcagtgctggtatgtttatctggtgttgtcagtgagtctgccgatgcaggctcagtgctggtatgtttacctgattatgtcagtgagtctgtggatccaggctcagtgctggtatatttacttggttgtgtcagtgagtctacggatccaggctcaatggtggtatgtttacctggtgttgtcgtgagtctgtggatccaggctcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagtgctggtatgttgacctgacattagcagtgagtctgtggatccaggctcagttccacagaggttgtataaacatggtctcaggtgggttcttgacacctgggttcaagcacaaaagtactgctgggcttgttaggtgaagtgggtggggtctagcacaggaatgcataatggtgaggctggccaggcctggggaaggtgggtcagacacaggtgagaccttcggtggtagggtcagacacaattaggtgagtagtgtgggctcttatatcaagggaaagccgtagtcattgtaggtgtttgtacctgggtctgcctggtgatgtctagggaaccctaaagatcagctgggacaggtatctgttctcagcaccctggtcaggtatgatagacagagctcagggtaatacagagggctgaggatctgtaaccagtccatggtgttggtctgcatccaagatggcattgtgctccagttgacacagggtctgagttaaaagtgaggaaagttgccaggcgcagtggctcacgcctgtcatcccagcactttgggaggccgaggtgggtggatcacttgaggtcaggagtttgagaccagtctggtcaacacggtgaaaccccatctcctaaaaatacaaaaattagccatgcatggtggcacatgtctgtaatcccagttactcaggaggctgaggcaggagaattgcttgaacctggcaggcagaggttgcagtgagctgagatcatgccactacactcaggcctgggcgacagagtgagagaccctgtctcaaaaaaaaagaaagtgagtaaagtgaggaaaaaggtagatgatggttagataaggtgagatctggggcactggggcaggttaggcccaggacattgaactgactgaggagctgcatctataatgtatggtctcagaggccactgcacttaaaggtgaggtctagagacccatgtctgcagattgagggttcggaggctcaggtcagacactgcttggcattgctgggctgtcacaaaactgggatctgaggacctgttctcggccaaggtgagcagcctggactctgtcagccagagggctggctgtgtgctgaagtttagtttctagagctgagtctgggctgggtgtggtggctcatggctgtaatccctgagcttcgggaggctgagatgggaggctgaggccaggtgttcaaaacctgcctggacaacagagcaagaccccatctctacaaaaaatttaaaaaatagtcaagcatggtggtgtgtgcctgtagtcccagctactggggaggctgagatgggaggatcacttgagcccaggagtttgaggctgcggtgagctgtgatcatgccactgcactccacctgggcaacagagcaagaccctgtctcttaaaaaaaaaagaaaaaaatagaactgcatctgttagatgagatgtgagagcctatgtcaagcatgatgtagtctgtaggactgcgtctgtcaggtaaggttcccggaaacccagagcctttccaagtgagtggccccaccggtcatctcattgcccaagccagaaacctctcggccacactggagagctcccagaatgagtcctctgcactccccagtccatctccggggcttcaaagtggcttgtttgcttctgtccttgtcttagccgcagactgttctcagtcctcccaccgtgcctctcagcttccaccctgcggtccccaccccttcctttatcctctggaaggtgctatgcttccccctgcctcagtgggcttccaggagagaattaagccctcacagcccaaggcatctactggatgtaataagtgggcacctctccttcgtgtctagaaggttactagtcttggaccatccttgggagaactgagaagtcactcagatcattttctgtgggccttaattctgtcacgcttgagaaagactgctttggccacgggacctttgcatgtgctgttatggctgctggaatgctccctcagtgcttctctgggtcatgcctgctcgttcttgagatcaagggtcaagtacccctcaggttccttttataagtggcctcagcaccatgttccaatttctcctcagcacttgtttctcagtttcacatttattggcatgattatttgatgtacgtctctctcccacactctgtgtccgttgcctgtgctagaaatgtgggaggtgctccataaacagctgttaggaagacatccgtgaagttctgaggactctgatggcaccaagtggagcttgcaggtgtggcttgagaaggtgcagtgtgaatgataggcctaggtgataggccgagaagatcggtcaagcccagatatgacccactgggcctgtcagtgtccaggaggtggggtgaggcacaggtctaaggttctggatctgtcagtaccacctgaggagttgggaatgggcacaggtacaaagtgatgagtcttcattgttcaacaaagaatggcacaggtgtgaggatctgggtttgtcagtatctgaggatgtggggcctggcacaagtatgaggcactgggccactgttcaagcaggtgggctggggaacagaaatgtagctgtgggtttttaatatctgaggagacctagccaagtgtagcagagagctgctgggtctttcattgtccaaggaagcatacctgggcacaagtatgagactgagaaggtgggtcctggcaccggtaaggggctctgggtctgcaagtgtctatggaagtagggcctggtacaggtatgtggtgctggaagaggtatccaaggaggtgggctaagtacaggtatgacatctgggtcttccagtgtgtgaggaggtaggatctggtacaagtatgaggccctgggtctgctggtgtctgaggagataacagcaggttacaggtatgaggccctgggtctgctggtgtctgaggaggtaacatctagtacaggtatgaaatctgggtcttcctgtgtctgagaaggtagcacctggcacaggtatgaggatctgggtcttcccaatgtttgaggaggtagcatctggcacaggtatgaggatatgggtcttccatgtctgaggaggtagcacctggcacaggtatgagaatctgggtcttccagtgtctgaggaggtagcacctggcacaggtatgagtatctgggtcttcccgtgtctgaggaggtagcacctggcacaggtatgaggatctgggtcttcctgtgtctgaggaggtagcacctggcacaggtatgaggatctgggtcttcccgtgtctgagtaggtagcacctggcacaggtatgaggatatgggtcttccatgtctgaggaggtagcacctggcacagatatgaggatctgcgtcttccagtgtttgaggaggtgagtttggactcaggtttgaggcccttgggcttccagtgcctgaggagatagcatctggcacaggtatgaagccctgagtcttctagtgtctggggaagtgaggctgggtacaagtatgaggatctgtgtccatcagtatctgaggaggtgggatcgggtcctggtatgaggatctgggtctgtccatgtctaaggaggtaagatctggccctggtatgaggatctaggactgtccatgtctgaggagttaccatctggtacaggaatgaggatctgggtctgtcaatatcagaggaggtaggaatctggtacaggtatgaggatctgcgtctgtcaaagtctgaggagttaccatctggtacaggaatgaggagatgtgtcttccagtgacttaggaggtacgatctcttataggtatgaggatctgggtctgtcaatgtctgaggaggtaggatctggccctggtatgagaatccgggtctgtccatgtctgagcaggtaggatgtgtccctggtatgaggatccgggtctgtcaatttctgaagaggtgggaatttggtacatgtatgaggatctgggtctgtcagtatctgaggaggtaggatctggtacagttgtgaggatctgggtcttcgggtgtctgaggaggtggcatttggcacaggtatgagaatctggatcttctagtgtctgaggaggtgggatctggtattaattatgagaatctggttctgtcagtgactgaggaggtaggatctggcataagcatgaggatctgggtctgtcaatgtctgaggaggcagtatctggtacaggtatgaggatctgggtctgtcatgtctggaggtaagatctggcatgagtatgaggatttggttctgttcatgtctgaggaggtaggatctggtgcaggtataaggatctgggtctttcaatgtctgagaaggtaggatctggtacaggtgtgaggatctgggtctgttaatgtctgaggaggtaggatctggcactggtaagaggatctgcatctgtcagtttctgaggaggtaggatctggccctagtaagaagatctcagtctgtcaatttctgaggaggttggatctggcccccttatgaggatctgagtctgtcaatatctgaagaggtaggaatctggtacaggtatgaggatctgtgtgtgtgtcagtgtctgaggaattaggaatctggtacaggtgtgaggatcttcatgtctctgtatctgaggaagtaggatctgatacaggtattaggatctgggtctatgtctgaggaggtagcatctgatacaggtatgaagacctgagtctgtcagtgtctgaagtggttggatctggccctggtatgaggatctgggtttgtcagtatttgaggaggtaggatctgtccctggtaggagggtctgtgtcttctagtgtctgaagaagtaggatctggccctggtatgaggatctgggtctgtcagtatctgaggaggtaggatctcatacaggtatgaggatctgggtttttcaatgtctgaggaggtaggatctggcacaggcatgagcatctgggtctgaccatgtctaaagagttgaagctgtgtgcaggtatgaggccttgggtctgccagtgtctggggaggtgaggctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggtgagtgtgtttctgtgtcttgcagcccctgtgggagacagtgttgcagtctaaggtcggggtagggggcttgtgtccctgaacatcatgctgtcctcacaggctgctggcctctctgcagctggctgggatatttatttcatgtccagaaggaaggtctgggtttttttgcgtgtgcaagttggcccccgtctttgcccctcacaactgcagtcctgtttctctcctatcctaggcagagtcagatccctgcactcagggccacctctcactggaggggctttgtctaggtccgagtcctcccatgtcgtatcttctggctctccatgcagccttccttcgttgcagaaggagctgtgcccactgcccacaggacgcagggtgtggccacttctgttgactctgcttttgtgtcacaggttttgacaacttcgagcagctgctctcgggggctcactggatggtgagtgctgaggctggttctctgccaagtgctggccagaggcgcgtgtgttggtcctggtcccccgctttctcccccactgtcctgtccctcccctccccgtgcagctgctcagctcccactcatcctgctcctgtttcaggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcaggtaccagctgccaagccaggccttggagtcagcaagatttgtggggggtctgggaggtctaggaacctgggtttcagctcctccaggagctctttgccccattgcccttgggcctggccaaggtccatctgtgctccttgtctcaggatgaatctttgtaactgaggttggttccatttgagtgtcatctgagtttgatcaccatgggaggggcatgactggtgatcatggtgccctggctagggaggtcctggcttgactcaggggatgtttctcagctggggtcacttctttcttgcacatcactatgcatgcctaccatagtgtctgaggacgtaggatctagccctggtatgaggccctaggtctgttagtatctggggaggaaggatctggtacaggtatgaggacctgggtctgtccatgtctgaggaggtgggatttggccatagggtggggctgcaagctggaatcccttatagcctgcactgcctttatccctccagaaaagcaagtgtgtatctagtctgtggtggcctctttggactacatggccctcttctcccttgggatctccagagccccccgagaggcttagcaggccctctcctagtcacattatgtcccagaaagcttttccacacctgtccctgcttttttttttttgaacagattctcactctgtttcccaggcaggagtgcagtggcgcgatctcggctcattgcaacctccgcttcctgagttcaagcaattcctgtgcctcagcctcccgagtagctgggattgcaggcatgcaccaccttgcctggctaatttttgtatttttagtggaaacggggtttcactatgttgcccaggctggtttcgaactcctggcctcaagcgatccacctgccttggcctcccaaagtgctgggattacaggcatgagccaccatgcccaaccctatccttgcttttgtttagtacaaagccagtccctgtccagcagctcttgagttgctctgggcaggtacagaaggcttcaccaacacctggaagcaaatcctgtgactgaaggagaggccaaggttccccaaatcccagctgccttggtgagggttgccatgaccagggcccaggtgggtacccaaagcctagcatttagttgtggtgacagccctcaaaggctgtactcttagccaggcatggtggctgatgcctgcaatcccagcaccttgggaggcagaggctggggggaattgcttgagcccaggagttcaagaccagcctgggcaacgtagtgaggcccggtctctacaaaaaaaacccacaaaaactaacagtagccaggcatggtggtgcggcacctatagtcccagctacttgggaggctgaggcaagaggcttgcttgagcccaagaggtcgaggcttcagtgagcaatgattctaccactgtactccagcctgagtgacagagtgagactctgtctctttgggaaaaaaagaagctgtgcactctggaccccagcctgctctcccttaagaaatgagctgattttgtgaccgattttgtctttagggaggtccttgcctgacctccagacccaccttttcctgggcatgagtccttcctgcacagtggcttaagcaggaaaggttgggaggctgtgtcctcactggtgtggggaggaaggggatcgtgcctgtggacacgtgtgcaggtccacctcacggtgtcagggcagggtgggtctgcctggagcatctgggcaggactttggcatggtgcaggaaggagcaggatttgcgtacagtgtgtgaaggatcaagacttgcaggaagagggttgggttttttttctttcttttcctttcttttcctttttttttttttttctttttttttgagttggagttttgctcttgttgcccagtctggagtgcagtggcatgatctcggctcaccacaacctccgcctcccgggttcaagcgattctcctgcctcagcctcccaagcagctgggattacaggcatgcgccatcacacctggctaattttgtatttttagtagagacagggtttctccatgttaatcaggctggtctcaaacttccaacctcaggtgatccgcctgccttggcctcccaaagtgctggaattacaggcttgagccactgcgctcagcctctttctttctttttaaatgttctttcattttgccaagaactgggtttctgttccttttccagggcgacatggagtccaatgggaaatacatcaccaaatctggaacccgtgtggaccaccagacaggccccattgtgtggggggagccagggaccaatggccagcatgctttttaccagctcatccaccaaggtaggcccctgtggcctgggaagggtgatgttgggggagggaaaggatcttccagaagagatatctcacttaggtcagtgccctcctctaggccatatggctagctcccatgggctggggtcatgtgggtgaccacagtgcccttcacaggcaccaagatgataccctgtgacttcctcatcccggtccagacccagcaccccatacggaagggtctgcatcacaaggtaagagcccccatctggccccatctggggggtctggctcacattgcacccagacctctgaaaacctggtgcattggttggcaatcacgttagttttctattcctgccgtaacaaatgataacaaacatggaggcttaaaacaacactcttcttttgtggggtggggaggggggacagagtcttgctctgtcgcccaggctggagtgcagtggcacgatcttggctcactgcaaccttcccctcccggcctcaagtgattcttatgcctcagcctcccaagtagctgggactactggcactcaccaccatggccagctaatttttgtagttttggtaaagggggggtttcactatgttggccaggctggtcttgaactcatgacctcaagtaatctacctgcctcggcctccctaagtgctgggattataggcatgagccaccttcctgggctatctgaagagtttctgaagctcaaatatccagcaggccctgatgtgtctctgcttagagtcttgcaggctgaaatcaaggtgtcatcaggactgtgtttctttctggagaccttaggggaaaagcctttgacctgcttgtcaggtggttggcagaattcatttctctatggttgtggaactgaagtccagcttccttgctgtgggctgaaggtcgttctcagattctcagaggtcacctgcatcctctagcttgtgggcctcttcactgcagaaccagcaatggcaggttaaatccttctctgaagctttgattctgtcttgccacttctgttgcatctctctgacttgtttaccttcctcttctacattttgcttttgttccctaagtgacagtgtcatgctgtgttgtctaggctggacttacagtggcatgatcacagttcactgtattctcaacgtcccaggctcaagcagtcttcctgcctcggcccctcaaatagctgagacttacaggcactaacaggcacttacaggcacttacaggcactaacagcctggctaactgttaaactttttgtagaggccagatttcactatgttgcctaggctggtctccaactcctgggctcaagtgattctcctgcctcggcctcccaaagttttgggattacaggcatgagctaccgtgcctggccctcttttacttttaagggccagtgtgattagattggggctactagataatccaggaaaatctccccttttgtttattttatttatttattttattttagagatagcatgtcactctgttgctgaggctggagtgcactggcccaatcatagctcactacagccttgaactcctgggctcaagcaatccttttatctcagcctcctgagtagctgggaccacagatgtacaacatgcctggctaagtttttttttttttttaaagagacagagtcttgctctgttgcccaggctggggtgcagtggcacaatcaggctctctgcagcctcaccctcctgggctcaagcaatcctcctacctcagcctcctgagtagctgggaacaggcacacgccaccacacccagctgatttttttatttttattttttgtagagatggagtctcagtatgttgcccaagctgccctcgaactccttcagagaatttactgtgctttgtctcaggtgtgcagagcagcacagggttacggtagcacaatcttgggagtcagtgagctggattgaattctgattgttcctgtctatagttctgtgatccagcactgtggacttgtggaacccaaggctctactagaacagggcgatgatgcctttcctccttaggatcttagtattatttttttttcgagacaccgtttcactttgttgccccggctggagtgcagtagtgtgaccttgactcactgcaacctcagcctcctgggttcaagtgattctcgtgcttaagcctccggagtagctggaattacagttgcacaccaccacgcccagctaccttcttaggatcttaaaagatagatgttggtaaaattgtgagcaggacccctagcaagtggtgtgtagttctttttttttttttgagatggagtctaggtctgtcgcccaggctggagtgcagtggcgtgatcttggctcactgcaccctctgcctcccaggttcaggtgattctcctgcctcagcctcctgcctgatgacaggcatgcgccaccatgcccagctaaatttttttttggtatttttagtagagacgggtttcaccatgttggtcaggctggtctcgagctcctgacctcgtggtccatccgcctcggcctcccaaagtgtcgggattacaggcgtgagccaccgcgcctggccactggtgtgtagttcttaaagagcagttatcactgttccctgccttgtggtgtcatcggatgtgtccccctcgctccaactgagctgtacagcgagtgacccaggctgggactgacccctgctgagaagtaccaggcggtcttgtccctctgcctgaagcccagacagtgctctcaagcataactgatgtctcgctcatcagatcctcctggccaacttcttggcccagacagaggccctgatgaggggaaaatcgacggaggaggcccgaaaggagctccaggctgcgggcaagagtccagaggaccttgagaggctgctgccacataaggtcagcacttctgcatttggctttggggtgcatgctggagttggaggtgtgaagctatggcaccaggcaggggcttggggcgtgcctggcttgtcctacagaatgggagggcctgtcctcacagacctgcacgtctcagcctctggggcagggtgtgcttcccttcaaggggtttagggatcaggactctcttggagacattccttggtgttttctgcaggtctttgaaggaaatcgcccaaccaactctattgtgttcaccaagctcacaccattcatgcttggagccttggtcggtgagtgagtaggggaaaggtcctggcttggggtaggttggaatgggcttgtggagccctgatgtgccctgtctgtcacttctgcagccatgtatgagcacaagatcttcgttcagggcatcatctgggacatcaacagctttgaccagtgggggtgagttgctcacttaggggagggccgggaatacctttgtgtcggctcagggatttcagtagcaacgttagagccttcctcataccactcttcccttcccttcccttcttggcagagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggt

SEQ ID NO: 36978 - DNA, 56717 bp, Homo sapiens
atttcctccgaggctggcgatcggcggagctcccacctccgcttacagctcgctgccgccgtcctgccccgcgcccccaggagacctggaccagaccacggtgagcgcagggcgcacggcgcggaggccggactcttcgggcggccgggggtgcttgggcggccggagcgagcctgcgggacccgagcaagtttcccaggtcagcgcggggcccggcgccttcagactcgctctcttctctcttccgcagatgtggaaacgctggctcgcgctcgcgctcgcgctggtggcggtcgcctgggtccgcgccgaggtaggcgaggggccgaggagtccgaactcggtccccggggcctcttgggtctgcgcgctgggcgggtgggcgcgcgtcctggggatgctctcccggggtggcgctgggagtttcggtccttggggtgtgctggggtggagctggggcagtaatgctgcttacgaaacttaaatctttaaagcaggaaaagtagttcgggccgtaagcgggagccccgccgcggctaacatggagggagagcggggaggaggagaggggacgggctgggccgacggggacgaggcggcgactggagcagcagcgagttcaaaaaggcgcctcagttccgtccttcacttcagaggagactgagagtagttggggacttttccctcccaagtctgtctcctgggggcgggggcagaggaatcgggattcttcttttggggcaaaattaattttcctttctctcttttaaagtgagatcatgattctctgaaatgtattttcttctttgtgaagtgtcctcgggttttgtgttatcatctgggcaatgtaacggccttttcccaagtgttccctgtaacgttgcgcaagtgtaagagaagatccattgctctgctctttgggggctcgagtttccagttaaagcatttcagcgcttgtttttttgtaccaattttttcaactctaacgaccttcctgagacactacaaacaaaccaacaaactctttgctcagaagccgctccattaactcaaaggtttatggacagaaaataaacaattctaaattccccgggctccagtctccaggaaagtgaggtcagaaactaaacatttgataattatggcaggaaatatggaaggaattaaaaagcatgagggagaagaaatggaatgcacattacaaaagaaatagctccctggtgggtggtttatgctccctgtttgaattttttccttcatattacagtttaaccacacccttagcatcgcagcttgactctgcccaaaaaagtcataaatgcatacaaggtcttcacaatttttaaaaaatacgcattgtactgaattctcatttaattcactactacgttgttgattgaggtggaaactcaatcaactgtttttactgccaatgaaataaaagtagctaatatttattaaatatctgctatgttgtaataaaattccattttaatgacagataaattgagtcagcgaaggttacccaatgctctcagctattaaatgctaagggtgggatttgaacccaaacagtctggctccggacccaaggctcttgaccattaacccacaccacttccaagcacaatggtttaacatttaccaagtacatttttgtttaccacacactgggctgtgtacgttacctgcagttacttcttttaaagctcccaaaccctgtaatgtaggttttattatcccgattttacagaggaagaaacaggtttaaggagattaggtaacttgcccagggtcatacaactagttagctctgaagcaggatctgaacctacctctcttacctttggagcccatcttgaactccaggtctgcttcttatccatctggttttccagggtttgcatttgagagcgtatcccccttcactggctgatgtagccctggttaagaaacatttctccatcccctgctgtggccctcaaaaggcagttgcagaccagtgatggatgaggtgaatccctggttggttttccagcaggctcaagaattgccagccagtgtgtgaaatcactcagtgaactggaatgcaaatatgaggtgtgaggaggctgttggttgacttaccaggctgtgtggcccaaggtctggaatctattctaggcggcctgcaagacacacacccctcccaacccccttccacacagggaaaacttatccctggtaggaagttcccccagcagcaatttcctgctggaggtagaagagcatccagtgctctcacataattcccaggcaaactacagggaagaaggcaaaatagagaagtactgagatgtgaaaacagagtgcgttgggggagaaaagaggctgtgaactcacagtgtatggaaatggttacaatgaaaagagtgaggggtaggtatgagctaggttacatttcatggctccaggttattaaggattattatcttttaattattccaacctcctggtgcctggccaagtaagatttggcaagtttttaatccatttaataataatatacctttaacaattgatgaagaggtacattaaccctctccctatgggaattgtaatttggattttttaaaagccttttatcttgtagttaatggtgcttgctgtttaaatttcttccttgttaactctaaggacagtctgcaaaaatggtcacatcatgatatttacagtccttagtgacaatctattttagtaaacttcaaatcgctaaaattgtacaaatattgttgaactttttagaaatgaaatttagaaaataaattgaggcttcttggtgctttctgcttttctgcgaccataaatatttaattcagcatatttttaaacaatttaatcactttacaaatcatgttgatatttgaagaagccagagcctctgtagtaaaccagaatcagaggtgctctccacttgggaaaaggtgattgtcatcagtattaatgccagtctatgtcaatcccatttggttagattcacaaagctattaacaaaagtcataaaggagcctgggctcagtggctcatgcctgtaatcccagcactttgggaggccaagacgggaggactgcttgagcccaggaatttgagaccagcctgggcaacatcgtgagaccatatctctacaaaaaataagaaaattacctgggcatggtagcacacacgcctctggtcccagctactcaggaggctgaagcaggaaaatcacttgaacccaggaggttgaggctgcagtgagccgtgatggtgccactgcactccagcctgagcaacagagtgaaaccttgtatttaaaaaaatagaaacaaactcattaagcaaagtgtcatattgttttgaatgtgttccatggtgtcctacttccttggcacctcagggttgctttctgattgcttcttctctttcttacctgctcactctcttactactctgtctgcagcatataccttcagccagcctccctccagattctgccacatccacctgagcacacacacccatgcactctgtagtctgcttgaaagaaggtactgggtgtagcatatgtctctagatgtgtgtagattaacatgtgaatggactaggcagagagggcagcagcagagggagtgcctgcactaataattacacagatatcccttttctagattctctggggagaggactgtgtgagcctgctcatctactctttcccatccccctcccattgggaattactacagttcattgagaagtgttgatggtggatgcatagtatggagcctgggaaaatgttaagaacacaggcggtagtgtgtgtgcccttgaagctcagtcagtggatatctgtcactctaacatggcaggctggagagaaccctgtggcccaactgcctgctttaggaagacagccctggcaagtacccaagcatacccccactctcccttggtggatgtctctgctgtcactatgattcccagcattccaggtctagaaattcattatgataagtcacatgtacagttaactgatttgtagttcagaatcctcattccagtaagggatccatgcttgacccatgaactttgagtgtattacctaagagagaacaatagcaattctacaaatagatgtacttcacttagctctagacatgcaatactagaagattatgagggctttgtcctgaggccacgtttcttaacctcaccgtaccctattatcggcattgtacactaggggttatatttgggagctcctctatgttctttagaattgttctgatggtagactcaagtaagccttgcatctaacccatatctctgactgcatcttcttggtgccacaacttgtattattaacaaagctaaaaagatctctaaaatgatctcttgcttgtttatcctttggcaaataagctacttgttgcagttctaaagaccattgctggaaattggggtgtaaaacatagcaggggctgtgcagactagccagaacagaagggcaagcacccagcataggaggccctggccatcgcaagtggctttagaaggtggacacgttacagttcccctagaagtctctggattgggtgacagaaaccaggactccatccccaggctcatagaagcaagttggagaggaaccatgaggtgaagatctggtcatgggctgaagtggatgtaatgatccgagaggaaatgccccaaagacgaaaagaaagtctttgaagtcagtggggcagagcaacacatgctgccacaagaataggaagtaaaggatgagctgtaaattaccagtgatcacatatgagaattgaaaatgtcatggattctttgtcttagtcctcttcaaataactggacatctggcagaatgtttctaacagacataaattttattagcttaatgataccagttaatagggaaaaaaagtacattagataggttcactttgtaagccagatgattaatgtcctcagagggcaaatgcatactttttgtttaggatgctctattctgactcctgcgattttggcaaggggtgctttctctgagagtatgccatgaatggcgtggccttcccttcactgtcctcatcgagcctatcccctgctgcagctgagcgcacctggtactcaggtcagagtcacagtgaagcacaaggcatggtctctgccctcacattatttacagtctagtggtgggtccaggtgctttaaatcgtggcagctacagtttatattattataactacatagtaactagtagctttatacttattgctgttttttttttaatttacattaatgtagggccttcctttgtaagatccttttatggtagcaaaatgcacaaatcttccatgtatagcttcatgaacttttacatctggcccatgtaggcaccatgcgacaagactgagggagttagtacagaaaggtatgaacctgtatgttaccatgaagttacatacaggaaaagttaccatgaagaaaatgagggatagggatgatctagggtacatttcatgactctctgcccaaagatggctatcttttaatctgtctcttctcttggtgtctagcccaggtaacatttagcaagtttttaatccatgttttaacaacagcaaaccttcaataattaatgaaagataaattaatcctctctatatgagacttactatttggatgttatttttaacattttaacttgttaacaataaatggctttccttgttagctacaaggatgtgcagcaaacacagtgaaatacagccttaattgacattaatccattttagtaaactttagatctgctttggggagctttcttgactgttttgtggatggatagatattccagggctcactgtaatctatattgaattccacaaagaactcaaatcattctgttagaccactttgccctggtcattattacttttgaaaggactctacataagatgtcagtcatgttatttatgacagcaaaaaacttaacattgactacatagtcaaccgtaggagaagggttaaataaatcatggaacagctgtatgtgccaccaaaagcatttacaaaaacattttgaagcgccggcaaatgattataatttaatttaaaaagcacacaccccccagctttattctcacgactgtaaaaatttatagaaaagtacaacaaacaaatgtgttagaaattatctgtaggtagtggatttatgggtcattttattctttgctctagtcttttctatattctctaagcttttaattggcatattttattttcatattttatcagaaaataacacattaacttttttatttaaataaaataccacatattaggagaagggaaaattcctctcgaaaaaaggaggggatcacaagaatcgtcacgatgtcaaggcactggatgaaatatccaaggggcaggacttcagggattgcttaaggagaaaaaggtggggtggtaaatggcctttcagagatggcacagacgtggcatacatattaccattaccctctcccttacccatgacagacatttctaatcaatcatagaattctttcctactgaacttggagaaggtttgaaaatcctactcagcaatattctaggtagccactagcaatcagagtctatatgagatgaaagctatttaccatccctgctggatggtaaatcagtccaatttgacaaacattgacacatctttagccaaaattaagataattagaagacagagtttgggactgtatgaaactgacaaaaacaacatagggtaatagatgatagaactgggttagcaaatggatgaaatgtcaggaaaatagcacttacaccagattttggcccaagtttctaagctctttggatgaatctgaacaccttaaagtaagccagaccttctaacattggcccagtcaacaaaaatataacgagaattttcttggctattctgatgaagtaaacagttgctcttgctaaagttctaagagctgctgctgtcatagataacagcttttgcattagcctggcaataacttgctaatagaatgctctttgggtagttggagtacaaaataattcccataaatcttcatttcctgctttggttggaggatttccatttaatcttttcacagactttagatgctcatttggaagccatcaccaataaactattcccaggattagtctgaatgtatgacccccatatgtcccttgaataatcctggacaccatttgtgaccaactaagctgttgacaaacaggtcatatgatacatgacaaaagctatcacatgttgcaggcccagatttatatgtgcatgcatgtgtgcatgtgtgtgtgtgtgtcatgggatattggcttgaattgatgtaaggaaaacgtctctctgtctttctatactttttgttgtttcaagatttaaaatcctatgtctgaggcaaaatttgtcttttcccctgtctttcctcttatccttcaatgacagttaataagtgtaatttatggatctacagaagtgtcaggcattatgctagtcagtttgcacataagctactattaggaagagtgtgggactaaaaagccttaccatacagatccctgttctgaaggagctgctaccaccatcgctgcttggccattaggggtcagatgtaaggctttagcagaaattccccttcctcacctcttggcactacttcagaaaatcctgaaacatggcagtgggatagatggcccctgccttctcagaatttgaaagactccacttgggcagctggggcccttttcagcctgtccacctaatcagtatgtccagtagatggcagctttttgtgtggaacttttttttttaatttattattattatactttaagttttagggtacatgtgcacagtgtgcaggttagttacatatgtatacatgtgccatgctggtgcactgcacccactaactcgtcatctagccttaggtgtatctcccaatgctatccctcccccctccccccaccccacaacagtccccagagtgtgatgttccccttcactttatcttaccttgtgaccgttctgggggtctgctgtttttctcttcccatttttctttgtcttttcttgttctcatttctgggtgtctccaagtctgcttttttttttttttttttttttcttttttgagatggagtccgctctgtcacccaggctggagcacagtggtgcgatctcggctcactgcaacctcctctgcctcctgggttcaagtgattctcctgcctcagcctcctgagtagctgggattacaagcgcctgccaccacacccggctaatttttgtgtttttagtagagatggggtttcacctagttggccaggctggtctggaactcccaccctcaagtgatccacccgcctcagcctcccaaagtgctgggattagaggcgtgagccacgatgccaggcctaactctgtctttttcatagactctgtaacaaacccattttgttattaagagcaacgctgtagaacaatgaaagagtccaacttagaagtcctgctgtgcccttttctgggcacctttttaaagtcacataatgtctctaacttgtatcttcagttaagagcgagggctttggggcagtggactgagtttgaattctggccttgtccagctgtgaggccttgtgcaagttacttaacctccccgaagtcactttccttaccagtagaatgggaatcattcctgtgtctctacctgtctactcgattagatcttggaaaaggtctcctctactcatggtgtatagtcaacaccaaaaacaaatacctgcaagagatgaagggtcgcttatgtttttgactctgtaatgatttcaccaggagaatcctcagtatacaagtaaacatccactaggcatggtctttatttgcacagcctttgtgctggctcaggttgttactctgattactgatttttcctcgagaggaagtataacataatggcttagcgctcagacctggaagctagattaaatcctagcactgcccttactagccatgtgatcttgggaaaactacttaaaacctctctgagcctgtttccccatctctaaaacgggcttaatccagagtatctaccccataggttggttgtgagaattaaataagctcttacatgtaaagcagagtgttttggcacacagtgtgcagtgttagttggtattatcatcttcagggcatctctaggggacgaactccaaaagccatgggtgcgtgtgtgtgtgtgtacatgtgtgtacacacgtgtgtttgcacacacattcacgcacgtgtatatgtgtgttcatggcatacagaagtctccttgcttctttttctctctccagagatttaattatcaccttcttttttaaagagaaaactaggatatttacttcagtggatgctttaaggcccagaatttatatcagaacccttgcttctactgagctaatcttgcccttaaacttctatgtagtgtttcttctgtgaagccacagttctatcattcctccaggaagagattgaagtactcatggagcatctcctgtgcagaggcagtaggatgggaagccagcataggttctccctaaaggtagagtgagtgaatggaaataactgggaagaaaacagaaagaaaaggcaaaaaaagaggtatgtatgaaggtggcaaacagatatcttgggtggtcatttccattttgctgtggtcttcatagcatggcctgttaccaggcaataaatttcaaattgttggtgtggaaaatgtgataatgcaaaggaataggatcctttgctttcattatttcaaaaataagtgccaattactctcaaagacagggtaagaagtattcctggagcaagctggaatttgtccctttgggagccaaggccacagcttctggtactttgcacacagacctgcagtcccactagggaggggctgctgtgtctgcagccaggccgatgccagcctcacatgcccaccccttcctggccctggagccagctctctgtaccactccttatgttgctctttgctcttcccttcatctttctcctctattttccttctctcaccattacagagaggtcatcctgaagtgtctgggctgcagtaggagctgccaaacattcacgaaccaccacgttcacattagatgcagagataaaactgcacaaagtctcaatacactattttgcatcactcatctgggacaaagtaaaatttttcaaagtcaactcaaaagaggaaaacaaaaggtattgcaaatctgttctctgttaggcactgagttagtgctggtggataagagaccttgtgcccaaagagcttgcagtccggaggggaggcagacaggaacacaggctcaaagtgatgcaatgtgagaagtattgggacagggctgaaaacctaacccagcacgaagggctcaggagcgcttccaggaggaagtgacccaccagctgagctctgaaaaatgactgatagtcactgtgtcttgtggaagtttgaaaaccaaagacacttctgctaggtaacatccactcagcattgtagagacccagccgtttaactttccaggtaacatcagttgttatatggctatgtgcctggaatgacacttcagacttggccattctggccacatagacatggcaggcatgacctccatttggaattaggtccatttacttctgagtcacattggaatgcagtttttacagtggagcatttgcagcctaatgatcagtgacttaggagttttgggggtttttttttgtaccagttgttttgttttgttttttgacacaggatcttgctctgttgcccgggctggagagcagtgacacaatcttagctcactgcagcctctacatcctggcttaagcaatccttccacctcagcctccagagtagctgggactacaggcatgtgccatcaggcccagctaatttttgtgtttttagtggagacagggtttcaccttgttgcccatgctggtctctaactcctgggcttaggcgatcctccctcctcagcctcccaaagtgctagcattacagtcgtgagccacagtgcccagccttgggggatgttttaaggcaatttctttgttcttcagatgtattcacaactgttccgcattaaataaggccaaatggcaagacagctctaaaacgccagcagagttgctaggtagggttgtacagactgttcactgcacaagtgtgtcatgtacctgtgtgtggcacagggcttgtctgcccacccacaggaaggagcacatttttttctaactgatgtgcaaagctccccaaacccaacgttatctctgagtcatgtgatgtttattagactatggcagtcatttctacatttgtgcatcttataagttgatttcatttagactcttgcaaagtttttgtactaggcctccatcaaaagccagttctgtgtttttgtggattttcctcatagataagcagagatgatagacatggaaatcttaaatatctggtttcttgtacccacagtgtgctactttgggctgttgcacaagtcagtctagtttgggaactgtgattccccaggaattaaaacaagtattcccagcttccttctgattgctggattagcagaatttcctcagcctccagctgaattccagcccctgggaagaaatgtcttagagtaaacccccagcctggagcctgtcagaggttgtgtcatgtgtttgcattagctgagcaaaacccgagcaggctttccggccttgctctcgcctcctccctgcacgcctctccgctgggagaggccagttaaagtctagacactgtctgcttggctctgtgcctttttagcacaatctgcatggttctgtagctcttactttggttgtctgtcctcactcgtttccccagttttcttagttaggcttaaactgtcccgggggactggcaacgagtcgcacacataggaaacaggtgagtgaatttatgagactgtcaggattcagctgccttgaaaggttcagagtgaagatagcagcagtgctgactgaaactgtggctgagtttacagacatccctggtgtgagctggcttcaaacgaacctccatttactggccagagatgggctgggatgaataactcaggacagacagtggcaccccaggtaatgagcagccacctgactcctcatctgccaaatatgggggttagagtaggtgggctctaaaatgcagctttgaagtcctattcatataaaaggaggcggatattctaggctagactgtcaaaatattctacttaatggaattgggatatttgattaactcttatggtgatttacagcctagtgaagaacagtttgaaagataggctggctcaagaatgagaaaacagagtgaataaaaacaggaggcatcttgtgtcctttactttctctcgccatgtagtgagtggaatataaacagtacggcatgtggcacctgaacagtcttcatgcccaggaatcccaaatgctgtttactctacagaaaggaatcacttgattttccacttcagaagccaaccgctcaacaacactggggaagaaatgaagaatcctgggtctccttgtagtcgatcaagaaattttggggggaaaaagggaagacaacccctaattcagagtgtgcagtttgggatttattgaacttacttgaaaaacaaaagcaaacaaaactttttctcgcttctgtaaatgttcacattttcttttaaaaataatgatgcagtattgcaaatggcttacagaaatagttgtctgaaactattgcgtggaccctaattttgttttctggaatccttcttattactttctcatcatgttgcctggcccatgatcaggatccaggggctcctgaacaagtattaatgaattgcctgccctgctcccctggccctgatctctggtcagatcaggctcttactacagcccatgggcactggtctttggctttgacccaatggttaaatcaagtgacttgttagggtgaacacagtaaggaaacagaggccaatgcagatgttttagtcctgctgaaatgcttggtaccttgcctgtactccagttcccgaatctcactagaaaatcccaatgtgctaaatcgtgctattgatcctgactggggagccagccagctcaatattggaggtggcttttctagtaagggtacagtacaggttagaattgaattaaattttgctgtgccccagggtagactatatgtgtgtgtgtgtgtgtgcatggatatgtgtctgtgtacatacagaatacacaaggagacatgcacacacacacacaaatagacactgacttaaatttcaccactaggagaacatggccatctccctatagctctaatagtgagacttttctcacaaaaattcctgtggaatttgttttgttttaatttagtttagtgtttgacttatgttatactgccctgatttctttctaagcctaggcacataaaccagtgcttatttttatggtgtgaagtttgcctgttaatgaatttaataagtgcatgtcattcattcactcattccctaccatattccaaaaataagacataggttttccctccctaatcccacagccaacatatcctattagcttctgtaagggttgggctaattacatgtatttttagctattgagagggcccaagtttgtagtttgtggcataacatttgtgacagagaaaaagaaaatggacgggacctcaaagatggtccgagaaatttctgatccccttcacacatatacctggctcacctaaactgtagtgtgaaattgatacagtggaatttctatcagagaggctaaacactattgaaacagaaatacagatgctcaccctgagcaaagactcagacatactgagttccctttactgtcagggtccctaccaggagggcccagcatggcttcttggtggcccagccgagctcacaaaacttgctttgggatggaggcagatgtatgcttgccagtcattcacaaatactcggagcacgcagcttcgcttctcccagggcaccaccatccctggttttgcactatgtgctataattatggtgctacagggacaggctgagtcctatatcagaagcaggaaattcacctggcttctccctagagtcccagcagtctttcaggaatgtgtctgtttgtgctttgttccccttcctctagttttccctccttgacattttctattttctttcctttcttatcctatgtggccttggtcttgctgacagccacatgcagagatgcagattttctggtttagctatttattttaaggagaaagacattcactttatgcattaattggtgtctgcctcctgttccacagaagggtaattttctgtgtggcaccaagggcttgatagtgatcaaagaaaaccccagttcccagtaggaacacacttcaggtgtgagtccattttgggtttctcaatctcctttcttgggagatgaaactagaagggagaatgggactgggaaatgttttgagtagaggccagacattcaagtcttggctaaatgttgggtataataatttcagtactcactgcagacttatttcttaataaaactccccaagctacttgtggaccatgttgttttaaaggatagttacaaagttaaccgcttcctcttacagatacaattggagaagagtctttgtgttttttcattttctacaaaggaacatatataagctagataataagaaaccatgttggggttgtttttgtttattacgtgtcctattttagatacttttttttttttacaaaaataaactgtgatagggatatgaaatcctgtaaaaacaaccagcgcttgaggatgactaccccactatgttggtcattttacagcttaggtaattgcgtttttcctccaaattccccatacacatttgatcaaatagaagtctcttcatttcctgtttaagttgctccatggaattgctgtgtggattagagagcaagctgggttcctccccagtggctgtgtttccgttggttgattgggttattttccaggtaatgctataattattttgcccagtgtaaatggcattgtcgtgtagtgactgaaattactcatgttacagtggcctggaatgtaaagacttcctcattctccagtgatttgttgtttgactctgactccaggaaaaagtcttttctctgcctaggctgaagtgtgtgcatgtatttggggctcagatagatagctgaggctctagactgccagtctgtgggctcagatgtgacagtagccatattcagaaagtcatgacagtctctgagaaagagacaaaagttaggaattgtaagcctaagagtgttcaaagcatgtaatgaactgtccccaaatggttcttgtcctagaagtgggtagaacaaataaggaggaggaaaatagtgatgaggaagactggaagaagggaggtggtgatgcacgtgggaaactctgttaattttagtgggttaagcaaatgcagatgaggcaattgagtgaagaatttctgttaagtgcttcatgagaaaatactgtgagtgaacactgcagatgtatatgatcagaaaagatatatcactgttttttgtttgtttgtttttgttttgagacagagtctcgctctgtcgcccagactggagtgtagtggcaggatctcggctcactgcaacctctgcctcctggattaaagcaattctcgtgcctcagcctcccaagtagctgggattacaggtgcctgcaaccacgcccggctaatttttgtatttttggtagagatggggtttcaccatgttggccaggctggtcttgaactcctgacctcatgtgagctccctgactcaacctcccaatgtgctgggattataggcatgagccaccgtgcctggctgttttttgtaagtaaatgtatgctctgtaagcacaactcacaaatgataattaaagctgtaaattaaaatggcacctgtacatagtgtgtggcaagggagatgatgtctacaaaggtgcctcccacaaggtaagtactcaataaatagtagttgctattgttctccttgttgttatggcttgaattccaaggaacggtaataacaccatagggagagacatgaagagcctagacccaaagtgtgtagtgagtgaagtccatatatgtgctgggttaaatggttttttagttagaggatgttccagagttttacaaagttcgtgtgcgtttatgactctagaaggaagtataataagtaatgtttcccaaacattttaccacagaacaccatttcaaaaaaggccataaatatttcaaggctagtgttccatggacagacttcccatgaacaggatctatttatatgtgaccccaggtcttagtggccttgctgaactcacctcataaactaagtttcctcaggaaggcaagggacttgtctggacccagagcctgtctcagagaagatcctcttggtagtgactctagaatggaccatcagcatggccatgtgcacacctacccagaactggctgggcttttggatatcaacttatgtacccaggaattttctcttttatttttcactttctctgttcatacccagtctatcagcaagtcctgccttctgtactgtcagaatgtatcacctctccattgactgtcctctgtccccaccgccaccaccctagccaagctgccatcattgtgcctggactattgcaatagcacctagctgctctccgctttctctctcctgcgacctggctctttctgtacaggacagcctgagtaatctttgtaaaacacatatctgatcatgccactccctgagcaaaaccccccagtgacatccattgcattaagaataaaatacagacttatcagtacctttaaaaccctacatgctctaccccttgccagcttttcccagcttacctcttgctgctctggcttttggacccagtgctatggctacactggccttttctctgttccaggaatgtaacaaattccaccctgcttcagaacctttgcacttttctactttcgtctgaattgctctcatccttcaggtcccagctcaagaaagcattccctgaccactcaatctaagtggtgccctctctcccagagttctgtcatacatactctattttcctctaaacttactgatcacaggctgaaatgaacttgttatttttgtttgtttattcaccttcctccctctagagcatgtactcctttagaatagggctttgtctctctcattctgcaatggatctctaatacctagaaccagttgtgcttagtgtatagtagatgcttagtaaatattttttgaattaatccactagctaaatggattaataaggccaaatgtctcatatgtaatacgaagaggtgcctacaatctttgtatcttaatgatagtcatctctgtgccgtattttgcaagaatgttgtgcatctgggaagatggttgacagcacttgcccgtcaacagtttgcttaatcttggacatgatagtagtgctgggcttgcttaatcagacacctggattctaagtctctcagtcccaggtgaagttggaagttaagcagaggctagctgaatagtaaatatttttattgtttccttccatgatcagcaattttaatataacttggcaccattcccagaggaagctaatgtcccaaagaatatgaaataaagcattaaattctgttgttggtaattctttgcccatagtcactagtcacctttgtctttggacctcaccttttgctgaagcctttacttttttggatccttcctgctgttactctttctctctggtttcatttgaatggcaactgtgatgtttccagtatggataaaacaaagcaaaaggcattcagtgtcactggatttgcacattaagatctcagaggcgaagtctcattctggggaacgttccaccgctaacacagtggacagcattgagtgaagtccctgggggccaaccacctccacttacctgtggccttaactccttaagtcagagttcccggacttaccatagcatactacttcatttttcagtggagttgggagttcctcagggtgaccccaaacagttaaatatgtggcatttctccagtgtttacacagttaaaatgaaggataccagagctgtgagaacaatattgttacatgatacttggaagtgtttttaccacaaatgataatctatccatagcaactaagctagtacatttttgtgtagagtttctaatgcagtccttggggaaaaacagaatgaacaaaaaaggaggtctttgtgcattgtgtacagcttgagggtctcggagggttttaatttctgaaaaaataggggggaatttgttgcagcggaacggaatacctggcagtccctcattggtgggcctcctgtcagccaaggcctgattggccagcataagtaggttttacagctccttccccccagctgtgacatcccaactgcttcaaggaaagaatgcaaggcaggaatgtctcaagaagaatagaatgtgcatgttttcattgactttaatctcaaggcactgaaactgtgtttgtgtgtgtgtaatattgaaagctggcagtaagagagtgtagcagtcaagccaagaaaatgttttaaaaaggttttgaaaagatatatctatctcattgccaaatttgtccatggatttgtatgcccccaaaaaagcatatttagctaagagaaggctccaaatatgtacagcttaattagcccttttgtcattgtttctgagctgagccataaaaagtcttacagagaggaagtaccaaacattttacctttcttatagaggagaccagaagggtgaaatgacttgtccacaggcattgaaaacagccagaattcagcctaagtgcccatgacgcctgcctatttttgaaggactaggtcctcattactcagtatcctggtcccagatgcagcctgacatgctgccttgcctgtatgttcagataatctctattgacttcagttatacaccacttgaaaagtattccaagttaaagaaggtcgtcctctttctcctcaaaccctcctcctccgatgcagtgaggtcagaactcagaactatttttatttccttttttctctttttcttttttttttaagagacaggatcttgctatattgcccaggctggtctcaaactcctggcctcaaggaatcgtctcgccttggcctcccaaagtgctgggataacaggcgtgagccaccgcatccagccataactgtttagaactgtgctgttcaatgccgatagctactagctgcagtggctattgagcacttgaaacgtggctagtccaatttagatgtactgtaagtgtaaaagacataccagattccaaagacttagtatgaaaaaagtctaaaatatctccatattattgattacatgttgagatggtaatattttggatatattttcttaaaataagtgattacacttaatttcaccttatttcttttgagtttttaaaaggtaccttccagaggccgggtgcggtggctcacaactataatcccagcactttgggagaccgaggtggtggatcacttgaggtccggagttcaagaacagcctggccaacatggtgaaaccctgtctctactaaaaacacaaaaattgtccgggcatggtggcaggcacctataatcccaggtactcagcagattgaggaaggagaattgcttgaacccaggaggcggagtttgcagtgagctgagatcatgccactgcactccagcatgggcaatagattgagacttcgtctcaaaaaaaaatgtacctactagaaaattttaaattctgtatgagatgggtattctatttctgttggacagcactgctctagacagttgtcacttaaccatagccacacattgtcttgagttatctcttattagattgtgttgttctgttatttaaaattgcatatattcattcccctagcttctcacctaagctacaagctccttagagacacagagtgtgctttactcctccttgagcccctggcacttggcatgatgtttggtatgtttttgattgtcctgtatattacttatagatttcatctatttccatgttagatattgataaggaaatgcagattaatttgtgtttggattgttgcttttcttttcaaaggaactgattttatgtagttcttagtttgttccacaaagattaacattcctctaaactggactattaaaatccaggggacctgtagagggtgccagaacttcctgacacccatgcctagtagagaacaatggtgttaaaattgatgcttacaggttttaaggagcccctcctgaccaccccagaaatcttgagaagttccaaactcagctcagaaacttgtgctctacttttcaggacctgtctgagtaataggtgcaataaattaggcatgttggcccagggactcccagccttaaaccagggttgagaagagggtcaccaccagcctgagtcaatgagtaactgtcaggaactcctaccagatggctgtgattcccaaagtctctgagaaaattctaggagacgcactctgggtgggccttaccctttaaacatcctgcaattttgtaactgagcctgtggctgaaccacatgctcataatatctaggctggctagcttatgcctaaaacatagtcatttctgctggtgctctgggagagcctgatctttccctgatttcatgactacaggatccctgtgccactgttttcagttcagatgttaaagaatgtgtaagaatgcactcctggaaaccactccccttcaggggcagatatattaggtctcactgctgtggaatgatcccactccactgaccactttattgctgtaaacagtgaatagggaactatctcccttaggtgacaaagtgtgaaatgaatgattgtctctttagaggagtagttggaaggatttgtaatgatcaagacttagaagcaaagatggtcccatctgctgaggctccccagcttcccagcagcagaaccctagaaaatcctcctgtggctgttgaatcaagggagattaaggctacaaaaggcagttcatgcccagagcagtaaattagggtttgtctttcctaggttattgggtttgggtttgggtcttttgagtattgaaaaattcatgcccccttgaaaatccagtcccaaaatttatggatgggtttctgggggcccatagataccaggttagcatcctcactctctaaaataaaaaccacaaattttcccatcccataggcagcctagtaattaaggtgaccatgtgtcacagtttaggcctgttgtccaagtgtgtctgtttaaaaggtttcctttaactctcaaatgtccccatttggatgataaaatatatggctgaaggccacactcatgggtgctccagagtgatgcataaattaaacttgcagcctccctcactgatcctcactcagctccagaaagccccagagaccagagattactcttcagcacaaactctcctctgagagttcctcattccttcctttggatgccctctgaagggagcccttgatgtgcatttgaaattgctccaggggtgggaatggggattaggaggaatttgagggagagggccttctagagcctgggcgtgggcaagctggaggagccagccatgaagcccaagcatgatgaacaccactggcatttccttggaagactgtattcctcggactccaggttttccccactttcttcctggccagcagttgctgtggcaacacaatgtctgagaacttctaattacatctgtctgcttctcctagaaccctactgagccacacatatggagacttcatttagctttgagtttcttgctgggttttaaccctgtctgcatccttaggctagagaataattgccaggatgctggaaccttaactgctttgcagccacactacccccagagattcccaggactttgtccctgttttttgttgttgttgttgttgttgttgctgtttgttttttgtctgagacagagtctcactccgttacccaggctggaggacagtggtgcaatctaggctcattgcaacctctgccttccaggttcaagcgattctcgtgcctcagcctccagagtagctggatttacaggtgcaagtcaccacacccagctaatttttgtatttttaatggagaggggggtttcaccatgttggccaggctggtctcaaacttctgtcctcaagtgatccacctgcctaggcctcccagagggctgggattacaggtatgagccactgtgcccggcctgtccttgtttttaaagtggagactggtgctactttgctatgctgggtctcccagatccattttgtttcagtcaaccctgacatccctactatccccccagcctccaccattgtatcagatggtctcacctcttggttgggcatcacagttcttactaatgtgcccaatccaaggggagataaaccacgtgggcacacctaaggctttgctgtcccggcaactcgtgtttcagtgtattccagcccactgcaaggtcagcctagtggatgagacagaggggagtagttagagatccccagaatattttgggagtggaggaggggtagagcaaggcaagaagcttttttcctggtctagaaatgttggccagcctgtctccctctacctcagaagacagtgtaagggcggggttcctcagaagagttcacgcaaagcactggcctcagataataagcccatttccacagtttctcctgccttctcacttgcttctcttcatctctacttccccctagtataggcccccaaggtatcaggcagctctttggctgcccctaccctatactcagaaatctcacccaattttgctttgctctgagataccccacattcccacattaccttatcttcctcttcaccaaattctcattctctcagcatgtctcagttaggttaaatatttaaactgtggacaaaggaaatgactgaaagccattttcgtcctccgttgctcttctacctcattaacacacatatgcatgcacacacatgcacaaacacactcttcaatgtctttctgtgggcctaagacaatctctaattagtgaaattccaggctgaatatatatggcctggtggtggagggcagggtctttagggtatttcctcaaagaagaccagttctgggagggagcagccccaggaaaggagttggcacaggtgttgttcctctctgtccctatcccaagtccccagggcagtgtggttcaatccacctttttttgctttcaacaaaggttaatggagtggcacaaggtatactaggtcctacaaaaggatggacaaacagaatctttgtcctctaggagcttgtagttcagccagaaagacaaaatccacacagtcagttctgtttttaaaaaaataaatgatcaaaatgagttcatacaaagaggaatcaaagttcagagaaggaagggggaattcataccagtagaaagtaaaaggtcactgaggatggagtggtgtaacttgacccaagccttgaaggacagggagaatttgggcaagccagacaacaaatcagacttcccagatggtgacattatttttttaggtggtcttgtgggacattctctgcctatctgaaggttaaagaagcatctgacaattcctcatcatgctgacattttcaaaggctaatgagttctcatttcaaaacatagagccttgggagccctagaccctttttttaaattttagtccacttacagcttaaatctgctgtggctacctgctctgcttacagacacttcccaaagctttcagtatccagggtccctaagaagtggagggttgctcgaagtgaggagcccacagatctcgaggctacatgaacaatgaagtcacccaggagagaggaaaaacgccctgtgccatatgccaaagactttgttaacagtgcccaggtagaaggcagtaggtgacagtgtcgggcatccaactcagtgccagggcatgtggaccaccgtcgagaatagtggcttggcttgcaggtttagggggaatcatgtgcaaattggggtaatggaaagcagccacagaagtgatgggggtactgttccagctcagggaagcaagcaagctctctgccacagtggattctattcccagcaggtctgtggtatcaggaaccacccagggactacttaaattcagtggcacccaaggcaaaaatgggtggagtggagaactagatacctcttaggcgatatccatctcatctgccttccaccatatcaggggaataaatcctacattccacttggaactccaaagaatgcaaatcctaatgggttcagggcttgggaagctgggggtgggtggagggtgggcttgcatgggatggagggatgggaatgtgtagggatgttggcccagatgtggcaggcactgcaggggatgcttctaaaactgcctgtcttgagaattttcccacagctgccctagagctttctcccttctttgatttgaaggtactgggatttaggtgtgtgggaattttttttttaaacttttgatcaaccattttccttgaactacatgtggaaataattagagcatgaatgctgagtaaatgtgagccctggcagccccagacatacttcagtgacaggttcttggcaggaatgaagaattgtgaatcgcatgtgaatttcctttagcctttctctcctttcttttcttcccttttctccttgcaaggcaaatgcaagtagaataaaaaatttattaatagtattctaggggagtagagggttccacccagttcactagaaacaaaatcaggacactcaattggggttccattactgcttccctgattccctctgccatgatctgggagggaatgaaaaggcattgcttatgagaatcctttgactatgagagccaactttaatccccccttcagaacctagcaacaccctcatgtgactgtatacataaccactttctttagtttggccatttaggttagcttccttgggagagtgaagtttgatattcaggaacatctgaagtggtaaattcctgagctttctaattaatagaattcttacagcttaagggacttaggcatcatctataacctctgcattttatagctgaggaaactgaggcccagagaggtcaagcaccttgccccatgtcacaccatatgttagaggcagagatatatccagggcccatttcagtcctcctgcattaattcttcttacacaggacatcactgcctctgcctggcttacactccaggttactagttcaggtttcagcagaagtttaaaagcttttttttttttttggctgttttatcccgacatttgccaaatgatttctcttacatggcattcatcatccatttctgggagctctctaggcttcctggttttcctcccaattctctgaatgttcctactctactctcggctgctttgctgtcagagttctcataccattgtgcaggctgttgactgcatgaggaggtgacaggggctgaaatccaaactacactctgctagccaagccccataccctggccatgtgctgcatctcctggagagaaaggtgccttttctgatttgcacagagaccccttgtgggctgctcttcctgctgtctgtgctcccccttttccttccacgccctagccgccctcggccttccatgcccacctttttctcctgagctcatttgttcctctgcctcaatttctcacccctacacaggtgacgcccagatatgcatctttagccaatattggcagctgtcggtgggatgtttcactgtccttgagacgcgtccataactgactcatcattgcccaccccaccctcacgggacacctttcccagacttcatttctgatagagacacacaaccaaccctccaggccctagaagccaaagatctggcagccccccagactctctccttcctctctctattcaggatgttgccagacctcgttattctgtagagatctctcttggatcccttccttctataaccatgccaccactagtgtagatgcaactgtcatcaccccaggcctgttccaactgatatccttctgcctgcccccaattccgccttacccatttcttgccatgtgccactgttcaaatgtttttcttaacactctcctgctcaaaaacctatagattttccatccacatcctacctttcttaagagctcggctcaagtcccatctcttctatgaagtcccatctcctggagtcggccccattacttaggactgcattggcctgtattcttgtttcatcagctcaactaggttagacactcctgtggtgggggcagccacatcctctgctcctttttgggttttttgttgttatttttagagacagggtctcactctgtcacccaggctggagtgcagtggcatgatcctagctcactgcagcctcaaactcctgggctcaagcaatcttcccacctcagcctcccaaagtgctggaatgacaggcttgagccactgcacccaggcctcccttttgggtttatgccacggagcttgcgccatgctcattacagaccgttctctttttttgttttgctgttacaggcattcatcaaatagcattttgatgggtttaaatcattttccttggccattactgaagaagactggaggatttatactctctacattggccttcaaagtggacaagtcttaggtagacaattggagaggagaaaataagaaccatattcaaacctaacaagctaattcagggcagataaatggtctgtattagaaacttccacttggactttcctaagaaaccgaagggtgaaattatgaaactagtggcagccttacaaaaacattttttaggaagagtgacaagatatcttgggaactcctaagaatcactctgaggagtgttgctttcataatggggagcccgaaagaccctgtcagtagcagtggagtcactgggtgttcctgtgttgagaaggcggtgtggtatgtcacaggggagactctccaactcgtcactgtggaccatgagaacagaagcacctctctcaagtaccggagttggagccacctgggtctgactcttacctcagtcatggcccagctcttgaagtcacagtctcctcagtgcaaacagggatgaatccctgagcctcacagatctttgtgagatgattttcagccctatatgaacaggcctaacatgtttctaactctgtaagtgcttactatactgctatacttctgctatgactagacaagaccattgcagaacacaggaaccgatcattctatagaaaccaagcatctagtgtgctatgctgtgtctgggccacctcaagaaagctctaagcataggcagcatgaggcattccagagatgacatgtgagcagcagtgaaggagagaggcttccgtgtgaaggtggcctgagccaacctagattcttcagtctgaaaagacacatagagaatgtgacagaatctgtaaaataataaagaaaatggtggaggtaaacatcactgtcccatttgaaatttgaatatagtaatttccaggcacacaatacgcaatgagtagtaaaaggaacatgttatatcccataagctgtgatagaggctaaacatagaaattaatcaaagggtaattaaataattcttgattgaccgggcacagtggcttaggcttgtaatcccagcacttcggaaggccgaggcaggtggatcacttgcaatcaggaattcgagaccagcctggccaacatggtgaaaccccatctctactaaaaatacaaaaattggccaggcatgggggcgtgtgcctgtaatctcagctactgggaaggctgaggcaggagaatcgcttgaacccgggaggtggaagttacagtgagctgagattgtgccactgcactccagccttggcaccagagcgagactccatctcaaaaaaaaaaaaaattattgattgacagcttcataatagatttttttaaatcttaaagctaatcttcgtcaggcgatatatctcttatctggatgtcatggagcctggccatactgacccaaaaacatccgaagtgccactgttggctgctgcactaacctgaagagactgtaaatgacattttaaaataatttttgtttatttttaagcagctttattgagatatcactgacatataaaaattgcatatatttaaggtgtacaaatgttttaatgttttaatattcatatatatggtgaaatgttcaccataatcaagctaattaacatattcactacctctacatagttaccattttgtgtgtgtgcatgttgagaaaatttaatttatgatctatcctcttagcaaattaaaagtatacaaacagtattattaactatcatcgccatgctgtacattagatctccaaaaattactcatcttgcataaccgaaactttgtacccccaaatgacatttaatatacaaaccatttgttgagcattttctcaggcagtacactgtggtgggtctgggggaagctgaagtgtgcaaggctcttagagtctacttgagataagccatatgtgcatcagatattgaataggactctctctaatagactaaggacccaaaagccattattggaaagattttgtttatgaagaaaataatagggcaaatggggagttggattaccatgaagctaattaagctttgatttcagaccttttatttgcaagggtcttgcaaggccatttacccaatttgcatttataattgtatatttttttagccctccctaaaccatttaagcttgaggccccacaaaaccagggtttggccctagtgcattaaccttgagatgagggactgattgtgagcacatataaggaagggaaacttatagcagggactgcacacatgcagtgccccctgccacacacatcagaaccactgctagaaatcaccagtccctcctcctctgtccatagcatatgcaggatgtaccaacacatttctttccagaaaaaaagagagacttgaacaaggtcatgagatactccagcaaggtttcaaggtcctgaagcggttttgctctttctctctgcttttctcaggcctgtgctactgggttccagaagagctgcctgggagcaaccagcatctcaccccatacgccccactgcagacctccccctgctctccccagttctgtgaattcctttgtccccagctccatggtattctgtgtatatctgaggggccctggtgttcctgtgaagtttccatgactaattctggcaaagcaaagagagcctttctcacgtcaacaaagccactctgtcgcagaatagtggcaagtagagccaaaattccaccttggcataagtagagctgttcttttttaaaagagttggaaggaggaaaagaatggaggggacagagccggcccacttcatgttagtgaaatgatggtatattaaactgacagttttatggctttgcttataagcttcctttcctgccaaagcacactgttcttccagaaattattttacttcagaagacttttttttaaacattcaacgtgtattttatgttcagacttaattctggttggcccagagactcagatgcacgatcacctctactggtagttttgcaaataacttgcttctccatttgcttgcaaagatcttttttgattgcaaaaatcatttccattttttaagaccttggattcaagacatttcctggctttgatttgtaaagaggtagagtggtttagtggaaagaggctgggattaaagtctggagacctagggccaggcctcaattctacaactgtgagatcttggaccagtcacatgtagctgtgagcctcagttttattttcaccataggatcttaaatctagaagggcctcagaggtatcccctgcctgcctatctaaaaagaatcaaaaatgacagtaaaattacagatcaaccagaattgctgtgcaagtatgaatattgccattcaatggctgaccgttgctcagatactttctacctagtaaaaagtcaggaatgttcccagtctgtcttctaccaaagggagtttgcaatgtgaaaattaatgagaccaaatctccagagcttggcttgcaacacacgaaatgaaaacaacacggagactggtcaggaagatgatgcagaaggataaagctagaaatctgatgtttctccattgcaggcagatattttgctgatttttatcaatatatctgagtgtccacacttccaaaacacaccctctacccccactcaaatcaattacattctcacaggtacatttagacttataggttcatacttttgtgatattggacctgcctgtgacctcatactcctagaaaacatccatgtgccaatgtggttatctacgcatacatgaagtcctcatactgctttgggacctcattcctaaaatcattacagtggtagaacaaacacttctatttgcaagaactgcattgtaccttgtgacctcaccctgtgccagcccttggaactgtccccactccccaaagctcactgccttgattgtaccccaagagggaaccttgaggctctggagtcagactggcctttgttctattcctgagtcagctctcactagttatgtggcctccatgcgtcacagagctttcctgactctccgatgcctctgcatctgttacatgggactaaaaatacagagacctgcacagaggttgtgaggacagagatatctgcagagcctcactcagctgaaggtgctaaaattaacattggccctgggtcctaggcccttgtcatccccgactagattacagtcttaaacctggccggttttcctgcttgcagcctctctccatccaggctgccttgcactttgaatcagaatttcagaaaggacccaacacaaattaacattccaaagcaccatatccatcatgttacctacccaatcccaaaccttccaaggttctcacttctcatagtcgctgtggagagcccctcaggtcagccatcgagcgccacccctctccccatcatcacctgccaccctgcttcatctccctcttcctcaccacgagaagggttgaacccatgagcatgttcaacccctctcaaggtgttcttttcccccactcagaatcagtttctcagtagatgggtaagactacccaccaccctaagcaactttctaggcacctcggggatgcacctgacactcccactcccagagaagatgaggcttggagaagagctttcaatggcacaaagcctatctctctggagaaaattttcttcattgttgatttctgcatcaaagcatgcctgtgaatggggatcactggggagggctatgaggctgcaggtgagacctcccccacattggtagatccccctacccatgtttttggagcagccaccctattcttccacctcctgcaccacttcttgttccgaggacagagctgggtggagctgcaggagccaacactgcgcttctgcattgcagtgctgggctgtgcaagacagagagagattgccacctattgacagacgtgtcacctgcaaagaggaatgattgtgtaactagtggctccccccttctctgtgtgctcttcaaacgggccttttgttttttccattcagtgagtccttctgttctctattatcactgcagtgcaagggaggacagggaaaaacggggacatgacagcccaaggtggtagtgacagcatctcagtgggaaagttgtctgaaaataaattgcccactgtagtaatagccactttcagttgtgtggcaggcactgtgctgcctgcagtacatcccgtttaatcctcacaacaaccctctaagaatcagtactcccagttttcacgaggaagctgaggtttaaagagagcacctggcccacgaccagcaagtaaggaatagaggtgggatgtgggtaatttaaacctaaatctctgacgcactcttaacgcacattctcccgacacttgctaattatgcaactcacacccccatcataatttccttacgtcatctggatatgaaaataaatcaaatataaactgctttccctttgggcagaattctagctctgccactttctagttatttaagcctctgctctctcacctgtgaaatggggctagtaatgatgtctaacttaaggagttattgaagagcttaaatcacatataataaaaatagtaggatgccggatatttataaatgggagtttagttatcagtggttgaagatacgagttggaatcctagctcctctcatttctagctttggaaacttgggcaagttatctgacctttctggtcttcaatttcctcatctatggaatagggttaataataatatacctattcttgcagggtttccctataagacaaaatcatgtgtatgaaaacattttgtaaattgtactattcaaatattagttgttataactcaaaagttatctgtttcttcaaatggatttttgagaactattcctgaaaaatgacttggtttaattcaatccgtttttaatacttactaaaaacaacaatgtaagttaaaaggaggttccatacatgccacaggcttttctgcaagtagctctataaggcattcccatgaataacaggtttcatatgcagcttgttttacagttggtacttccacatgtatctcactgaatctccgcagggcagggttggcatttacccctactttatagatgaggacatgtgagccttaaagaatgaaaattactagttaaggacagagactagtgagtggaggtttgtgggtgtttgcctgtggagctgtgtgcgggtgtctttgagtgcaggcatgtgtctgagcatgcttttttatgcatttgtgtgtccataactcatgggaacaactcgtcagcaaaaaccttttcctcttcctttttcgtgttgccttacattgtcaggcacagtttccacaagagggccctgcctggagaatatccttgatttttatctccactctctgtttaggaaaacaaaagctctccaatccccgcggacttctgggaattacttcctctttcttccccgcctgctagctttcttgaattcgccttagcaacattcaaaaaagaattggtttatcaacagcatgtgaaccaatgaaatgtgagctgagaacggcttctagaccaatgggagccctgcatgaccagcaagctggcttgggacagaaaataatgacctggagtttgcagagcagcctctgggtggcagcagactagctgtattggatacagcacctcagctcgaaagcctcttctttctttttgcttttttcccctaatcttgagtataaaacattcaccaactataagaattgtactgttacaagacttgtgggtgtgagttctctgcataatgtggtagacatggcctggagggtggactgtctggttccatccctgccttaccccagccagccccatgaccccatcgtgcctcctgcagtctttgttggttttgtcacagcatctagcccagtagccttgagtctggaggtctttcgtgattttgcctgcccagccagtcaggatgagaagctggggaaatcacattctccttcatgcaaccaccactacccctgggttgagtggtgaatgaggtggggctggctttctgccaccagtgaatgggagggaagggatgagccaccaacagatcagtgcctgtcaatacccccacattctcaggtggcatacactgagaccattccctgccttgtcagttctgctgcacacgtctgaacaggggaatgcctgactagcaaatgatttgagaatagttctactttcaggcagcttcgccctcttaatcttgaagacagtggcagacatgggtaggggctaaatgggaccatagcaaaaatagcgaatccacgtttccaatggtttagccatccttcttttgccctttgagatgataatgcctagaacaccattcagtcaggtttgggtccttcagatagtcatagttctgtacaatgtttccatttctgcctgacttactcctctcaccctttaagaatcagttaagacctagtatcttcagaaagtatcctttgaaaaattctcaccctcttcctcccctccagctccctggtgatcctgttcttgcacttcctgtgttgttttccaaatgtctctttctttgtgagtttcctctgagagtcatggagcttcctgaggacagggtctgtcctttgtatctccatctcagcgtagtgttggcataaaattggtgctcaacaagcatttttagaagaaaggaagcatgcaagaaaggaactcttgctctttgagaaacatattagggactcagaagtacctgaacctgggctgaagcagtatctgggagtagggcactagctgttggaggcaacgtctccaacagctgtttaagacccaacatctagctgtttaagaccatgagccatgactccagagcaaagcccaagcctgaaagataatctcattatgggctcattccataatgggttcatctcagtcacacggtttcctttatgattgtatgttttaggaagagctaaggagcaaatccaagatctgtgccaatgtgttttgtggagccggccgggaatgtgcagtcacagagaaaggggaacccacctgtctctgcattgaggtaagtcctgatgtcgggagccagaggacagtggccaaggccaatgtggtaccttgcggagccacccatcagcaggcagtgccaatgatttcattctctttataaaagcattcttcatccccctgaaaaacgtggaattcttattccagattcctgatttttaaagcatggatattttttcttttaaaaaaatttagctttataagattttttaattaaaaaataagaattgttttatataagtcaaatagtacagacatttacacaagcataaaattataatcttcccccataacccttcaatcccttagtctgaagtaaccagcgttaacaatttgatacatgttccacatgtttttcttttctatgttactataagcatagggtttatatgctactgtagacataatggttccccctattttatgcaaaaatgggatcatgatatggatatagatatatacagtttgtattctttactcattaatttatcagggacaaccctctagatcagcacatatacttttaactcatttaactcattgtagtggcataatgtttagtaatataaaagaactagatttattcaatcattttcccatagatggacattcagttggttctttgggttgtttaccactataaccaataacatccttgtgcaaatacccttatatgcccctgcctttatttctgtagcattgattgacaccagggcttgctaggtcagaggatatgcaaatttttaaaaacagtagatgagatgcagggttttttttttttaatgtttttttttttttgaaaaacaaacatgaatatgtatttattccattgtataaaagcaataatttagaaattaaaagaacgttgcagagatctctaaatagagctaaagattttttttctttcttttttttttaatttatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcatgctgccttcaagcgtctgtttaacaaagcacatcttgcaccgcccttaatccatttaaccctgagtggacacagcatatgtttcagagagcacagggttgggggtaaggtcacagatcaacaggatcccaaggcagaagaagttttcttagtacagaacaaaatgaaaagtctcccatgtctacttctttctacacagacatggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgctccccacatctcagacgatgggcggccgggcagagacgctcctcacttcctagatgtgatggcggccgggaagaggtgctcctcacttcctaggtgggatggcggccgggcagagacgcttctcacgttccagactgggcagccaggcagaggggctcctcacatcccagacgataggcggccaggcagagacgctcctcacttcccagacggggtggcagccaggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcacttgcggttaggggctggagaccggcctggccaacacagcgaaaccccgtctccaccaaaaccagtcaggcatggcggcgcaagcctgcaatcgcaggcactgggcaggctgagtcaggagaatcaggcagggaggttgcagtgagccgagatggcagcagtacagtccagcttcggctcaacatgagagggagaccgtggaaagagagggagagggagggggagggggagagggagagggagttttttttttaatgtttaaaaaacaaagagagcctttgataaatacttcttttgtaggctggattctgacaagttctgccactaaagtgaacataaataccttggacattctgttttctgtcaaaacaacccatagcctggaaacacgtctttctgcaaattaaatacaaccaatttagtccccaggttaaggatcctgatttgttgccccagaaaggaagttttctaactcagaaacctaaaagccagatcctactggggatccattagctctgggaggtcctcactggcagtgtacctggccacagtgtggtggcataagcctggacttaggatctagaaacctgatcctaaaaattgtacaactagatgtgggtgagctgagaccaaacctgaggtctcaggagatgctgtgaagacagtgcccacatttggttttgcccgttgcccagcacatagtgagcactccataataaatattggttcactgaaatttgtgtttttggtatcctcaactaaaactggaaaggttgggctgccatccacttccagtgctctgtgcttctttttaccatctgctctttcttgtttcagttcctttctttattggatctgagctaaatttacttcctgcttctcccctttaaaaaccatagaagtccaaagaaactgaacttgcctgtgatcttggcaccttcagcagccaaagcataacctagttgccatatgaactttgttccatttccctgtccataatgattctctgtagtacttcacaaagacccaggcaaccctactcctagcttcacaacaaaggcttgagatcaggaggaaaacaaagtgttcccccaatagtatatacagcaagagatccttacagttaggctgcagaagaattggagtgtgtgtgtgtgtgtgtgtgtgtgtgtgtgtgtgtgcgcgcgcgcgcgcgcgcgcacatgtgtgtgtgtttgcctgcctgcctatcagcctctccacattcccagctctcagctctggctgttttgtgtcattgaatgttggaatattaagggatcttagatcttctgagacattaaattactttttccaaagtgacagagaattcaaatttctggcttttaataaaacgccctttctgctcatttgatgtggggggtgtctttgtttgtttgggctgctataacaaaatatctgagattgggtaattaataaataataagaatttaattctcacagttctggaggctgggaagtacaagattgaggtgcaagcagatttgatgtctggtgagggcctggtctctaacttccaagatggcaccttgcatgtggcatcctcacatggcagaaggcagaagggccaaagggccaaatgctgtaggaagactgttttattcacttcttaacctcatccacaagggaggagtcctcatgacctaatcacctcctaaaggcctcacctcttaatacttttgcattgtggattaagtatcaacatgaattttggagggatcacaaacattgaaactatagagggtgtctctttcttcactgaatagaagagatgaccctggaccaggataggcatgaagggccataggcaactgagacagggtcagttggccagaactgtgactgcctgtgccctgatggggtagaagcaccatctctggtggtggagagtccccttacaaaatggctctgtgtgtgtgtgtgcatgtatgtgtgtgtgtgtgtctgtgtgtcgatatccataactgcacaaacattctcttttgggtctgtttcagcaatgcaaacctcacaagaggcctgtgtgtggcagtaatggcaagacctacctcaaccactgtgaactgcatcgagatgcctgcctcactggatccaaaatccaggttgattacgatggacactgcaaaggtaaggtgtgctctcaccactgcaaggcagctttagccacggggagccaaggaacagagcagtgtggcctggctgaccacatggtctttcctccacgaccacagcctctcaaagctgtggaaagcgcccagttggttggagttgcatcctcttgtcacttatgagcctgctgggtttgccctggatggcccaggcctctgcccagggtttgctatatcagatccccatgggggttttcagcactgtctgcagctggatagtagatagggtggaccccatcagtaaatcagtaacaataagaaagttccttaaatgaattatgtacctttttagaaagtaggtaagtttcacttttcccatgctttttaatttgggcacctctcagtattgtttcctctattttgcactgaaaccactgccattagaataagaaggaagaagtcccacacttgttgctaattagataccagccccctgccaagccatagccctgcccagcccctctcagccttgcccttccttgaagaaacaagaagctgtttcccaggtgattgtctccactccattccctgtccagaatgattctccatttgaattctcaaaatcccagtgacccctcaatgcaacaggaggaggtatgaggccagaagggtaactcagtggccctaaattgtcagacaaagcaggagacagaagatcctcatacctgggccctagaagaaggaaaggaagggaaaggattcaagacaaaatgatgaaaaggttacaaacattcccctacatgtagagcagctgtaatcctagaaatacagaaaaattttcttttttccttcacttcgcattacacgttttctctttttgtcttgcagagaagaaatccgtaagtccatctgccagcccaggtgagtgcctattttttctactgtgtgcatctcagggaggacattcttttcatgatagaaattttgtgttccacaatccctgccaagctcataagatcttctatgcatcagaattgtgtcccagaactggccactcctcaacacagctcagaaaagctgcaaaactacatttgtgtatgtgtttgccaattgaagcagctggttgggtcagaatgttggctgtgttttcccatttttcctgagtagtgattgaactgcataaacaggaaagccactgagttcatttttcaacatcctataagacatgctcgtgtcatgggaccagcaaatagaaggcacaactctttttgaaaggggataactggaaatgccagtaagacttctgtggttttctattagtgatcactaaaattttatcatgatttatagttacagagcttttttgcacatactttccttagattctcacggtagcctttgtgaagtagatcttattgtaattaccatatagatgaggaaattgaggctcaaagaggctaagtgagttttctatatcacacagctagtaattggcagactggggaagaactcccagattttcattcccctggcccagtgcccttttcacccacagcatgtgttgtcttccaggaattctcttttgccaaagctttctctcctctgcttccccatccactcaactctcagcaccccctgttatttccagtggacaacagctgtccagagcagggcttcgacgtagccctcactggccttcacattctgttgttcataataaaggatgatgcaggtggtatacagttgtaagtggggggaagtttggatggacctagttggtgagaaagggagaaactggagaaaatcagaaatctagtagcataaaaactgtaatattctcatttattcatgtattatttcagctcatctttgagtcaagagagctgctttattgattttttccccttcagcttcctaaagttaatgaaagtatcctttattatttttctgctctagttatttctcacataagcagcaaaatctctctgtttcaatattctcaatctttacaaatattttagagatgggtgcttgaatcctgggctagactttttccagttgtgtaccctggatgtgctaatcctatctccctgtgttgctgggatgacatatgcagaaccatgggcacggatgctcccacacagtgggtgccagatatcactggggtcctcccctgactgctccagctgacatcctccactttcctgcagttgtttgctatcagtccaaccgtgatgagctccgacgtcgcatcatccagtggctggaagctgagatcattccagatggctggttctctaaaggcagcaactacagtgaaatcctagacaagtattttaaggtaatccagaggtaggaggaagactattcaggcccatagaaagggaagcttcctcctcccattgcccgatcacaccttcccagaccacaggaaatgtaaacctgcacagacaccctgagtttcctcatcatagatcattcatgaagctgtgaaagttgccttctgaccagcttgatcagtgggagtaagcagtggagtctttgggatctaacacacatgtgctgctgccttcaggcagtgaaagccacaaaggtcttggagaacctgtcagttagggccaagctctgtcccctactcgccatgacaccttatggatctggctgttaatacaaaattccctctgattgcacccagacctggaccactttggcctctttcctgcctagtttgacatttctctaagtcattaacttgactgccaatggcttggagagagtcttcatatgagaagaatcaatggactggcatttcatgggtccagagattgttcctgaacttagatattgctgttcccaatcataattagttgaagagacagagtgttccacttgggagcaggagagatgctattttcacaaagagaaatgaaggaagctataatatttagtgatggctcgggttatcatgccatgcagatctttcacagaacttgagagttagaagaagcaattaagggcattcttacagctgattgacaagaacagacacacacacaggtacatcacactcagaatatcacactcagaagcacagagaaggacacacttaaactcaaaacatgccagacacgcacacacacaccacatacagagactcacatgccacacagagacacatcctacatgcagacacattcagatacccacatttccatgcaagcaccaaagccctcttcactaggtagatgccccagccatctactccctcacatgcttccagggcccaacccagccaggactcaggagcaacttcagacacatgaaggacttttcttggcagctctgaggccacctaatgtggccaatgccagtctagtctgtggatttctctttctgacactatagaacccgcagatgaagaaatactgggttggcttcaaatggatatttggtcatttaagacttcacttgtgtcatttttacatagagatttctctcctctatggcagatactaaatctctggattccaagtttttgagatcatacccagatgaaaaagcacagcctttcttgctctgtcctctctctcaatcactcccacattacagagcccttagaggaagaatggttcctcttctacagaaaaacacatcatagtgctgagccaggagacttggacaggaacagaaagtaatgtaaagaaagtgactgttcaaaagctgagcgaatggtaaaggtacctgcagggcctgctgtgtgtgagcagtgactttgccctgcaattacagcataggaggtgtggggcccaggacactccttcccaggggccacttaggacgttgtaaccattttttagtggccctttgatggcactctgcctcaggcatcactgacacctgctattagatttgattcccaagaacctatgccacattcccctcaacacatctccatctcctccagcagtaactcacttttacaggctcccttctgaaagctataaggccctttgggaaagtagctcttctctaggacattctcacaaccaggcatctaagaaagcttgatcatgactgacagacacaaaatcccctcttcccagacactctggcagtgtctaacaggagaaaacaggtttcattttctactttttgatgattatcagagtcttacatgctgctgtcttcaaagggagactgcctcctcctaggtcagcagctgcctgttggtgagaggtctgatatctcaaagagactgttatgaaccaatgaaatgctccccagcccagctggcatttcttacatcaaaattgttcaaaaaccaaattgaattagaatttgaataaggccaaaatctgactttcaccataaccagtgatgtagtcactgtttcttaggtgaaagcgtaacagaatgaagaaagaaagacccaggtagaaagagccttccatgctcttggaatttggaatctaatccattcctaatttcatctgggtgtgatctcaatccctgtggctcctgatggccagggctgacacttgagccagccttcttatctcctttaccctggcaccacagcccacacagccccagctgctgtgcacaagcaagtgcctgtctcagcccatctcctctgaagagtctccaaacttacattgataagccccaagaacagatctcatgacatacatcttttctgcctttccacaaccctacagttagatagaggaaaagttttgttacctcaaatgctgaaatctgaaactttttgagcaccaacatgatgccataagtggaaaatttcacacctgaattcatgtgatgggtagcattcaaaacacagtcaaaactttgtttcatgcacaaaatgatttaaactattgtataaaattaccttcaggctatatgtgtaaggtatataggaaacagggatgaatttcatgtttacatttggatcccatccccaagatatctcattatacatatttaaactttccaaaatctgaaatctgaaacacttctggtcccaagcatttcagataagggataatcaacctgtatagagctggggaaagaggcacagagagatattatgtctttgtaactgactggctgaagagaggctcaataaattaggttggttcatggtccatgattaggacctcacaggcagaccccccaggcattccaggctatttctggggcaggcaccagaattctgtgttcctgtggattctacatacaactctggcctggggaggcccaactggaccctcatgagttgagaaagcacatgggctggaccttcccccagctgcaggccttattctagtcctactgaagtgtgtgtacacagcactgccttttgagagctgcctggactgtggttgccaggttcatggtgcccacttgggccatgtggcactgggtctgtagctagtgctggacgtttcccctccctacactcattccatcatcaggccctgatgacactggagtctttgagggttgctgtcatttacccagcacatgcaatatttgaactcaagaaagccctgtgctactaacaatggcccccagccaaacttatttaattattttccattaattaatcaagacttcacaaggtaaacagggaagtttcgtcagggaaaattgtatagtgaataaaggacatcagagacctgttcctaggaattaggacaagaatgataagtacgtactaagcaaaggcctaatagttgtttcatgcacaccttcattatacaacattagagtggaacacctgtgacacatggcaagcaggagaggagagttgttagctacatcttccccttctatctagaaatttggatagatgtttcttccagaatcccttgcaccatctggggagccatcttgaaagtaacatggggaagctgatcctttcccagggcagcagcatgagggagcctagggaaaggatttgggaggaagggggaaaatgttattgaaatttgttaggagagcagccatatgcaacttggaatttgatcagtcttgatttgacaccctcctcctgcagctagtgcctgggtgtcttgaatggtcccagatggctgaggtctcagtttagcatcttgccatagagaacagtgtgtgagcttactgcactcctcactttgtgcttgtgggatgccagctgggtcatgagggcagcctgagctggatgatctgaggacctgtgcacacatctgcagtggggcccacagggcagaggagcgggaactttgcatgatgacccctgtctgtagcttattgctttgaggcctttgcctgagttctcactgatgtgatcagttacgggcaccaaagtgaaagttaagcactgagaacaggacaaggaggctggaatcaagcaacaagatttggaatcctataattccaaagtgagctcagagggtcatctgcattgctgctgttcctgagcagctcattagaaacatattctgggacctgctacagagattctgattcacagcgtgcaactttaaactcttgttacatgttcatcagggcttgagaacatgatgtgcaggttggtctgaacccaaaggtatagtcaaaagtgtctacagggcagtgtcagagatggggccacacagcatgcttagggaccccagaggcctcagttcaggttgcctcctctgcccaggcacttttcctctctcattgtgggcacaggtaccttctctgcatgtcccagggattagagcatttgttgccaaggccctctgaggtcagggcagggttggaatgtatcaagaacaagatgaatcagaggcaggtcagctgagtggagtaatgatggaacaggggttctgcaaaacatccctgaacgatcttgtcatgccctttctagaactttgataatggtgattctcgcctggactccagtgaattcctgaagtttgtggaacagaatgaaactgccatcaatattacaacgtatccagaccaggagaacaacaagttgcttaggtgagaggaaccgagaggtcagagaatgatccacaagggaagactaactgagagaggggacttaaaccctttcccacctgcaaaagagccaccagtgagagaatgtcacgtaaaaagcaaaatgggaattctgtcctgttctattctatgaaagtatgaattaatatattgagtaccactgatatctaatcaaatagttattgtttttggtcagaacttgcaaggactagaagaatataattttaaaataaattgccaagggcacgtcagagcaagttatttctgaatgttgtgggtgatgttttactgattaattttctgaaggaattacagtaatgtattatttaactataggtctaaaatagctttgttctgatttttagataattagtgctatttcatgtcaattgccctaactgttacagatatatgcccgtctacttttatggcattattccagaatcaatattaataaaaactaatcgctaagaaacttttgatgtggtttcagcacatcggtaagaattaaaaataggaaaagcatgtctttttttcaaaagaagtgcattgcacagtttctagaaggattcttctttaataatagtctatgaccttaaagtataggttctgtaaatccttcatattttgataatctgaaattatatgttttataatttcaacgtttgagcctcatgatatcccagtgaaggagggcttcttgtcctccttttacggatgggaagacaggctcagaaaagttgaataactaactcaagtccatttgagtagtaagtgattgagccagggctcaaatacagcccaagaaagaagtgatggagctgagtttttttttgtttgttttgttttttgtttttttttgtttttgtttttgttttgttttgtttttgttttttttttttttttttttttttgagacggagtctcgctctgtcgcccaggctggagtgcagtggcgggatctcggctcactgcaagctgatggagctgagttctaaaagcttttctgaaaatctctttctagaaggatgataatggtgattcttgcttgaacttcatattctttcaaatcctatattcctttcatgtcatctgtcatatctcttctgttttgattttcctagtttggttgacttgacgtgtatataccatggggaaaagcaattgctagtggaaggtatgcaggcagtgaaaacattagacaaaaccattcacgaaactttagtcatcttaagggggggaacatttggacagcctgggtgatctgacattcatataacaaactaaaggttagatgcctgcattggtcaggatggataatagttgtgttgggtcagtgtagagagaggctgttttagttagcagtcatcttcttggcctcctgtggaggccctgggtgtatgtggtcctgatgcttacttcctttcttctgagcgaagctgaggtcttgctaacacatttctcctgtgttttgtttcaggggactctgtgttgatgctctcattgaactgtctgatgaaaatgctgattggaaactcagcttccaagagtttctcaagtgcctcaacccatctttcaaccctcctgagaagagtatgcctaacctaagaaatagagagctgtagtgaatggaggcattttgtaggagccaagatagagaggattggtggaactctccagagctagctgagaaaatccccttccatgattctaaactgggccccagcccattctccccatggtgaagttagggccccacattctttaggttgatggtagtgtttgctcagatatagtgcttctgagggacaggcaggtcttgtctgggaaaaaagggtaaggtgcacagactgtagcaaagatgccctgttccaccctcacagctaaactgttgccccgtatttctggcccaacagagtgtgccctggaggatgaaacgtatgcagatggagctgagaccgaggtggactgtaaccgctgtgtctgtgcctgtggaaattgggtctgtacagccatgacctgtgacggtgagctgtgcttcaagcagaaagaaaaaacagcaaggagagagcttcatgaaatcagcatgagagaagttggggtggggatgatggagaagagggcggtggctgggagcaaggaacccaggcagacccacacctgtaaggttggagccccaagtggggagctttgagggcagaacatttatcccataggcattcagtttgaaaatcactccagaggcttggaataagagaggaccaagaccctgggcaaaagtaaatgataatggaatagtaacattatggaaatagtaacagtgaaagtagtaataatggaataataattaaaaatagtaattatttaataattaaaacattaaaataaaaacaataattattatttaataataatcaaaaataataatggaatagtaacagtgaaagcaaatactcagcaaaaaccatgtgccaggctctcttctaagcactttacatattaacccattgatccttataacaccttaggaaatggtaaaagactagtggttggaagacaaaatgacttctccttgccatacccagcagaaaaagaaaatatgtttgtagaccctctttcaactaacagagatgggtaatcttttttaaaaagagaaagttgagctagttgagatatgtgcagggtggtctggggagacagagaaatctgagagtttgtggggcagtgtgaggctacagggtatgttggaaccactggagtcccatctgggtcctgggctacaatgatgccaaagatcaagagggactcttaaagccgagccctagcaaagaaccagggatattcagagtggaggcaagacagagaagggtgttgaagccaggtctgcaacggagaattgccttaaggtcatttggaaccaggccgaaaagtttcaccagctagggtgaacctaaagttatatcagccaggcgcagtggcttatgcctataatcccaacacttggggaggccaaagtgggaagcccaggagttcaagaccagccttgccaacatagcgagaccatgtccctacaaaaatgtgaaaattaggcaggcgtgatggcacgtgcctgtagtcccagctacttgggaggctgaagtgggaggatcacctgagcctgggaggttgaggctgccatgagccatagtcacgccactgcattctagcctggacaacagagcaagaccttgtcttaaaaaaaaaaaaaaagtttattttaagaagttaactgtgtcaaggaagagctggctggaacctaagataatgttcaggaagatcaggttaaatggtaactaggagacagaggtcagaaacccaggatgaggctcttctagacaaggatcctagagaacagcaacagtataaatggcccagtactatctaaggtatcactggtctaccgctgcccaggaccaagtctgttttcagtgtggaacgacagcaaaccaatgtaactacagggacaggtgaaggaacaggaagaggctgtttagagactagaaattcctacaagttcctagaagtcaagaccaagccaggatctccagaccaaacacagagttgctactgaaaccaacaaaacacatctcaaaacagtcagtggcctagcctgcctcaaccatgaagcatcctatacttgtcttccctaaactcccttcagtacctctccgcttctaactgctgctgttctggctttgtaaaggtagccctccatttctaaggtgcaggcagttggtatgcagttggcttatagaataagcatggtcatttggataataatctctatcacatgcatcagacaaaattcaaatgatcagcttcatgggatgttgcccatttccacagccactcagctatgggctgctcatcctccctggatgaccaagtccagaactctatgtgggtataacatggagcaacccatgttagatggtggtgccccaggggcctgagcacgtatggatgtgtaggccgtggatctaagaggagtttgtggagccagcattctggggcattttcaggttaatacctgagagttagcagtctgatcttagatcacaaatcaaaatgggacaagcaagaaggggcatcaaaatttgaagccaggaggaggcagagccaagggaaactgctgtgaagggaaggttgatagcaatgtttggaagatatgtcctagaagtgtttcctaatggtcagcattctacttgataagcctagagatttcatcctaaacctagtaaatcagaatttgcaaaagagcagcttgggaacctgtgtagtttttgtttttgtttatcactgtgcaagtttcagaaacattgctagatgaaatggttgtcaaccctggctgcacattagaaccaactagaaagacttgtaaaaaaatactggtgtccagatctcacctcacatcaattaaatcagaatctctgaaggtggaactagacagctatcttttcaaatgttctccaggacattttgatggtatatgaatgacttgagagtcattgtctcagagaaatctccagtgtcaggatccaagttttcaccataactttttttgtagggccagcttctggctgggatgtgctaagcagttaaaggaacaaaggccagagaggagttggggtagattgctttgttacaatgtgttaccttggaggtatcaattacacagggccccttcatgccttcatactcagaaaatgtgggtaattcacctctccttccacaagttaaatgggagatgaattgagagcctctaggtagatcttggcggattcctcactggcttaccacagctgctactgctctgagctttggttcttcttgcaggaaagaatcagaagggggcccagacccagacagaggaggagatgaccagatatgtccaggagctccaaaagcatcaggtgagtggcagcctccgtgctggttcaggtgttgctgttgccatcaggccctataccattcaaacactgcccagtgccccaggagaccaaggaggctctctctgctcaatacagtacatcttgagtgataccccatcacctgtactatcaaactgtgatacagacagttccctgataaagtcctcacagggcccagtaggtctcaacacatataggttacagctcggtgagtggctgcataaggcaaaatcaggcaggtggtgatttgcaaatgaggtggaagtggtttgcaaatgagcgtggtttaaggaagtgtgtatcctgtcatgaccagtgtccagacccaaagactgtgagctcctgaaagcaggctctgtaacttgctcatcattgtacccttgcagtctcacagggcctggtatgtagtcagcactcagtgagcatgaaagcagtggatttgggccacagcagaaaggatttaagttcaacatcagtctggctagaaaatagcctggggttaacaaagagtctccttcccagagactcaagaagataataagaattttgttcaggttctatgtcattaagttaaaggcttccttggggaaagggttcttagcagaatagtgatgctctgacatattgtggaactgttgaactcctggcccatcctcctactggcttattatgtagtcttaatacaggatattgcaccttccattacctgtccgtagaccgaatgtagtagtattagccttctctctgacatagaagtttttaaggaatataatggtcacaagaactgctaaactattgatatgaaatatttgacatgagtaaacagaactattactattaatagtaattgcccatttattgatcattcttaatgtgcattttgtcatcattgtcactgatagtatagaaatctcatgtcggttgtttaagcagaagcaaaagcttctagtcttttgcttttcaaatttcaccagtcttgagtctccaaatgagttcaatcccatgaaagagaaaaaaacttcataggaattactttcgtctagaatatcagacagtacagttatcagacagtacagagtgaattatagtagctaatatgtttaagtttctgtgtttgatgtgagtcccctcagagcagatgctgaggcaaggatgcaagtacacatagtttatttgggaagcaatgccaggaaacaccagagggagatttgggaaatgagtccagaaagagaaggaagtaatgaagagtgtgtattcaggcatgttaccactgttaacaagtgactcttaatcctattggggatctctgggaatggaataacagtgcctgagtggggatgaagctgggctgtttctacaagaactcccattagccattggctgagggctgctactgggaaatgttaattccctggcatttgtggcctatcagtgtgtgtggacagagtgggctccagcagccagagaaaggcctcaggcagagatgcaggtgctggcagtaggtaggaagtcatgccagtgtacaccaagacattaaacacaaaggggcgatggatggaacaccagtgtctgctagatatcaggcaatgttgtcaggttttaaaaatttatttctttaattgagatatgattcatataccataaaattcacccctttaaagtgtatattcctaagattgtcaatcatctcactactatcttaattccagaacattttcattatcccagaaagaaatcccatacccattagaagtaaccctccattctcatcttcctccagccctttgcagccactaatctactttctaactataaatttgcctgttctggacatattacagtggtatcatacaacagtatagccttttctgtctttgacttagcataatgttttcaaggttcattcttacagcatgaatcagtacttctttcctatttatggctgagtaatattccatgatacgaatataccacatgttgtgttatccattcatcatttaatggatatttaggttgtttcaatttgggggctctgataaataaagctgttaggaacattttcgcacaagtttttgtgtggacacatgttgtcagctctcttgggtatttacctagaagtggaattgctgggtcatacggtgactccatgtttaacctttggagaaatggccaaactggtttccaaagctactgcaccactgtacatcttcaccatagagttccaatttcttcacatactcaccaacggttttgttattgctattttttattttagctgtcctagcgggtgtcaagtggttttgatttgcatttcccgtgtgattaatgatgttgagcatcttcttatgtccttattggccattttgtgccaggcactgttgtaagagatggtactttattactgtggttttgcagttgaagacattgagacacagaagatttcataatatgcccaaggtcacccaaaaagtagcacagccatggttgaagctcaggcagtctgcctccagaacctgttgtacttaacacttctttggacttgttggattaagaacatcttgtagcatttccatttaacatcattttcttcatccttaaaatgggaaccataatgtctgatctgcttgtttcataggagtccaaatggagtcagcttaattcagtaaacagcccctgcatgaccatgtcatgaataggccatagttcttgttctcaaattgttcattgtccgtggaggagcccgacaagtaaacaactaaaattcagcataagcttgtaaatgccaatgctatatagtcttgaggaacagataaattccaacagttgtttaatatttccatgacgcctattttctcttgcatctcaaaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtg

SEQ ID NO: 36979 - DNA, 52279 bp, Homo sapiens
attctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccgtatccgccggagagaagggagaggggaggccgcgcagggccgggggtgggggtcgggggccctgcggaacacggtggggcggggcaaccgggtggcccagaggccgagcagagagggggagggggccggcgcgggagacgaagcagggcggggcggggcgggggagggcggcggtggggggggggtggaagacccccttcgccccgcagtgcaccactcctccccaccgcgcttccgaaggagacccttgactagcgcccgcatactgtcgagggtatggagatgaagggtcctctccgggagccctgcgccctgaccctagcccagaggaacgggcaatatgagtaagtaaccacctgattcccacagaggaggggagcctgccattacctcccaaccccaaaccgcgacgggtcacccactgtcctcctactgaagccacgcgggcaacaggttcaggtccaggtgtgaagtgccagtgctctctaacctcggggctttgtccccaacttccaagcctctggattgtgcttggcagtgtggctcagtggaaggactgaatgggcggggaagcaggaagcctgggttcttagttcctgcccctgcaactgacatgtgttgtgtaacgttgggcaagtcaataaagctttctgggccaaagttaactcttcagtttaataaaaccattaactgccttaccttacagcctttggaattataactgggggaaaaataaatgcgagagtggcttccaaaaagtaaaagtgctatggaaatgcttcattgttaacgttacagacttgtcttaaccctattcagctggtttctccagtctccccgtccccttatcccactgggttgaaggcatattcattaattcagtaatggtttagtgtaggccagaaactgcctcacttactgactttactgttagaaagaaaaggtaatgaaatgtgtagagatagaaatgacagtattttatcagtgtgtcaccttcctctctgccataggagctccgtaaatactgttgactgattgatcaaaagattattttgataagctatcaccatagctgctaacctcactctattgtcactaatatcttatctcaaaaatatccatggtgaccattacgtatcataggcccctatccctgtgtgcccaagacacctcacttggatattcattggcttcttgacatcatattccttcccagtttaaaaattgttcacttaaatcttgccatctcccaacattggcttctgcctaaaaccaattttctcagtccccacttttagatcctctgtatctatgctgtcagatttacacggaagaaattcccactggcccaacctgctcttctctgagactattggtgccactctaactggatgtcagctaattctgtgaagtagctctttcataggtcctgcttagtcagctctactgggaagttcatcaaacccggatttcatcaaaccctggaagactagtttaatgaaactaaactaaattcagaatttaataaaacaaaattcagcagaaaagtggaacaccactaacatttccaaaggctagagtgggttacagagaggtgacccttgggcaaaccagtaaaacttgtgtgccttggtttcctctaatgtaaaaacaaaatcatgaagattgaatagagtagctacattgttgagatgaccacagcccagaatctagtccctcggattagtagatttggaactctgttgagctaataaggaagtcgtgtgttccaattctgtgtaagttatgggggtatagttgggggtatatgtgggggtatggggctgctatataactaacattaatatataggtaacactatataacaactatataactaacaactaatatagttgttgctatattagcagtttatatataaactatgtaaatagttttaaatatatataaactatagttttaaatacatataaactatagtttatatataaactaacatataactaacaactaatatagttgttgctatataactaacattcaatggctgcttatgtgccaggtactgttctaagcccttttcattagttagttcatttaatccacatgtgagggttactataagatagtaatatcatcatcccccttttatagatacagaaattgaagcacagacaggttaagtcacttgtttgcaattagggagtagaatacctgagatctgatcctatgtaacatgtctcagaattacactgagaagtttctcttgaaagcatttgctggagacacctaataccataataccatctgtaatcctcatattcttgtctctctggtgtcttttctgactcgagtgtccagaactttttacttttggcttttttatcctagaacttgaagcctgacttaaatctttaggtctgtggttcctactgtcaaccataggaaatttgcttgaccaaaattacaattaaaaatcagggtttttttggaaacagggaatcaaacacttaagattcatatttttcaaggataatagattatgacaaaacctgtttgacctttaaccttccttgaacaaatcaaagtgtttcctagggataaggcagagttggcattcaggatttgtcactcttttctgtttgacaactaccaaattctgaattccattgttttgctgtataccaattatttctaatctttatattctgaaatgaataattacactcagaatttttatgcttattcttagccctactcttttattgtaatttagtgggtaacacgtagtaaatactcaataaatgttggtgaaattcacttaaattctcagtttatttgttttgtaatagtttttaacagtactgtccagatgaagctttaatgctaatgttcaacaccatttcttgtttatgtattttgagattttagtggtttgtgtttatcttcctcaaagtaagctcttcctccttaacccttgatttctcagccttttatctggtttctggtttccatctgggtttataggactctccactcaactcatgaactttccagatggaaaggggcctgccccatattcctgtaatcaccttagagtacaaacccctgcaaattaggcaagaaggatcacagcagaaaaacagcattaatacttttatttcccttagttctatctaagtaattacttatcctatcccaggttatcctcttcaaagttaacacatttgaaaatgcaaaaagcaaaagcaacaagcacccccaaaagacaacaaaatagaaatcaaacccttcaaaacaatgacattttaatgtcagaagttggacagtttcattgaaaaattcaccgctgcttatagcttaattaagctagttaatttattcagccagtatttgttgagcatctattaggctgcagacaaaactgaatatgatctggtctttgctttcaaggagctgaaatcagtgaggggaaataaatataaccataatggagtgtgtaagtgttctattagaggggcaaacaaaggcgataaggctgctggttctgcttgggggtactgaggacagtttcatggaggaggtgatatttgagatgaaactcggaaagaaacagagtgttcctgacaaaaaactaaaaacaatacttgaagagtgcttgactttgagaatgctagttgacgttcagaatggctgtttaccagtaggtcgtaccttgattctggaccactaaggataaataataaatgaaaaattaatatttcaggagtacgtatggatttagaagtatggatttcatctggggagtcaggtttactcatgtttatgtagaaataccagcgtaaacttggaaaccagagaagaaacaagggatttgaaggcaatccagttgtgatatctgccaccttgttggtcactgatattttgaccaatccagctggctgagcaccccctcttactcctccatgaacctgaatgcttgtttgaagagacagatccattctttggtaaaaagccatgggaatataattggaaggttaatttatgaattttctaattcattgattccacacacacgagcaactcctgtgtgccaggctttgtgctaggtactagaaattccgtggtgtaaagatagctgtggtccctgcactcatggacttcacatctagctgtcagttcttcactctggtatgcatactctgaagctatatactctgtaattcatgctcttaagcttgtacactgtttttaggatatatggcctagagaacagtgtgggtaatcagatgttcatcaccactagcatccttttaggcctagagcaatatctagctgtcatgatgctcagatccagggaactagatgcagcaagtctagtaaatacagactagatttgtataacaggacagtgaagtatttttttgctaaatgagtttttcagtggctgttctttgatgcgttcttctgtttcctaggttaataatccagttgcatgagaaggaacagcatgttcaagatatcattcctataaatagccacttcagatgtgttcaaggtactagctttaattccttagctagttttataatgttttttctcggtcattactgcattatgtaataccatacatatttaaatttgtcagtgcatgtaaaatgaaatgtattactctttgcataaaaagataacattgaggagatgatactttctctaagaatgctgaagggttatatcgaaatatatttgtatatgtgtgtctatagtctcacctgtttccttggcttgggttagagatgtatgtagattgttacctgtgtaggtagttttttatgctgactgacctatatgtggatttaaataacattcttgggcttaacggacacagtgctcataaggtaccaaggtcacttggattcacacacattcagcactttctccacatgctatttgaaattaagacatttggcaacatgccttgccagactgtaatatcttacactcaattgtgctgattctcaaaccttgacattggtgaatcataagaaaattgactctggggaggaaatatttggcctcctgccctcaaatttggggacggagcatagaaaatctgttgtttcatctgctacaatgaaacttaaaaattgggaggtttgtgtaggaggtgttgcttctgtcatctcacattgctctagaaaggaaattgatactagagaacaaatgcattctgttttcactaggaccagtggctttatctagcagaagcattctgtatcaattgtagcttcttggaaaacttgttttttcaagacaaggtcatttcccaggctcaagtgatcctcccacttcagcctcccaagtagctgggactgcaggtgcaccaccccccagctaattttttttgtaatttttgtagtgacggggtttcgccatgttgcccaggctggtctcaaactcctgagttcaagcaatctgcctgtctcggcctccaaaagtgctgggattacaggtgtgagccagcatgcctggcctttcttggaaaacttaaatcttaccttgcatggattatttcttaaactacattgaactttttttttaatcactaagtgacatgtacataatgtaatacatttggaaagaacagaaaagtgtaaagaaaataggtcacttaaattcccatcctttcagagataaacacctagcattttccttttttctacacatacattgcagggtgagtgatactcatcttatacaattttttgtctcttctacatgctattgtattatgagcacttttccatgccattaatggctatataccataccagtttatgaatggtccataatgtaattattcccctatgttgacatttgggttatttttcactagtatcaatagtaatatgatgaacatctctgcacctaaatatacctgcacatctcttatttcctcaggatgtattcctataagtgaaaatactaagctagtggatatgactttttaagaatgcatgtgttaagaattaaaaataacttcaatgaatagtgtccatatttgtatggaagaatgaagtgatagctatttagcctgccctatgtgagagagacatactaaacaaggtagccacgttccatagtaagttgctgtggccacctcacttttcaaggtgtaggccttcacagaggggaagagccaaagaacatgactttaaattaatatcctattagctttgtacctttttactctacctctaggatctcttttaccctgtttctcttagtatttttaataagaaatcaattgctgattgttagatcgtagtgctgcttcttagaacctgggaaaatatgtgcacacatgtaacgtagttccccatgactaaaggaagacttacttttgattttcatctcctttctatttcctgacccctgcatctattttgtaaactgtggccaggcgcgatggcttgcacctgtaatcccaacattttgggaagctgaggcaggaggattgcttgagcccaggggttcaagaccagcctgggcaacattgcgagaccccatctgtacaaaaataaaattaaaaaaacaacatttgccagacgtggtggcagatacatgtagtcccagctacttgggaggctgaagcaggagggttgcttgagcccagcagttcgaggctgcagtgagctgtgattgtgccactgcatgctaacctgggtgagagagtgaggccatctctaaagaaaaagaaaaccggctgggcgcggtggctcaggcctgtaatcccagcactttgggaggccaaggtgggcagatcacaaggtcaggagattgagaccatcctggctaacacgatgaaaccccgtctctactaaaaatacaaaaaattagccgggcatggtggcgggtgcctgtagtcccaactactcgggaggctgaggcaggagaatggtgtgaacctgggaggcggagcttgcagtgagccgagatcgtgccactgcactccagcctgggtgacagagcaagactccgtctcaaaaaaaaaaaaaaaaaaagaaaaagaaaaccatctgtaaacactcaggttttacagaactaaaagttaatgaagaacagtagtaagcatacaatatctatgtcttgatgccctaattccccttgtttaatcatcctaataataatatcgagactactttttagtgttaaaggagttagttccttgccagttgcttctgttgtacctgagtaatggagccaaataaacaattcagtcttgggagggaggtgaaaaaggtgagactactccatttgaccaaggtagatccaggctaatcccaaggagtcagtacccagagttcaattagccaggagggtctggcaggtgcacttggtcaaatccagagaaatcagaggggaagagataggttgggtctagacacttgttgtaaaggaagaagtccaggagaaccattgagagataagagaaatccaaacttgcagactgctttgcaccctgtttggtacggagggccttgggcccacaggtagtagttgtaacctgaaggtatactctgcccccatgtgtggggcaggggcagaggtgatgagatcactgggaaattttcagagaatagatctgagttaagaaagtaattcacctctgggctttcagggtcacttcctttgccttctgttatctaaagaagtatctaaaggacccagagttaaatcattatgttacagttaaggggaattaaacttgctttcgctgaattaacatgttgttatgttctgtactattaatttctcattcgttgatttgctttgaggagttccatttggttacttcttcagttcatttttattttagttgatttgctcatagtctttagaacccagtgctataaaaaatccctttaaaaaatattaaacgaaaagggatttaaaaaaatatgttctaagacctaggagtagtgactgagagaagcagttatttagttaggcatgtattcttttggttgtagtgagtggttttctcttccctaatcctactctcttttttttcccctctcagaagcagaagaaactcttttgattgacatagcttctaacagtgagtatctttctgaatgtgcttgatttttactcaacaaatatttacttgaacactcactacatttaagacaccttttggggcacattttttattttaccatcttttcctgtagtctcctgtagcagccatacaaattagcactgtttcccaaaaacatgtaggctaagcctaagaaaaagcaggtggctggtaagaatctttataaaaataaaaaataatgatctacctttctaatgctgaacttccgtgagctaccagtattgttgctgtcagttgaatcattgctgtagaattgataattgtaggaagggctgatgtttaaagcacataaggtttattggtggagtttttttggtcattttttaactgctattacattttaagttttttccctaccctctttttaaattttgtgtgttaagtcataatattttcctttatttgttgtatttttttggaaggctgaagagtcccttaaattgcttgtccaggcattcctttaaaaaaaaaagtttagtcttttatttaagccccatcccctcaaggcatctctttattagagggaacatgatcttcttttcaatgtttccattctctcatttttatctgtttgaagcaaatcatctttgactttctgtgcaaactgttctttgtttatcatctaattgtactattttatggagtggagaaaatgggcactcgatgctactgtgaggttgctatggaaaagagtatctgaccacatgaatctaaatcaaatgggttgccttatctcttggttgagtccttggatgagtgggaactggcactgagcttgggactaggggtttacataactttgtttagacagtccctgcccttggcactattaatttgtattgaacactttaagtaggctttttttctggcttgagtttttttttttttccctttggtcgtgaattttagaagtcttaaaggctgtgcctgaaaggccaggtaaaccccagctgcaagtatccaagagagaaaataacttaatgtctatttcttattgtgcttagaaaggagaaggcaaaaacaacacttaaaaaagcaaaactagaacaaaagcaattccataacaactgacactgctgctgaaataagagatggaaatgtcctgtatttgatgtggagaagtatttgattcaaagctgaaaagttaaactgagctgtgccttttctcttataagcacctaattttcggcattagttttgttgtggccgcttctacattagccatgtgttgctatgtccagagttctagttactggctcatagggggaaaataggtaagtgaccacttgaataaaatcctttgttatttctacccatttagtagtatttgcactgaaaccatattttatcttgatccttgggcttcatacataaacctttatggtacacggtgtgttgcaggaaggagatcttgggtttgttaggcaggcctgattttaatgtaaatatgcattttcccattgtctggatattggtgttaaatgctttgtaaataattttttctcacagaagtaatacatcttcattatatacaatttactaattcagaaaagcttaaagtatcaaattaagattattttcctgcaatctagagatcaccactgtggttaacatttttatgtatttccttccagtctttatatttttacataattggaatcctcatatgcagtttttatcctgcgtcttcatttaacattatattgtcccattttcttatgtcatttacaattactttataatatgctttttaaaaaccaaatatttcaccataggtctgtgccaaattttattaaattaacttctttataaaattaagtcattgtcaaggaacatgatatatctgtttttttcaggtcctcttttatatctttcaataaaattttatagtttcttaatatatatagtttttaggttaagtatttcgtggtggattttatttgctgctattgcgagtggaggttttttctatgtccttctaattgtttattactagtatacagaatagctgttgagttgtggatatttatcttttatccagttgcttcattgaaatttatttttaatcttttttgcttttcattttgttttttcattttggtagctaaccttaatatctataaataataattttgtctcttttctagtagctactatcgttgtacactataccagtgagaattttgggaccagtggtaaatgatgatgtttcttgtttggctcctgatttcagtgagaatgcctcaagtggtatttcactgttaatgacattattgcttgttgatttgacagggttttttttttttttaattaagaaactgcatttatttcaagtttgtgttttttaaaattatgaatgtatactgaattttagcaaatgtctttttggtatttatggagatgattttattcttccttatttgaccaattggtacactgtattgtactaatttcctaaaattaaactgtcccttgtttatccattattcaacaaatatttgttgagtgccttctatttctcaggcacttttgtaagtgcagaatcagtacagaacgacaaagataaagttgctgctcctactttggttcttgcttctgtgcaattcagtactagtgtcacacagatacctataattcaatcattcattctataaaaatatgactattttttatgtgccaggaactacactaggctctagggatatagcagaaagcagtacagtcatgatactttaaggattttaatataggaaacagactttaaactgataagatatagataattgtagttttttttgtttgtttttttgagatggagtcttgctctgtcatccaggctggagtgcagcggtgccatcttggctcactgcaagctccgccttccaggttcacaccattctcctgtctcagcctcccgagtagctgggactacaggcacctgccaccatgcctggctaattttttgtgtttttagtgaagacaggatttcaccatgttagccaggatggtctcaatctcttgacctcgtgatctgcccgccttggcctcccaaagtgctgggattacaggcgtgagccaccgtgcctggcccagataattgtagttttaataaatgctcttgaggaaaagtactaagagtttatgagaagagtaagtatattaggagggtggtcagggaagacctctttgaagaattgacatttaaattgagaccagaggggctaagtaagaggcaggttaagatgggagagagaagaatttaccaggtaaagggaatcacaaggctccaggctgggaagtagcttgacacttttctttgaagtgatagaagaccagggtgcctaaaacaggtcttgggcaccaaggtaagaaaaacaggctagggggcagatctggcaggatcttgtaagccttgtcttaaatctgaattttgagatttcaaaaatgagaatcgtatgaaggattttatgctggggtgtcatcatttgcatggaagcagagagaccagttaggaggctgtttccatagtgtaagctagagagtgtggtggcattagtaatgaagagaagcagtcagacttgatagatgtttttggaggtaaaatccataggaattgttttgggtgtaaggggtgagaggaagtgtcaaggatgaatctcgggtttctgacatgactgtggatgatggtaccatttgcagaaataagaacactgcacaaagaatgagttttcctcaagggggaagggtcattaatttagttttagtcatgtttagtttgagattttttttttgttttttgagatggagcctcggtcttatcgcccaggctggagggcagtggcgcgatctcagctcactgcaacctctgcctcccgggttgaagctattcccctgcctcagcctcctgagtagctgggattacaggcacccgccaccacgcccagctgatttttgtactttcagtagagatggggttttgccttattggccaggctggtctggaactcctgacctcaggtgatctgcccacctcggccttccaaagtgctgggattaacaggcatgagccacctcacccggctgagattttttttgagacacctgagtgtagatgataaattggcaagtgaatgtatgcatctgaatctcagaagaaagtcatctgggtcactagcacgtagatgatattcaaaatcataagagatgatgtgattgtgtgtggactgtgctatccaatacagtagccactggctacatgtgcctatttaaaataattagaaataaaatgagaaattcagtccctcagttgcagtagtcacatatcaaattgttagctaccatattggacagcacggtttagagcatgcccatagtcacagaaagtcccattggacaatactggtatagaatgagaaaaaagatttatgtttgaacttgaggaactccattttttaaatgttagatagaggaagagatacttcaaagggcactcaaaattagtgatgagagagaaactagatgagtatggtatcatagaagcttttggaagggattatatcaagccctgattaactgttgatttctgctaataggtctaataagatgactgaagaatatccatgggatggaggttattggtgaacttaaagcaatttcagataagtagtgggtgtggaagtcatattggaatggattcaagtgagaaatgggaagtctgtgactgtgtgtcttttaaagaaacgtgactggaggggaatatagagatggactggaattggagggaaatctgagatccaggaagatttttgtttttcagatgagaaggacttagaacacgattatatgctaatgtggaggagctagtgaaagggaaagcgttaaggatatgggggtgtgtctagggattagttgtaagattactgagagaatcagaggggttgtaattcaaagtgaaggaggtttgataggagtgatcttcttccttgtatcagtagggaaaggatgagatgagtacaaatacagataagtttccatgtgatagctttattttttctctgaagtatgagctgaagcattctgcttagaataagagggctcaagaagatgggggatccaaattttgaggataaatgagtaggtgtgaaacagttgtttcagatagtagtaggagactgattgactgtaggaccttaggttgcttcctatgatagaggacccggttgagattggcaatcaggaatgtataatgatagccatctggttgtgggtgtgcatatttaccccctctgcttgttcaggtataagtacagaaaggcaattagttggatttctgagggttggtatttagccaggtaggtgccacggaagaacagagaggcaaggcagttctgggtttttgcaagagtgtaatgatggcatctgtttgataaaaggggaagtgagagcaggaaggggctgacggatagtaagaaaacagagaaatcaatgggctggaggttcccatcagattaaaaaaaaaaaacagttacaatggggataatgagcaagtaagttggaaggaataacatgtcagggtgggatatttgaattagaggtttatgaagtggtggtgtttctatgatgacaaaatccagggtataactgagagggtcccagtagcaactgaggaagtggtggctgaggtggagggggaatgtcattggatgaggaagctgaaggtgttgactgggttttctgtgctaattttaaagggacccaaaattaatggcaggagatcgagtggagagaaagtcttatgagccaggtattgtatcttggattctgaagtttctgggaggatggtgcatgatcttgtagaggaaagggaggaaacggtagatcccaatggatgagcctcaaaggagaaaggattttgcctgagggagaaggagaaagagtagtctggtggtgttattaggacaaatacagacaccaactcaaaattacttcaggtgtgagagaatataaacagactccattaagagggttaggccaggcccggtggcttacgcctgtaatcccagcactttgggaggccgaggcgggcggatcacgaggccagtagtttgagactagcctggccaacatggtgaaaccgcgtctctactaaaaatacaaaaattagctgggtgtggtcgtgcgtgcctgtaatcccagctactcaggaagctgaggcaggagaatcacttgaacccgggaggtggaggttgcagtgagccgagatcgcggcattgcattccagcctgggcagtagagactccttctcaaaataaataaataaataaataaataaataaataaataaataaataaataaataaaaataagagggttgtaggagaagtgctcctcctagggaccagccagttttgcagttgactctgaattttaatgtgcacatatggtcagatcactcggaaactacgagtgcctgggcttcacctccagaggttctgttttaattgtcctggagtggggcctgggttcaatattgtttttaaagtgcctctggtggccaagcacagtggctcatgcctgtaatcccagcactttgggaggccaaggtgggcagatcacgaggtcaggagttcgagaccagcctgaccaacatggtgaaacccgatctctactaaatatacaaaaagtagccggacatggtggcgggcacctgtaatcccagctactcaggaggttgatgcaggagaattgcttgaacccaggggacgaggttgcagtgagccgagatcacgccactgtgttccagcctgggcaacagagcaagactccgtctcaaaaaataaataaaaacaaaaataaagtgcctctggtaattttaatgcatgcatagttgagaactactgagagatgcagagaatattcagatgaagttgaggatgtaggagtgtttgcagatcacagaggtccagaaggttttaggatggacaagaagagtagaaggttgagtcttgaggtaatttgttttctttctcaagcaacatggtgagggagcatccagtgttattttgtgagcaatttctggaatcttctggcccattaaataggtcagttatatatttgctaaaatatgtctttcaagaattgtgtgtttgtgtgtgtgtgagagataataagggtttttgttctaaatttatgtcagatagaaactactcttttaaaaccacatttagtataaataatctgagaaagaaaggacttgttaggccctgaaggagttttccctatatcttcatggctgctataattgacacttttttccttccctctcttttttcccctctacagtggcaccctcattaattttcttatccgtagtctatttgggtgccttctttcacatttttctccatttttatctattttcttctaattaattattttattttcctttttgtaactcattttacaaagacagaaagaagaagaaatgcagaggacaaaaagctaaaggttcagaagtggatttccaccataaaaactaggattttcatttcattttctcatgtatttgttatttacacgtggtaaagagtccagttcatcagtcattaaataccttctgtctgtgaagtctgatgttactgtcaccagtagagtgaccagcaagccttatttgcctgggactttcccagtcttagcattggaagtcctgagtcctaggaagcctctgagtaccatacagtgctgggacagttggtcaccctagactcctgaaagtgctgggttcgctgtatgtgcaccctgcatgcgtaccctgcctcttgcccttaaggagcttgtagtttccagaggcatgagaaaacaacgtatgtaataaatcagttacaataagaatagaaacaagtacataggtttcctggatcaccacatccaaacagttgatatagatgataactatagggcatcaaaaaaggggagacaatatgttatacacataataaattaaagccctagctaactttgcttctaattctcctagtttccaattggctgtacttgaaccaaaccacttctgagcataggtcattatattgtttttgtatgtttattcaagacatacattttaaacttgaggtaatgagttgtagatgcttcttttcagaatacttcaaaccagtatcactatttttaagttattttgtaaatttaatctgtgcttacggacaaaccatcctacttattttattcccttcatgcttcagatactctgacaatgtgatctggacttgaaatggtaggaatttccagctaaggaatgggagggagggtgattgaggaatttaccttttgctggaatttgaaggtccctgctttgatgtctgagagatagatcagaacgcaggaaagtataattttagtatgtgtcatatccttagatcgggctgctcatggacacggttcatcagccttaggagttctcacttcccttagggttccctctctgcatcaccccttccaccaccgtcatactgactctcttgatcttgtatgtgtgcttcctatattagagatctggaatatttgtgatctggaccttcttctgttaacctgataagttgagaatatgatcccagtaaaacattttatcccatagcagtatatgtatggatttcaattctttttaggtggctgcaaaattcgggttcagggggactggatcagagagcgccgctttgaaatccctgatgaggaacactgtttgaagttcctctcagctgtccttgctgctcagaaaggtaactaaagactcagcgattttctttcttctatttcaacgggagtggaattctgacatgctgatacagaggaaagtggccattggcaaaatacctcaccctttaagccctgatagctgatttttttttcttcaggagtgaacacagggataggttagggaaaaaatctgcccagctttaaggacactaggcaagttttcagaatattcagtgtcatggcaagcacagcttaccatagactataattctccttctgcccctagatgaccccagagctgccctcatttccttagtttcttccactgtatccaaaaatggtgctggcccctgcatataaggaatgttgaaagaatggcttttggctatagtaaattctactcagtgaaagacttcccagtttctgaccatgaaccttatctctctagctcagtcacagcttcttgttccagagcaaaaggactcatctagctggtaccagaaattagacactaaggacaaaccttctgttttttcaggtactaaaaagttcctggtttccttgttgctatggtcattgcagagtcagtagattttgtcaggccaaatatggtgatgtagattaaagctgatgtcagacacattctcctgcagagtagttttatcaagtccaggcccactgaccagtgttcactccttatccttcctgtagcatggtagctgttcaggagccagcttagcagggtggtagaaagtacaagctcgagagccagacagcctggatttgaatcccaagtcaagaacttactagttgtacaaccttcatcaagttactcaacaactctgaacttcccttttcctttctgtaatatgggaagatttttaatagtacttacttcttggagtttttgtgatgattaagtgagatcatgatatagtcccttactctcaaccaggcattgtgctcagtcttcaataaatgttagctattactagtctgttccaagttcttataaacttctattgttctagttagtatatcagtgcttcagggataggtatgcttcttcgaactccaatccaagtaatttctacccttatgatagttttctgtttagtaataccactgatcaaattgtgatcaaatcaaagccctgttaccctggatatgttggatgttagattttttccccgtttgactttggggtctgtgtctttcagggcttcttggatttgaagacaatttttcttctatgaatttggacaagaaaataaattcacaaaatcagcctactgggattcatcgggaacccccacctccacccttttcagtgaataaaatgtaagtcccatgtgaaaacatatttgccttgtaggagaattatagtttaaacaattttacttttgaatctctcatttatttgctaggcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcaggttagtgtctcttttgcttcctgagtctaaaaagttagtatatataacagacagtggcctgttgatatttaagacattagcctaattaagaatcaaaatatgataaaaaggaatggttgcctgtttcaagctcctgtctctatgctggccaataacatgcatatcagaaataatgcagatgctacagtttcccttggattttctttttttgtgtgtgtgggtcagggtctctctttgtcacccaggctggagagcagatagatcatggcttactgtagcctcaacctctcagtcgtaagcaatcctcccacgccagccctgcaagtaggtggaactacaggtgcacaccaccacatccagctaatatttgtgttttttatagagactgggtttcaccaggttgcccaggctggtctcaaattcctgagctcaggcaatccacccgccttggcctcacaaagtgttaggattacaggcttgagccaccgtgcttggccttcccttggattttctaactactaataatgccatgtctactaatgtctctactgagtcctagagaaccaaatcaaggtcacatgtactagagaattttcccctagcacattccataagcaagcgtgtttatatatctggcctgttaagtttttttttttcagccaatattagaaaattaaagtccatcattaccactagctcttaacttacttactttggtaaataaagaaagtttcacccagtcctcttgattgggaggtctatcttgggttcttttatctgtattattttttatttcatcttttttctggacttgtgtgtgtatgctgcatgtgaggtaccatgtggcatgtatcgccaatgcatgaagcaacaccacatttctttgttattcatgagcagaatgtacccttctagtccaagattctagtcccatctgctatcctgtcatacctcatttattctaattcagtcataactatatccctatgctaaaacttgcagttcctcatatcccccactatgcttatatttgtgtgtaaacagttaagacagtcatgagttttcccttctgctttcccccttaatactatgtctgcctcatcagaatttcctacacagatgtccttgtaatccttcaggaagtgagttcctggagtcaactatagccccttatagaacatttatccatatttgactagcttacagcatgaagatacctctttcccatccataagctctcctatcaagtatgagtttggatggagcttaattgaaaggaaatgtggtatagcaattacctttgcattttttaaaaataaagacttggtttccttctgtagttttacttaatgtaaaatttagagaaaataagcccactgcctttgtgttctagatgcaaaagatctttcttacatatgtggcaaaacattttgaggaattatgttagcatattgtgaacatacctttgtatggaagcgaaaagaaagaacttctgttggtttatacttgatctttgttttcaaattatcttttcgtattatgtattagattttttgttggaacttggaatgtgaatggccagtctccagatagcgggttagaaccttggctgaactgtgatcccaatcctcctgatatctactgcattgggtaaagaacacttctggaatttccttttggctatatgtttggtgttcatttacatgatgttttgccttttttaaaaaagactgttggtaaaacctactgtagactatacacgagagttaacttgcgggtcaaatttgtgagaacagaaatgaacagatacctaaaatggtgtaaggaagcatctaattttcttgaaacccgtaggaatctatatattctgcatagaaactaagacttggggtcagttctaacagtgacagttcctaggatataagagcaaagctctgctgttatcctctgtgggaggtattttgatttattttttgcatagcttatgaatgtacttgtgggaattctttagaaaagaaagctacttgttcttactgataacctgggtgaacagagcagttctataaaatttatctctctcccatctttttttcatctaatgtttcaacatatgggacaggaggtagccagagataattatgggatatgtatagatctcatatcccttttttcctcagattccaagaactggacttgagcacagaagccttcttctactttgaatctgtgaaggaacaagaatggtccatggctgtagagagaggtttgcattccaaagccaagtataagaaagtaagccgcatttaattatctttttaagtgtatgactaaatagggctcaccgggagttattccattatctacaacttgttccaaaagaatagtttaattgaattcttctctgtgtgtaatactgggatagggcagattgatcattcatccttatttcctagaaaaaaaaatccctaagctttctgatactatattttcattgcttagatagcttttaggggaaaaaagaattttattatgcttatatcaatacttagtttgaaataattacatataagatttagattactcactgacatggtcagaattgaatgctttacagaaaagcaatatgaaacgtgggcgcatggtgcatgtgttgcaatcagagcaagaatagaagtggtgtggaatttgaacgagttctaaacttggttttaagttaagaggagagttgactttagcaagatgggccaatttgtttgtctttagaaggtatgtggtaaaggcatttagctaccagaagagttaattacagggctatcatactaaggtctctaaaagaagtaatgtgagtaatttttctctacatcttctaacagtttatataggtaataaaactcctggggatgttattcctctcatataggtccctgactaatgtatatctcagacatatttctagctgtagttcacaagttaaaaataagtaaaaaagattgctgtttggttgatttcaatttcttagaaaattagacatcagaaactaggaaggaaaggtggaaggaacaagctgggatagtggctttattatttgaacttttaatgctgcttactcctggtaggctaagaagtgattaaaagaatagatctagagctgaaagtactcattgtccctcccagcttttaactcttattggtcagtgccagattagagcctccccagagaatattagtttccacttgacggggtccactgagaaattagaggatatgaagtcagatttgggcactagtatatcatcttgatggaaaattagtcgtgggacattagaaatgtggcaaagattggtattaacattaaccttttgtaactccccggaactcataggttcaactggtgcgccttgttgggatgatgcttcttatatttgccagaaaggatcagtgtcgatacattcgtgatattgctacagaaacagttggaactggaatcatggggaaaatggtgagttactttggaaatgagcttgattattattcatgttcatgtaaagttcagttgcttgttctgtgtactaattgaataattactcttgctaacagggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgagtaagtggttaactcacctgtagcctttgagtagtggctacaggagtttggatagtgtagagattaaatgtgagatactgtagagctgtgaagagtgaaagattaccagtgagggattggggtcacaaaggagagggtttttgagtaataacagaatcattgaggcagagaaattagacttgatatcagaggaaaagatagttctattagtggggcacctagaataatgctggagggtctgtagttggagtcagtttttattgtttttatgataaaatagaaatattcattgcaaatgtaataaaagataaaattagaagttaaatttcctcatttcttattctctacctagccagtccctctctccaaaggaaaccattcttaacagttgggtgtgtagccttttagatctgtactgtccaatatgacaaccagtagccatatatggctgttaggtacctgaaagtgactggtccaaattaagatatgctgtatgcataagctatatattggattttaaagacttaggaagaagatgtacgatatcttgatttctaaaatattgatcacatgttgaaataatttggatatattgagtaaaatgaaatttattgatactcacttgttttttttctttttaaatgcagctactagaaaacttaaaattatattgtgaggtgcattataattctattaaatagcactattctagccttttgtctattcatatacaaacacacacataggtacttggtgtataagactgtattattctatttattgtggattcctttccaagccagtatatatagatctacattattctttttaatggctgtgcttattaaaaacaggggcagcagagagaggtcagtgaagaatgggatttaataagcatagaagcagagatgtgttgaggagtagatgtggtggtagaaaatgattagttttaaagaaattaatatacctaaaaccatgaaaaccctagaagaaaacctaggcattaccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggccatcagagaaacgcaaatcaaaaccacaatgagataccatctcacaccagttagaatggcaatcattaaaaagtcaggagacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacatatgcacacgtatgtttatcgcggcactattcacaatagcaaagacttggaaccaagccaaatgtccaacaatgatagactggattaagaaaatgtggcacatatacaccatggaatactatgcagccataaaaaatgatgagctcatgtcctttgtagggacatggatgaaattggaaatcatcattcacagtaaactatcgcaagaacaaaaaaccaaacactgcatgttctcactcataggtgggaattgaacaatgagaacacatggacacaggaaggggaacatcacactctggggactgttgtggggtggggggagcggggagggatagctttaggagatatacctaatgctaaatgacgagttaatgggtgcagcacaccagcatggcacatgtatacatatgtaactaacctgcacattgtgcacatgtaccctaaaacttataataataaaataaaatttaaaaaattaatatagagagtagagtcattggggaaagaggaggaaagagtagggatattcaactattttccataatgtctcaataattaggatcatgtagaattctatttcacagtggtaaagtgaaggccttaaaatgtatggtcatgaagttgccatgaaattccaaaaatttattttcccagattccataaatttcatgttgcatttgagattgtcagaatgacccattgggaacttgagctcactcaacaggagagtccattttgatgtgttaattgcattgtctccctttgtggggctctcagcacatctaagggcctgttgctgttattgggagctgaggatcccatggaatgccagtctccttcctgcctgtaacttgggcaatggtagaccaatcaggcttcactagagagccctggacctacttttcttagtgggtcctgcctcggagagctgtcactcagaccatgcagacttcagtggagaacctgcaggacttcaggactctgagaggcagaaaacgttcagattctcttcccctaaagacctggctagcagccaggcaaaattttgaagcttgtccagcaaataaactgcatgcttctcagtccattaactccttggcttctaaatcccatacgtaatatttcccagtttcattcttcatgtacagagtcctcttctcctacctattttgtaatccattgtctctctcaggtgttgatagtagttgccctcaaaggattagttacaactttaaaccccttgtgagatagtggtgagtgagcccttatcaataatctacccatttttcttctctccatccttctctgttttttttatgctaatcgctacttctgttcatacatttttttgatccttagggttgtcatttggttgggagatttgaattatagactttgcatgcctgatgccaatgaggtgaaaagtcttattaataagaaagaccttcagagactcttgaaattcgaccaggtaagtaaagtttcattttataggaactttcctagatgggagatgagattgttagagttatgggaggtatatcttactctagggagtgatggaaacgtcttactgtcttgtgaaaacagtgtgactagtgatgcattgactacatacaagatttgtagtacttttattaagtgcttggatgggaggagggaagataacattagtgataaaaagtaaatacaacatttattcaaaacgtctttatcattaagagatttcagagatttgtctaaatgagttggtgaatgggtggggttaattggggaacacttcctggaggaagtgggccttcagctatgttgatgtggtttggcagatggaacagtgaaaactgttctatgattacttggcaagctgaggaacagcttggaggtaaaagagggaggccctgtgaggggaactgggaagtacagaaaagaagtttgtctgggatcaacagcataggctatgggctcatgggaactagatgataagttgaagctagctggtatttaaaacctgcaggaaaagcattgagttggtaacatttacataaaacctgatattcaagaacctggtttccatatatttgaagcagtaaatttgcctcagaacctggcatgtgacttgaatttttacttcaacatatggatactggctgctaaaagtgaatgcttcttattgagggaggaaaatgttttgacttcattcgaataatctttaaatcgttatgagagccttttcaaccttcagacgtagccaacattcaggtgatttgcagcagaatggtttttgtagtgagccattcttgtctatgtctaccttcacgttgtggttggctgacaaatttctttgctttttctttattctgcctccaaaaggggtacatttaggataaattctgagtcttatataactctggtaaaatatttcagtgaggatctttcaaaacaatttgaaactattcgctgaatttggtttgcagaattattcattcaacatttgtgtgctttttctttaaattaaaattgtgctgggtggtttctgcccagctccaaggaacttacaattattcagatttcatttttccattttaccctctgccactattagcaataaaagaatagtgatgtgctaataacaagcatcctatctgagggtgagtttagatgctgtgggaatgctgagatttaattcataaggtatagaaatttcatttatgtactctcactacagttgtaaaggttgtggaactagatactttgaaataggaacagtggcttatcaacctgattatctcttatattaagatagtgttatcctgcttatttgatgcttctttctatctgtagctaaatattcagcgcacacagaaaaaagcttttgttgacttcaatgaaggggaaatcaagttcatccccacttataagtatgactctaaaacagaccggtgggattccaggtaaagtaataagaaccttctcacagagaaggttaaggcttgatcttatttctgaccctccatattggtaaggggctaggaattttttaggccatgccataagcagatatataaacctaatggctcagtgcctcagtgctattatagaacaataagagtgtttcatttatctatactcaaaggtgagcctatcttagggaagttattacttatatgtcaagattgttgaagttttatgggctacctacagtgccttatttctctcacctcagcaaacttgcttaaatttttgccttcctgattttgcctttgtttcttacctattacctgttctggctattttttttcccaaactacccagctatttaattcaggataccagaaggcaaaaacgaagccatgaagggttcttctagcaccagtagctctcaatccttaaaagactttagaatcccttagagaacttcaaaaaatactgatgcttggacctaatatctgccacagctggagaacactgagaaccactgtttagtagacccttttttttttttttttttttttgagacggagtctcgctctgtcgcccaggccggactgcggactgcagtggcgcaatctcggcgcactgcaagctccgcttcccgggttcacgccattctcctgcctcagcctcccgagtagctgggactacaggcgcccgccaccacgcccggctaattttttgtattttttttagtagagacggggtttcaccttgttagccaggatggtctcgatctcctgacctcatgatccacccgcctcggcctcccaaagtgctgggattacaggcgtgagccaccgcgcccggccagtagacccttttgatttcctaatcatcctagtaaagtgcccccagtaagttcttagtgagtatttgtcctctacctactatctctttcttttcttttcctttccttttttctttttcttttcttctttttctttctgtttctcctagctggctgagcacagaaacttgaaagagaaagaatccccacgcatgttcagctgttttgaactctgagagtactggcatgggtggggagtcgatattcctatgctcctaggtaactggccagcaaatgaagtgacactgttagatcttgtacactttgccatgtttgtttcactcacctgactttagagtcagctgcagagctactgatgagaaatatctgtgtcaccttctggatcagggtacaaggtgttgcttcttttaatagaatgatgaataggttctttttccctacccttggtattctgtggactgacatttgctcagacttgcatggtttgattttatttcgtctctattagaagaagctagacttgtccataaatgtctggtttaaaggagaaatcaatactgttattcctctccaaaaattaagcccagtctaggaagagaagattggagttttagacttgattagttatctatctgttgtgaagtgttgttgatgctcatagagtaaaggaaaaggaagtgttcaaaatataatccaaatcttctgaggatattttaagaacgtgctattttctcctgtggtgacattgttgaagatgtactcccaatcttaacagaaccattcattcattagataactattcgttgagcacctactttgcaccagataccatgctaggttctaggagttcagtggcaaacaagcaaatacagtcccttcacagagcttgcaaaatagtagggaggatgacaggggttgttagggaaggagaagtacacggttctttgggagcatgtaacaagagagcctaaccctgatctaaaccagtgtggtaggtattatgttcttgtgtgatatgttctctttataactcgtttctttacttacagtgggaaatgccgggttccagcctggtgtgaccgaattctttggagaggaacaaatgttaatcagcttaattatcggagtcacatggaactgaaaaccagcgaccacaagcctgttagcgccctcttccatattggggtaaacacttgtttgtacattcatttatttgtgtgttaagtatcaattactagaggattatttagactcagaacagatcagtaattcagcaagccataaatgttccataaccaaataaccatttgcagcattgagaggttagtgcccccaaccctcccaaatgctgtccgtatagctcttaatgctccaggccttttagtgacacagatgtttctcatgctacatagtggttaggtggtaacttgagcttcctaaagtaggtatgcataatgaagagttaaaagctaagttttatcagatagtaaagaagggaaacaccaggagggagattctgggtggaagggtagagacagcaggagcaaaggcacagactgatcagaatacagccaactctgtatattgtcttaagggatatagtgtcatccctacacttattttttctttttttttttttttttttttgagacggagtcttgccctatcctccgggctggagtgcagtggtgtgatcttggctcactgcaacctcctcttcccgggttcaagcgatgcccctgcctcagcctcccagagtgctgggattacaggcgtgagccaccgtgcccagcgaatttttttttaactctgttctatcctgggctgcattaatggccagttatttaattttctgtctgtattgtgagtaaagtttttttcccattgtatttttaaactgtgtgttattggtatgtaggtcatatcttgtaatcatgctgatttaatttgttacagccagtacatttaggttatttcttgtggatttttcagatctacagccctataatctgtcagaatgtatatagtgcagtgcttagtagaatggactttgtagtagacttctgggatttgcatccgagttcaaccactttctaactgtgtaaccatggacaatttatgtaacatatttatgcctcagtttcctcctctattaagcgtgggtaatattggtacatactcatgaagattaatgagttcggacatgtgaagagcataatgggataggtttctttcctctgtgtgtgtgttgatttagggggcttctgagatagatatcaccaacctgttttatcctgctcctgttttaaggaagaaagactttggggcttttcatttaagatcagaattatttattggtcttagaatagattttaaattttatcaagacaatcatgactttacttttgtccattttgaaattttaaaataataatcattaataatagtaactgttcctcagatagcagctagtggctgtgtggcagggactatgtgaggcaatttgcacacatctcatttactcctcacaacaacgctttgagttaaatacagttgatccttcaacaacatgggtttgaactacacagatccacttatatccagatattttcaaccaaatgcagatggaaaatacagtattcacaggatgtgaaacccacgtataaggagggccaactgtgggacttgagtatgcgtgaatttgattatacacaggccatgccagaatcaatcccccacagatctcaagggacaactgtatttcccatttaacagatgagcagatggagaacagcaagttgaaataacttatttaagagcattcaactaggaggagagctgagattccaatcttaagttggcttaactcccaactctgtgctctttctactaccccacaatacctctataattctatagaacttgatgaaatatacctttagataacttcttttagcccatctaatttctagtttgtacttgcaggctgcccctttttcttcatttgaattctcttaatccattttgagagggtatctttcctcaaacactaacctctttggttagatcaggtatgcctggcttttttgtttacatttcttttcaaaaccttcagatttttttgtttgtttttgttttttgttttttggtttttttttttttttttttgagacagagtctcgctctgtcacccaggttggagtgcagtggcacgatcttggctcactgcaagctccgcctcctgggttcacgccattctcttgcctcagcctcccgcccagctaattttttgtatttttagtagagacggggtttcaccatgttagccaggatgatctcgatctcctgaccttgtggtccacccgcctcagcctcccaaagtgctgagattacaggcatgagccaccgctcgcagccaaccttgggatgtttttaatactccatacacattaatgcagagcttctagtgggatatttacattttttttcaggcttcctgtgtatttatgtatatctttaataaagatatgccttttgagtttttaatgatttttaaattatacagcaatgacaagtgcttttaaaaaaattaaaaggaaatttaagcagaattgacagataaggcagaagttcttcaatccctgttctgtctcctactcccaactttgcctaaacccccattccccagccaggccactacccttaggagtttatatctttctagaccagtgctgtccaatagagctttctgtgatgatggaaatgtcctgtatctgtgctgtccagtccagtggcttctagcagcagggggctattgagtacttgaagtgtggctagtgcaactgagaactgaacttctaatttaatttaatttaaagtaatttaaattcaaattccctatgtggctagtcactattgtactggacagtgcagttctagacctttgtatatgcttttttgttcactcatagacaaaatactgatttgtgtgtgtctctatatcataaacggtcttatatgtatgtgttggtctgcaacttgatttttttttttaactcagcagtgtgtcttggagaacctcccatcttattacataaagacctagctcattgtactttttttcaaattcctaattttgtcagtaatttcctttactaaaatggatgtgtcaggttgtgaaattctttggggttccccccctcctcattatctttgatttgccattaagtgctgtgatcatgataacccgctgagaaaaagtttgattttattgagtaatcaccccatgttttggattcttgggcatgctatgattagaggctttaaaaaccacactatattttcaccaccattggcaccaatgactgttaacaaaggagccaagtgcaccgtggccaattaatttcagaagactttctgtgggctggctgagatagagctaggatagggttccaaccctgcacttggtactgtgatctgttgcattggttctcagacttcagtggatgtaagaattgcttagagagctttaaaaaaagtgtggatgcatgtgtcctcacccctagaggctgtgattagtagacccaggcagctgtgcttttaagacatactcaagttgattctgtcacatatctagtatattggaaagagtcttaaactagtccagatgtcacctttggtattcactgtagcagtgagcaagtttgttgattgttttgtatcttaatgttctcaactatcggaacaaaaatattccttgctttggtagccttccaggttgtgaaaataaaaagacatgtgcaaaatacttttggaaattaaaagttgcaaagttttgtaaaagtataaaattcatcttaaactaatgctatactatggaccctggtgatggtaaagtgattgtttgatcctcggttctctaagagttacagttcaaatatgtgaaaaacttccccagtctgagatacttgactcagctttgatgttcttattttcaacattttaaaaaatttttatttcacttcaagttgtgggatacaagtgcagaacgtataggcttgttacataggtatgtgtgccatgttggtttgctgcacctatcaacccatcatctaggttttaagccccacgtgcattagctatttaaccttaatgctctccttcccctcgccccactaccccgagtggcctggtgtgtgttgttcccctccctgtgtccatgtgttctcattcttcaactcccacctataagtgagaatatgcggtgcttggttttctgttcctgtgttagtttgctaaggatgatggcttccagcttcatccatgtccctgcaaaggacatgactttttttattttttgaggtggagtcttgctctgttgcccaggctggagtgcagtggtgcaatcttggctcacttcaacctccgcctcccgggctcaagggattctcctgcctcagcctcccaagtgactgggattacaggcacccaccaccatgcctggctaattttttttttgtacttttagtagagacagagtttcaccgtgttggctggggtggtttcgaactcctgacctctagtgatcctcctgcctcggcctcccgcagtgctaggattacaggtgtgagccactgtgcccagcctgatctcattcctttttatggctgtatagtattccatggtgtatatttaccacattttctttatcaagtcttattattaatgggcatttgggttggttccatgtctttgctattgtaagtagtgctgcagtaaacatatgtgtgcatgtgtctttatagtagaatgatttatattcttttgggtatatacccagtaatgggattgctgggtcaaatggtatttctggttctagatccttgaggaatcgccacactgtcttgcacaatggttgaactaatttacactcctaccaacagtgtaaaagcgttcctacttctccacagcctcaccagcatctgtttccacatctttttagaacctttgctgcatgtatcaattttttttgacatgaatttttgtgaaatttcctagtctaaaaaagaaaccgatatctcaagttaaaatctgttagttatgttaattttggcattggtttgtatgaagttttaatatttaaaaaaacacagctatatcaggaagctgaaagtgctgtgtcaggtggaaaatttttttatcagtggagatgtgtttatacgttgtcatggttttactctagtctaggacattttgtttcagccattttctaaaatggctgtaggttccatttattaatatatctctgctattatgtaatctgagcagtgatattatacttcttggtattgtacatagaatctaatagagttaaaagctttttaataatatttgctgccacctcaccaagttatgattgttagaaacagtaattgctgtgttttgacactgtcattttgtacagtgcaagcaatcatttttaccacaattatcacattttttccactaccaaataacttaacaatgaagcaagaaaatattcttcccaaatatttattattaccaagcttcttaacgtaggggtttaacttttacaggacgttagccaattaatcttacctttaccttaaagcgtgtgcttctataatgctttgttcaatttatgtttgctttagtgaccttaaaaattgttagagactcttggaggtataaaagttgagaacacataaaactaaagcaaggatctgttttctttcaggtgcaagctgtggatgaagcaagatatagagagtgtttgaggatgttgtttgcaccacagtttattttaaatagttactgtaatgaccagttttaaattgttagataatctccaagggagatgagctagaaggatataagactgaaaagaggatacattttctttcaggtgaaggttgtggatgaacgaaggtaccggaaagtctttgaagatagtgtacgcatcatggacagaatggaaaatgacttccttccttccttagaactcagcaggagggaggtgagcaaaaatacatgatctccctgtctactgctcactgtggttagcacagaagaaactgctacttagaaaaggctacatagcaacgtggttaagcccatgtcgctggagtcagactgcctccattccagttgtagcacggctgtttagtagatgtatgacctcaggcaagtatcttacccgctcagagccgcagtttcctttcctggattaaggggtagttgtaaggattacatgagttaatacatgcaaagctctcagaacagcacccggcacatagtaagccctccgctgttagatgctcttatttaatatttcagagttgctagttaatttatatctcagaaaccaggacttggtcacaggatgaatactctgaaccaaggttgggttaccctcttaggatcctaggaatgatcagagtagcctggagaagtagcaagagccacctaactccttctctgctggtgtgagtataataatacatgcaagtggatgttgtgaagttggttcagttggtgaatgtctatggcatttgcacacctgcttaacaattaccttactcctcatatcctctatggaataatccaactgacttacttcccctactagtgatgcatgtttgtgtctgtctgttattccccagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaagtgagttttccctttaccattgtctctgctggtgatgtcatgactcccatccccttggtttaactttctgttttctaaccacatgtctcttacctttactgtcatattggtgatacctctggtgtgtgtcctgtctcttccccctcattgcttaatgatttttttagaggacacttttctgttggttcttatactcttttttgctttcccactggaggttttcctattaccatgtatcatctcttacatttcagatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggtaagaactgtcccaagacataaacctcttttacatttaattttcacaatacttaagtgacgtcctcattatctttgtgctttctgtcttcttttggccacgggggatgtcaaatgataaagaagaatgttactttagcactgttttgattagattaagcctaaggggaaagaggggggactaatctgcagttggctcttgttgtgagtacaatacataatactaagctcaccaaataagattaaagactcccctctcaaagatataatgcttgtttgttaagctcttcatactctcaagtcacttttgtataaattagcatgtacgtgaggtatgctaagtggggcaggcagaattatcctcatttgagcatatgagaaaactgaggcacagagacattgacgtgcccagagtcaaataccatcagttagtaacaaatctagcacccagatttcctggctcccagtttagtattcctcactaataccacattatatctaatcagagtaaaactttgctatttatggaagcatagaactatcctggaaccctggagtacctgaatcagaatccctgggggtgcttattacaggtaccctcacttctggcaatggaatcagaatctcaggatatggagcctacagatctgcattttatccgcattccagatgcttataatgtacattgaaatttgatacttacttaatgtgatgtgcttaagaaagaaaaggaggttgattttcccacctctccctcaagccaagctataatattaatgtttttatgaaggaagtacttactatcttcagtaacataagttgatttagtaataaagttcattgtattaagaaatttccttctaaatgaaaatattgttggattgtatgcagaatctctttgggctacaaaagtatattcttggtttttttaccaaagaaaattaggtgaggtgacagcatacgttatccttaccattagtattcacatggatcctttaggcctagccagagcgagtgattgtatctagcagggaggtctagaccagcaggcaggctgctggcttgtctgagtccgatctgttctgttgccatggaattgttttagctgtgactcagatagcagattaaaacactgagtccagccccggcattctttcttggaattatacttatttccccagagccctcatgactgagtatattacctctgtttgagagagaaccattttcttcagaaattcatatcctaccgttctgctgtttttcatgataattgtttttctcctaacattatatttctgtcttttagattttagtatttcaccttttagaatacattttggatgatgaagttgtttttcttatttctcctaccccctttccttcatctcagacattatttcccagctttctttgtttcagctttttattatgaaaaatgtcaaatgtgcagaaaaatggaaagaacagtacaacacacccccacatgccttctgtacatatatacacacagatgttttttgctgtgtcatgtaaaatttagtggtaatatgtcacttcaccactgaacacttcagcctgcatctcttaacaaaaagggcacacttaagcacaataccattattatgtataagaaaactaacagtaatccatagtatcatttaacattcggtccatattcagatttcttcagttgtcccaagaatttctgttatacctttttttaaaccaaaatccaatctgggttcatatagtatttggtgaggtctctgaagtctctattggagtagtacagttcctactttctttagtgacattgacttttttaagagtccagtacaaatgtccagtcaagggtcaaccatttcctaaatttttctggttgtttccttcttgttttttttttttttaaacttatcccatttatactctctccttccaccttcatgtaaacaggaacctacccttatttttagtcagagtcagtgaagatattagaatatctttgccattaatatgaaaaactgcaaagccattaatatgaaaaactttgcagtttttcatattctgggattggccagaagaggctcaaccctcataaagtttttattttatgtaaagtatactatcaggtaattttaccatgtttgcccatgaacagaaaggaaccaaaatcattagaggaatgaatggctctttgggaagcctttttccttctttttgtgcacaagtgattgagggttaaaataatagaaccctgatcatttttaattacagaatttctgagtttttattaaattgtatgtgtgtggacatcatttttcttttaaagcttttattttgtaggatttagggttcttttcacagtctgttgcatttcagtgttattaaattcctgtatctcattgatgaggaaattatctatacaggttgattatccattatccaaaatgcttgggaccaaaagtgtttcagatttcaatctttttcagattttcaaatatatgcattatatacttaccagttcagcttccctaatctggaaatcggaaatctgaaatgcttcaatgagcatttcctttgatcatcatgacagtactcaaaaagtttcgagttttggagcattttggatttctggattgggaatactcaacctgcattactgtggagcagtaaacaagaaatctaaaaacaattagtatcccatctttaataccttctcactctgttgtgacttgattttgaccttctgaaatgattcctcaggtatagtattcatgttttttttccccaagacccaatatcgtatttcaaatctcatgagatgatgctgttaataatggtacctgccctctgttgtattatttgctctaaaattttggtaaagccagaaacgagttcaatgtatgtgttgtctctctatgtactgttttagaaagatccttatgcactgttttagaaagatccttatgccacaccatcttcccaccaaatgcagaatgaaataactgacataattatttttcatccttccagcccttttcataatagtgactttgccactcctagaatagttgagattagcacaagtgggaaacggatgaaaatctaccatttgtaatcatctttattgtttttcagaattaagatagatttttctgttatattaactagaatattaagtagcaaataatcctcaatattgattcattacacactggatacaaagtattatggagtttatgtgagttcccataatttagtggtgatgaaagtatatttgcacataaaatatggctaaactttaagtcatggttaatagggagtttggttaaagataatctgaacattaaccacctttactggctaatgtctggtgtgcttggtaagtcagtattttggaaagtcgtttaaagtgactgctatgaaggttgtagtttgtattaacaataggttcctttcctatgttgtttattcaagcccttatatgctataaaagcttattgactgaccagctaatccctatagaaatcagaatcagcctgttttcattttaatgaatatttgatacatgtaacattaacatgactgagaaataagtttagcacataagaataaagtgaactaggaaggtgatttggagttagttatagaagtattttcagtcaagtccaagtacttaagaaacacttattaatatagtgggtgagcaggctcttccaggcttagaggacatcttgaataaagggtagaaggtgaaagtgaaaagaccatgtatgaaaaactgtaagatttccctgggacaagtgaagatcaaggataagaatgtatgaagctggttagggagaatggggcaggtggtagagagtcttgaagtcaatagataagtttatgcatgagccagagggtatctagaaccatcagaagggtttgctgattagtatgaggttgcaaattgatatagttggaagaacattctggtgttacttgtagaatggactaattgaaaggagacaagacttgaacttgccagatgtggctaagttgtaaatacggagatgaaaaaagttgagggatgggtagagaaactatatttgcttggggacatatctgttgggagaacaatatcaaaagtttgaaataacaggaataacttgttaatttgtccgtagtgtttttttcactatgtttttactttgtcttactaatctaaccatccatttcttactctgttaagtatatggcttgtatttcttctctatttcatatgaactaatcctttttagaacttcattttccattcagttttcggctatttatttatttatttttgagatggagtcttaccctgtcggccaggctgtagtgcagtggcacaatcttggctcactgcaacctccatctcccagttcaagtgactctcctgcctcagcctcccgagtaactgggactacaggcgcgcgccaccacgcctggctaatttttgcctttttagtagagatggggttttactgtgttggccaggctggtcttgaacacctgacctcaggtgatccacccgcctcagcttcccaaggtgctgggattacaggcgtgagccaccgtgcccggctatgctttttatttttaaatttgcatcttccacctctaattgactcttttattttagctgcatttaccacggggaacagtcttctgagggtgaatgttggggtaaagaatgatttgcattgcatttgctatgtgccagtgttgtcccactggggaaatcctgaactaagttctctttttaaatgtaatccatatatagccttttgcagagaatgggcatctctgctctttaaaattggttgaactaagtgattcatagtagaaaccttaggattattataggagtaagctgtttactaataaaggttaagtgatgcttctgttttcaaaattgagaccaaggttgaattcaatgtaatttctatgttgtttctttgtgcctgtacctagagaagtaaatctcttgtccctccatcagtatttaatcaaagtccttttgattcttctttcagaattttctcttgtattcattcatttgtaagtgtatgtatataccttttattatatatatatatcctttaatatatatacttagaaattatatatatatatatacacacacctgtgtgtgtgtgtgtgtgtgtgtgtgtataaaattttccattattaagatgtttaccttcttctgcttgacctacctcggtagcctttgaatgatccctttgtctttctctctctctctctctctctctctctctctctctgtctctgtctctgcccttcattttttcctattcagggctgtcagattgatctttctgtactactgctttggggcctatcacttccttgcttaaaggtagtcagtggcttccccatgcctgctgaatacaatccaaatgccttaatctgtcatgcaaggtcctcctaagtctgacttcaacataccttttcagatttatttcacactatttttcttggcattctccatgccccccacaaacagatgactaacttcttcctaatatcaatttgtgatttactgtctctgtgccttttgtttatttctgcctcttccacttgtaatattctctccccatctctaccctttaaaattctgtgagtcttttaaagggctagcaatgatttattgagaactcgtattcatgaattataacaataccagtctgtaaactctggaactcctcaccccaactcagttgcaaatcagagtcagggacaaaccaggtctttctcctttatcctcatttctcattgccttcccctgcaaaggcattttagcacaatgccttgtactggaggatggctgctgcttaaagaaaacttttttgagagcctggttcgacaggttagtatacaaaatctctgtctagttttattcatatcatgtattagatattcatgggaggaaaaatataaaatgtgtcagatagattcttcatttgataacaagtcctaaattttacaagaggttctagtctaaaattgtatcagatgttgggcactcaaaatcaacttgacattaaaaggtatcgtaattatagtactataaatatgtaccttataaagactattctaattgctttatttcatgtgatatttaagagtctagataaacccacaaaagcatgtttaattcgtgaagtatctaccaatattaaaacgcctaatccccatggataacagtagtgtgggaggaatgcattcagtattaccactaggaatgccagggagcacatacttttcctcctccctctccactcccagctcctgtgcatctcagacagtaagattgggatttctccttttacctagcagaactaagacatgtaatttagacttgagtgcttagtggtccatagtcagattcgaaacaatccaggttgggagtcactggggaggtatgaggaactttgaggaacccagaccttctgctggcatactgccccatcacccattggttttaggctgcttcaaggtaaatattactatccctattttagagatgaagaaactgaggctctatgaagtttggtaacttgtgtgagggctatacaaaattgccaagaggtggaacgaagatttgtacccaagcctgtccaacaccagtgcctatactctttccattaaccacgctgtcttttaagtggggtttctcactgtccttagcctgttatggagaatacattctcacagttttcctctacctctctgtccaggaagcagtcacattgtcctttttgaattgtctaacggaacatagtgataatgactgtggagttggtcagacctgggatccaatcctgattcagccacttactacctaatagtgagtgtggccttgggcaaataatttaagctttcagagcctcagtttcttcatctgtaaaatgggaataatatctactttgcacatgtgtacagattaaatgactgtatataagcactttgcacagttcctgatacatgacagatgctccctaagtggtggtggtagttatcatggctgctattattattggattgtaataacagcataaaagataggaagattaaaaagataccttcttacctatcccctgcctctctttttttctcttatgcccaataggaaaataaaaatgggataatgatggatcttctgatccgcaaaggtctgaaatgaaattcatttatagttcagaaggaccttcaaatctgggcactctgggggcctttgaggaggggattgggtacgaggagatagaaaggaatctgggatgctgcttaggagactggctggggtgagaagaatgaaaatggaaagtagagtggtttaccatctccttccagatggccactgttgggcccacagccatattctttcattgaggtatatacctcaatgcacctgcctccaagcagcagacaggaagagacatcaggggcatttggctgggtcagttggcagatgccaaagggcactgaagtctagaactgcacatatttcttgagtgatattctcaaactgcacaaaaatttaaaatgtatagtaaactttgtgtatgaaaaatgtatttcattttcaacaatcataatttatttgaagaattcaaagctgtttaaagcatgtatatctggtaagatagtgagttctaatactgatctgtttctaattctgtaaattaattctaatcatattctgtctgtcaatgactttcttttcctgctccgctctcaggaagaagacagcttcctagaaaaggtaatgcaatccattggtggttatgagagtttccctgtgcttgattaacacttaactgtggtccctggaatttgtccctaggctttcccatatcagagacctctgacttggtgagactcccctaaagtcctgccggctgtccttaagtgtgtttgaagtacaggaaagatatttactgtagcagtcaagtcattgagactcagtacataaaaacagtaggactcaaggttctagatttgtatttttgaaatgagaagtaactacagagccgtcttgatgtatctgaatgctcatgaattggaggggggtaccagttagctgtcctccatttccaatgacaataaaacctgaagaagtagctttctgttgcattaaaaatgatttgaggttaatgatcatagcaattaatttcagaaaaaaatacacagatatgatcaagaaatagagcatagaatagaaccgtggacctgaacaagatcataaaagatcatctggttcaggcctctaccttcagacagggtattttctccattctaatagatgagacaaccaaggcccagaaaggttgaaaaacttgctgaagtcatgcactgtacccacttggtggaatttaatgccttttgatgatggggatggtatactgttttcatgctttagttattaacactaagtaaggttacagagtgtgggcttatcaggcgctgaatgtgtcttgttgaaagaagacaaagtaccttggttttcctttgaaaattagagttcaggataatttgtgaaattattcaagtattttctgtgtatgatctttctctagactttggagacacaactgtggcattccatattatcatacaggaatttgaaaatgaatagtggatggtgtatataatctactgacactttattaacctttttaaaccaccaaggtttgagacagctgtgcttcctagctcttccctgttaagagcagtccatgttctgtctttttatcttaggcagtgccttgtgttgccttaatgccttagtacaggaaaagctccagttggatgtcagactttttaaaaagtacatgaatcagtgctgcataatttctatatggcaagtttggaggcatctgctaaagaatcagtacacgtgctgcatttggtccagagagttagcagagtgcatgatggacagtgttttgtctcaaataccatgtggatgcttggatttgatatttgtaactggaaagaagtaaatggatgagccattgatagacattctggcaactattaggaacatgaatatcaagtgatagaatcccagggaaagaaaggaagcaaactgaatgtggggaaaaaaaagaaagattttaaatggtaaccaactgtcacactcccttctctttcttattcccttggaaaggcacagcagcttttaaaggtcatcagtgcttgttaaagaacacaatgttaagaagagacctcagctcggctgtagtgtatgtggtctctgtcaaagtagtgacatgctcctttttttttcttttaaagctacgtgactgggggttgtggatggaattcacaagttgcacaatgttaggcaagaatttcttagttaaacatacagaatatatatgacctcaagctagaggcgggggagggaggaggatgcaaaaaaattggtcatggttctctccactgggatttttatgaagggtgccttcaggtgcctttactatttcaaacattttttcatgtaatttatatttgattacatgaacctaagataactgagtttatttcctagccatttccaattcacatatagtgattgatttgatttatgtcacttctgggtttttctcttacaaaattctttcagaagaatataacagatagtagaaagatagatgaaaggagtaaaagcccctagaaatcttggctgagctattcctagaaactgtaacttctggactcagaccttaaacttttcgtggtatttctgcctcttggttagctgtattcagtttactatttttggaccttaaggcttacgagttttagcaccttaagattagaacttccatcaagcctgaagtatttacatatgtgggtctaatgttgtggagagttgtctttaattcctgaaaactaaagaagctaatttaaatcaacattgaaaacaaacaacagtatctgtggtaagacctgaaggaagagtaagttagaaataaacaaaaacctaagtgtagaccttgatctctcaaactactgtattgacaattgtaatttaatagtccccaagtcaccagtgctgtatggactccactgtgactgtatcaccggagcactggttctcagtgtcacctttgaaaggatttaaacacaaggcatccacgtaataaacatcataaacgcaaatgaaatgcagaacaattaagtgaagcatttaggaaaggacatcctttaactatgggactcgctatcaagtgccttctgaccaggagtgtccccagtgagaagaaatggaaaatcttaagagatgaagatcacattttacctgcatgaccagaatttgaaggactttaagttatacaccaaagtctttattctgagacccctttgattctcatacttttccatctattaggagaaatcccttctgcaaatggttcctttggatgaaggtgccagtgagagaccccttcaggttcccaaggagatctggcttctagtagatcacctattcaaatacgcctgtcaccaggtaagtgagagtagaccttccctacaactttggaaggtgtgtaactactataggaaatcacaacacctcacgtcagcatagcgcttttaactttcccaagctacctgcacacagtggcactgtcagatcgactgggtgggtggaagtgtcctagtcacagatgtcacagctgaagcatgtaaaggtaagttatttactaagacaaaggcctaagtgtagttgtggcagagccaggaccaaattaagagcacctgtctcctggctaccctctcattttccctggacagctgcacacctgagtctataatgcctactttggctatgagtcatgtaggcattagagattgtaaaatccaaagcagattttaaacccattttttaacttggtcctaatttttcttttaaatcctaactaaaatgccaccccacctcattcgcccccaaaagagatatttcttgggactaaattgaaaggtaatgttctcttacctactgacgaataatgtaacttgaaagcaaggtttagtatgagcatgcgatttcctccttccccagcgttcagtagtactagcatttgaatgtggttattctgtttggactctgccttctgctgcttgtcaagaggctacaagtaggccaggcatggtggctcatgcctgtaatcccagcattttgggaggcagagacgggcgcattgcttgagctcaggagtttgagaccagcctgggcaacacggtgaaaccccatctctataaaaaaaaattttaaaggaggctagaattagaacacctggtttcctgctctagccatctagtcccctgccttattaggtacaggctaaaacctttgaaaagatcattttcctatttgaaataacatttcacatggattagagaaatgctaaaggaaaaatgtgttattttcacacctccatttgtaattattaacacacataccacccttcccttttgcttcctgctgctcttctgatccttgggtaatcatcataacctcaggagtgattatcttgcctgtcccttcattctgacttctttggtaggaggacctgttccagacccctggaatgcaggaagagctccagcagatcattgattgtctggataccagcattcctgagacaatccgtatcctttgcgaccaaagcttaagaagctggatgagtacttgatcaaactcttcttcgcacctatatttgatttttgtggttctatatttattttctttgtaatatcttttattataagataaccactgactatccacttgtttctcatttcctttcaggaacttttgacctctttccatatccagctcttactaaaaggaagcaaggggtagataacaatgacttaaaagcatgggacatagaagccacagcactggtactattctccttcaggtgatcagtcactcctgccaccacacgtactgttgacagggcagggagaaggatgggaaacatgggcacctggtttataggactgctccagtgtcaactgtcactctgcaggctatattcccctgaccctgaagctgggccaaagctgccaagagtctttgaccaattctgtaacaactcacctgcagggcacttgaatcaataaaatatcaaacccccattaggatcaatgtgccctgaataagaggagggaaacagtccctgtaggagcttgaggaaaggagctcgtcggggctctgtgtggcctttctcctggagctcctttcccttgacttaagttgattcagctggcagcaaccactctgtggctgaagcactgctcattttcttggaagccctgccagagccagtcatctgttacgagctgtatcagcgatgtcttgactctgcttatgatccccggatctgccgacaggtgggttctactgacctggggatgtgtttgacgcagattgccccatagagaagtcgtcagttttacagagccagataggcagccagctgtctggtaggatgggtctgcatctgttattaatggcaggacaccaacattgagagttgctacccttaaattttaggttgtgttgtttcctacgatatttgccacctttttcccattggcctatttctgtttacagaaaacatagtggggtggatccctctactctggggtaaattggtgaagctgattgtacgtggaattctggctgacattaccaggaaggatgggtgacacttgggagcctttcttctttttctcttcttggtgtgtgtttttaatcctgaaatgattttaatgcacagtagctgacagtacctgtgaattggactagtgagtattgagaggagtccccatccatgctaagtgacattgtaaagaaaaccattcaaacaaaaaagaacagaaaaccattcagcttggtaggtgccgtggctacatgcctacggaaatgggaaaagaacagatgaacactgacctattgtgaggcagggtgtgcgtatgaatgtgtgatgaccacgtggcctggtcattgagtggacagggaccaaacagcacggccactcttactttgaagttataatttggaaggtattgtgttggccatgaggagataatagaagttagacagatgaaatgggtcctgcaagggttggattatagactactattacagcagctgtaagttcctcttactttcatcttccacctgtttttctcactgcctgcccctatttttaaaaacaggtgatctcccagcttccgagatgccatagaaatgttttccgttacttgatggcattccttcgagaactcttaaaattctctgaatacaatagcgtcaatgccaacatgatcggtaagagtgcttcatgcaacacggggcgtttgttgagaatactcttagtgcattgtatccagtatataccttactgcatatgcaggcacatggcagtcaatagtccttgtccccaggccctccagccctgaggttttgcttaggttatgtctgacagaagtttccgcttgtctttctctcgtcttgtagctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtg
